United States Patent 11,001,841 (CCCTC-BINDING FACTOR (CTCF) RNA INTERACTOME) - sequence listing, part 23

SEQ ID NO: 57395 - DNA, 1070 bp, Homo sapiens
gttttctaagccagcagaaaaatggttgtcatttaaataggaagtaaaatatccaatatggtataaaataaaaatgtatcactataaatcttgaaacagagagatagtggagataaggctggataaagtagcaagctaagccttatcctagcctggggagaggaacagagaagatagtgggagcattgggaggaatatataaataggatggtctccaggttctagaagagtctagtaatgctagatcagatagtcactgtatcctgaagcttctagaagtcttagagcacatgctgattttagtccatgtggtccacgaagtcttcttcacctgccccatccccttcctttccaccaggtacatgctttacagaatgtaaagtagcttttgtcccggaatatcagccaaaggtggtgacattttttgaatgaatgactgtctctttaggcttataagtctttgttataacagtgttaatagcttattacctgcttggatattgtctgactaaattattttggcagttaatttctgcttcccttgtggtttcatttggattcaaaatgtatacttcctgtcctatcttaggtttcatttctttgctttctaacagctgtggtcttctgccttcatggtagaagaagcaattgctgagttttatgttgttgtttttaatggatgtgttacagtaagatctggacccactagtattgcaagtttcatgaggcagttttgaggtggagagtggttcacactttaaaagggctggtgtgttttatacttgagaaaaattgtttcctgcctccggctagcctttcaaatttttgtattagtgtcatgaatgagtgcctgaaagtttagatgggttagtttaattgatcttgtgtagagaataaattataaagcatacgtcttgtagatagtggattattcatctgtttgtaggtatattggcagatggccattatatattgccattaaagttttgcagtcaagccatattttagtttagttgctgtattgttatgaatagacttatcagctgtctgggaaattgtaactaagcatt

SEQ ID NO: 57396 - DNA, 1877 bp, Homo sapiens
tttaggaatctcaagtagactatgtggcagctttgggtttttttcttgtctgtttcatttacaacaggatttctcaaccttggcacttattgacgacttggtccagatagttctttgttgtggtgggttgtcttgagcattgtaagacgttcagcagcatccctggcctctatccattaaatgccagtatcttcccttgcaatcgtgacaataaaaaatgtccacacattgccagatgtcccctggattgtaaattcacccccagttgagaaccactgatttagaaaatatatgtagtaaagatatatatgcactgcatgggttcattttcttgttttctcctctaagccacagattggattttcttttcagttttcttttaggtagtaataggctagttaccataggcagacattatccataaacatttgtacatattttaatttcttaaatctgtgttcttttactggcaattattgaatacttattgtatagagcacaattaccggggttatgcctttggcaaattaaaagaaagacatttaagtagctataatagtaggtcaaaggtattatgtaagtataggcaagaagtttattccaacagaggtggagatggggtggagagggtgtctttgaggaggtgagatttggtttgtacattgaaagatggatgggattttaataagtggatattgggcaaattgccatttcaggcgggaagaacaactcatggctcctttattccaaataagttttttaaaaattgattcactcacttaatacattgcattaattagtatgctgaccacatctaagtttttcttagataaggtaggtttatggacagagaagtggtgatgtggaagtggtagttcaaagatttggtggctgctgtaggcctcaaaaagggaaaaggaatttggtcaggcaggatcctacagaatcccttcctttaactgtactctttaatgtttaccatccttcaggatcttttttcacttgtgtcgctctcttcttttaaattattccctttaccgatcttactttctgtgaaccaatctcaattttcctttaaaaggccttcctgatctgatttttcttttcaagttctgtccttctttacctttgttttatggccaagcgtttcaagtttgccctaacctatgtttttcctttagttaccatctacttttccttaatcccttgctatcagtccatttttttctgagtacattattgaaattaccatttccaaaggtgccaaagacctcacggtggccaaattcatttactgattgttttcctttccctcaaactcacacttttgttttccttcctctgtgtgtccccctctcttgtatctgtccttctatccattccaccaataaacattcagtttgggccatgctatatcccaggtccctggggataaaaagagactgtgccctcaagtagtttcactgggcatacaagtaagtactcaattaccaaatagttcatactggcagtggtatatacacagaggctttacagggtgttctgagctctgttgcgtttagcatcaagatttcatgattctaattacattgcccattcttttgaaaaattcttcctactgttaccttacctgcatttcttcctgcaagcatcaagaaggaagcattgatctggggctttaagcaccatctgctactttctgtgtgggctaacaacttaacatttctgtgtcttgatttctttatttgtaaaacggaacattgatctcctaaaattgctgtcagtgttaacaaaggtttacatgtgtttaacaaattctggttctttttcaggttctttaccacctgtccccctgccaattaatctttgcgttgctt

SEQ ID NO: 57397 - DNA, 3265 bp, Homo sapiens
cacataacttattatagcttatgtcataattattccattttattattagctattgttagtctctcactgtgcctaatttataagttaaactatcataggtaaatctgtataggaaaaaagtggtatatatagtgtttgttaccacctgaagtttcaggcatccacagagtcatctcccatggataatggaggactaatgtacatgtaattctgaaaacagctttgggctaataggacttcatttatagaatcctcaccttgagataaggaggtagaatggaggtagagttgtgggaaggagaagttctacagcattagggggaaatatcagaaatctttagttactaaggttaagtgaagtgtctttggatttaactttttcaagtcataaagaagaaaaactttgcagaccctttgatgattagtgttttgttctcacagttcttgatggcattttcctactgttgtgtcttgtcttaaatgacaagcatgattctgaaagtctgttataactgctatattgcattaatattctcatctgtttcccaaaactctttgggttcttttctcagatcgcagaagttgagttctttttctttccttctccttcccaaagacatataatagtatttcagtgctgtgttagttgggatacagtataatggatgtgtctgttttactaatactgcctcttagaaaggttacgaattatttacttttgtatcaggtgatcacctaaccagattatctttgagatactgtacagtaatgagataattagtagtgaggtaatcaaaggaaaatgcaactggaagatggtattcaaagagaaaaatgagttaaagactgcttacttgaaattttttttattactggtgaaaaaagtaaaaaagcatagtgttgagagaaccaccataggataaatttggacattaaagagtgtcttaggacatctgcagaattttgtgtgtgtgcatacatacaacttgtgtaatatattatgaggtgaaatttttgtacttttaacatctaattctatgaaatcatattcctcaatttctgtttaagtaaccaaaatgacagtattataccttgtctgaaataatcattagttttgttttttgatgaaaaaaggttagaccattttaagaaccacaactcaaataataaggcatactggccataaattctggtttatgaaaggaaaataatgtaacagattaattgctttctggttttctaatgtaatatattaatttggttgtttaaacgcatacacaggtctttttggctccctaagacagcggcacggcatagcaagttgaatgagccaaggagtttgaattaagactggcttaatttgtattttggttgtcctgagttcagatccctattatatactagcaatgtaaccttgaagctctctagttttttaccttggctacctgtaaaatgaccatggtagaattactaggagaattacatgagaagatagacacagtataatccctccatagccgtgggagattggttccaggacccccacaataccaaaatctgtaggtgctcctttatataaaatggcatagtacttgcacataacctgcatacattgtctactctaaatcatctctagatcacttacaatatgtaatacaatgtaaaagttgttacactatattgctttttaatttgtattttaaaaaattgttatttttttctgaaaaaaaatttttttttttttttttggtctacaattggttgaatccatggatgaggaactcaccgatagagggccagctcataccacaataaccctcatgctttctgcttttttgttacctgtgctgtttctttatacctgaaataacaattagtctttccactatttttggcagctgatttgaagctacaagtgatggcagttctcaagaatgtgtcaccaggaacaattctctctccctttaaatgctaacagggaattgttagcatttcctttgtatgagggttacttgcttttgtgttggatttgggagaggtgtgcagtatatcctgatgtggccatataggtatatcctttaatattaatctttgtgaaacttaggagactcctgagttaatatcctttatctaaaaattttttggtatgtgattttattattttataaataatgtttttagtaatcattttgacctgttgtttgaaaggcttattatactcttagaccatctgccatatagcttctgggttagcttccattcgcatgtaatctggcatacactgacataccttttcttttttcagttctgacattgaggcttgtatagactagcaataaggaataacttcacagagaggctgtttgtttgttcttttgacatgattgttagtagtaatagccagcacttttatgttgtgccagacagtattccaaatattgtgtgtttattaactctttgaatagtagatgtatactattattgctctgttacacagctaggcaaacaggcataggagacatacatgcagaaagtggcagagctgggttttgaacctagatatcaggctgattctatctgtatctgtatagttttataatcttatttgcttaggattgtatgattttatttttattttatttttgtttatataaaacataatgtaatatgtagaattataaacatatataatctgaacactcttctcatcagtgtcaaccttcctaatgcactttttctttgtagataataagcgggaagtgggccgggtagttttgccaaaaaacttacttaggggagataagtttttcttgtatatttgaaattaattcatttagattgctttatcttactgactagttgacctgctattcctcccttattatagctgttctttctgcaggttttgtctttagttagtatcactacttagatacagtttatttcctagaacactggggaatattgagaaccagctattatgggggaaaataactttgacctatcagggctaatagtacaagtagtgaatgacttgccagtttttgtggataacttcactgcagaagatttggattccattttcctcactgacttggttattacatagagatgtttaggtgccagcttctgacactgaggattataattttgcatgtatgaaatttaaatcttggataataacttgcttctaaaggaaaattcaatgtaacttttaaaaagtaacagattactaaagctatactttatatgtgacctgatatct

SEQ ID NO: 57398 - DNA, 1090 bp, Homo sapiens
attccttctagagtgtctaggaggaaaatcctttttcttgccttttccagcttttcagactgcccacattccttagctcatggcccccttccatcttcaaagccagtagtcacattactctatattctacttcccccaccactctttctctgactctcctgcctctctttcacttagaaagatccttgtaatcacattggacacacccagataattcaatacactctccctttctcaaaatccttaactaatcacacctgaaaaatccctgttgtagataaaattcaaggttctgggattaggatgtggacatctctaaggagccattattctgctttccacaatagctatacagcctggaacagtgcctcaaatcacatcatagaactcagcctgtgaagacactttgcagaaccttgattgtgtcagttactttgcatccctgatcctaacaccactcatgctggccctattggaaattggatgtgcttgctgctgctatccagaatggattagccacagtccccactttctctcattagttcacacttaaatgtggggttgatgtgtttgttgatggagcctgaattatgtgtctgtacactagctgcaaatgaagctggtaaatatataatgggaagcaggttctgctttataaattgtggggatttctcaaaaataggaagagaaattcagatgctgggcttgaataccaaccagagagaacatataagtacagttgagagtcattggtataaggattccattcgtttgacaaactgtaccagagatacacagatggatgagatacatttctgtttctgttggtgctagccagagcaagagtggaaagccgtgttcatatgtcagtagcctaacataaatcagtactatttctctgagactctgataggaagccagctctgttatgtgaaggcttttcacttagtgtgtttttcatctgttcaccaaaaattgctattggctgtacttttgcctttcaaatggtgacatgagaatagttgatagaggaaggtgggtaggttttgaggtttttctctttcactccagaaggttatcagttaaagtg

SEQ ID NO: 57399 - DNA, 1028 bp, Homo sapiens
cctgtgattatttattatttattttattttatttgtttttagagacacgatctcgctctgttgcctaggtattgtgcagtggtacaatcataattcactgcgacttcaaactcttaggctcaagtgatcctcccacctcagcctcctgagtagctggaactacaggaatgcactgccactgttcctggctaatttttacaaacttttttataaagatagggtcttattgtattgcccaggttggtctcaaactcttggcctcaagcgatcccctggcctcagcctcccaaagtgttgagattacaggtgtgagccactacacccggcaacctatgattatttagaaatgtttgattcatttccaaatatttgaggaattagagaactttattctttaacttagacaactaattctagttgtttatatatatatttttaaatttgtacttctatgactttaattcttttaaatttctgagatttgttttgtggttcagcatatgttctatcttggtgaatgtgccatgtgcacttacaaagaaggtgtattcttttgttgggtaaaatgttctctaaatgccagtgggatctgttgggttataaccttagtgttggtctaacctcactggtttgttttgtttttgttttttattgagacggagtcttgctctgtcacccaggctggagtgcagtggcgcaatctcggctgattgcaacctctgccgcccatgttcaagtgattcttgtgccttaacctcccaagtacctgggactataggcacacgccaccacacctggctaatttttgtattttgagtagagacggggtttcgctgttggccaggctgttctcgaatgcctgacctcaggtgatctgcccgccctggcctcccagagtgctaggattacaggcgtgagtcatagcacccggccactttactggttttctgcctactttttgttagttattgagagagttttggaatctccaaataattatagatttatctatttctctattccctgtt

SEQ ID NO: 57400 - DNA, 1219 bp, Homo sapiens
catttatgaaatgcgtgttttatcttcgactttgtggcttgttgttctctggacagcctgttttctccatattaactccttgtactttgtcttgtaatgtccctttgtcagttttttcatattaccatttccaaataaatttggtgtgccgttacttacattaacactacttttaattctagtatctactcatatttttgctttcattttggtatccttcttgtttggaattctgttaaccttttatctgtatgtgcaagcatctgattactttgttatgtcttctaaggtggtcttatctgaccatttatatattgagatactaattttaatctgtttattatttcaagaaggtacaggggttgttgcaaaaaaaggactatttttaaaaaggcattgggttcattgctttggaaagcattgttttggcataccttgtttaatgtaaaaattgagatgaggggaaatagctttcctgttgtttatggcttaacctactttgcttgtttcattcatttgggttgtgagcttatgttctgtttgaagttatagattttatatttatattatgttctgtttgaagttttagaaatatttaatgttctgtatatattatatagattccactacgatgaaaacaaagtgtgaatttcagagagccaagtaaatgattatgtatttatctgattgactgtataaaatggtaggttttcttaagaaaaaggatgttattcctggttctcagatggaaaacctttcagattgtttttggtgaagacttttaaaactattgtcaggttttagaaaccttgagtttttaggatctttaccttttattgagaaactgtttagtccaaattaacctgaatttatttgagcaacttgtatgctgtgcactatgtgaggcactacatatgcgtaattgaataggacagtttctagtgaaggaaatgtgtacacaaataactttattgtagtcctgtgagtccaataatagatgtgggcattaagatgcactgggagtactcagccaaactaagacctgcttttaggagttactgagtttaaaatacaagaatgggttaaccaaacaaggagggaagtgggagggcattctaggatgagtgaaaaagcatgaataaggatactgaggggcaaaacaacaagaaattaaaagtaattcaggtttattggatcacaaagtgtaaagtgaaaagct

SEQ ID NO: 57401 - DNA, 1895 bp, Homo sapiens
aaaacgtgacattttcaactgatcttagcattattcatactacctataattgtgttttaattgttttacatattttttacataattgttttgttttacatattttttcttcagtaaggagtccatctgcttctgtgttctacagggcattctcatcctggtcttaaaagagccctgcttggtaaccggtatctgtttgtcctgtagtgatcactcagttttcagacagtgaggaacattagaataacattttggtctataactagaatctgttagaaatatatgagacagaatttttaaatgtttgttctaagaaacattaaacaaaaaaagaaaaaggctttgacatttttcctttacctttcacatgaagtcatttcaaataaagataaaataattttcttcataggggttctctgttattgtgggttaactcatattttcctcctctcctctatctagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggtaggatgaaaattacaagggatttctacatgtttttattccttttggagatgtgtattattcatactctgtgaatactaataaaattagaaacttcctgaaacatttgattttggccaagatcgggatggggcatgctaaagttttattatttatgtgacttcttgagaaccttggcttatgtttatactttgtcttgagcatttttatcttgtggtccaaggaagcttttgaaaattttactgaagtaaatttttaaaaattttgttttatatgaggtctctgaatatttatgataaacgtagggacacatgatttatacctcatcctttagaatgaaagtttctgtggtttttttacatacttagtaaatcatgtgagtgcaggtaacatcagcttgcagttctgtatgtcagcgtggatgcaatcaagcctcccaagtgcctgtagaaataggtgtatgatagtatgctagagaagccctcttgtacatgtgaattagtaactattgctacagcagcttataatgacagaaaatgcaaagatgcttgatctcaaagatgcagcttttaactgagagatgatagttgcctctgcgagagtgatacctctagcctggccatttcagaaggccttaaatatgtttatgagctctggggtttggaactagattgcaagggtggaacccaagctctgccatttcctagttatgtgaccttgggcaagttatttaaccactctgtgcatctattccctcatcatcaaaatgggcataatattgttacttacctgatagaattgttgtgagaatcaaagatttagtaatatatgaaagctaagacctggcaaataataagtgattaaactatattattgtttgactgctggttaattcttaacagatgagtttagtctgttatcagttagtgtggtatttctataatttataattgtcttgatatatcaggtccaattttaaaaatgtatttgttaaataacgtaatcagaactaatgtttggagaaaaataaaaaaaaataacatcctgactcaattattttgtaatttttatgtatctgcctctggttttattttctgtttatactaagaacatagtcttcatgacatctaaactgtttttcttttgtcacttgtggtggtagaggacatagggttttttactacaactttgaaatgtctttttcaacccaatgtgccccttcaaaagggatctcatgaagcagtgaggggagggagggacacctgactagccagtcagtaaccagattagcaaaa

SEQ ID NO: 57402 - DNA, 2204 bp, Homo sapiens
gaatctgggtttttccgttcatctgtattaccacttccttacttcagtcttatatctgtagtaatctttctaaaatgtaaatctaacaatgctatgctcttgctttaaattctgcactggttttctattgaaggacagaatctgaactccaaggcatgtcatgcaagtcatgcaaggcctctcacaatttgttctgtctggattcttcagcttcattatctgtggctttctgccttgcatttgatgctcactcactagcttagctttgctttttattgttctgttatttcttctgcttggaagaataactccttctcatcctttgaaattctcagaccagtgttggtccttaataaaactaggtacacatttttaaagaatataaattatggagcgaatgttgtggtatagagtattgtagtgttgggagatttgaaaatccttcatgagccctaaagtgctgtaaagagaaagcaaattagtatttttattaacgtgtgcaagaaaagctcctttaggagcagcatcttctctagattttcttttccaaatgacattcaacagtagagcaatatgatttatttttctctgattaatattgcgagacttgatgtgtgtgtgggtgtatacgcatgtgcacattaagtgcatgcttactttatgtctggccaattattcagcataaataattatgattagattattgtgtttatggttatgattgagaaatgctgttattatcccaagtattccttagaactctatgaaacaagtgaacaaattaacttgtggcttttggttaaatttcttaaaaaaaaaaaaaacacgaaaaaactcccagcgtgttctcccaaaataaaagagagtgattcacttttccttagcagctgtgagtttagaagatgttgagttatattcctgaattctgctcaaaggggattgggagttcaggcagaaggaatctcccattttatgtgccctgatttggaaatatcttacatttttaaaccatgaatcttagactatatattcttttttttttttttttttttggagacggagtctcactctgtcacctaggctggagtgcagtggtgtgatcttggctcgctgcaacctacgccccccaggttcaagtgattctcctgcctcagcctccagagtagctgggactacgggtacatgccaccacgccaggctaatttttgtatttttagtagagacgaggcttcgctatgttggctaggctggtcttgaactcatgacctcaggtggtctgcccacctcagcctcccaaagtgttgggattacaggcgtgagccagtgcccagctgttaggctatatattcttaaaagagattatcctgtatttgttacctagcattgttacataagtgctatatgtataatcaagatatttgttaaagaagataacccaaattttagtattttcctctagtaacattatttgaaaaattatcataaaatgcttaagtattgaaagccccagttctatgggttgttactatcaaacatttcaatttttttttcttatactcttgtgtaagagaggaactattatataatatcataaaataatggttaggagttatactctggagccatattgattatgctacttctgctacttactatgaccttaactaacgatactacttaacctctgtctccttgggtttcttgcactataaagtgggaacaataacagtacttagtgtgaagtaaataatttatgtaaagctcttagaacaatggcaatagtaaacgctacatatagtgttagctgtacctataggcactataatatctatatgtattctaatgtacctagtacctatactacctcttctgtagtacctgtagtatagtatatagtactgagtgtttagaatgcattaaatgtatttatagatgttgattattccacgagtatttattgtttcagtttattagctttcaacatagttggctgtcactgaatgttccatattttattcagccttttaatgactttttctttttttattgcttaatagaattgcttaatttttcctattatttaataactaagacaatatatttcgatagctatgtttaatagtgttattttgttattgaaatcatggtgattttattcttggttcattcattattttcattaattccttcagcttaaagaatta

SEQ ID NO: 57403 - DNA, 1074 bp, Homo sapiens
gaagaggggaaatttgaaatagttatggtgactagtgaattgagaaacatagtaggtttttttggcagcattgagagaatttttaaaaagttaatatcatttaatattatcttaagtaaatcacatgtgaaggaaaacagcaagaaagtggactctacttagcagaagaggtcacttaacttttaagtggtccttaaacttttaagtattggcattaatttgccaagaccttgtgctaccctgatgttaaagtagggatgctgtttgcagtgccacaaatatagctgctgtatatccttatcgtagtatatgatttcacctaacttttagtgttatttatatgttagttaggcctcgtttgtttctaactgatactcttttttttttttttttttttctatctaggcaggcagaagtcctgaaggctgacatgacaggtattggctggcttatttctttttcacaacatattttatatattaaattaatggaaggatatcctctttcttatattatgcacagcactaaatcccatcttagttgccaaaagggatgatcatttactatctgctttaaatatttattgtttatgtagtttgaattcttgcttaaataactgttgggaattgcatgtaatactaatatatggtatactgaattgaatgttacctaatttagtttatataatcacttaatttttatgaaactttttattaatgatttaagacatacagaaaaaataacataccccatataaaccaaaatatcttacagtgttaggctaatatctttctgggaaatttttttttctattaataattaaccaaactttagtaggtaaaccttcagaaaaaatatttatagaaaaattctattggaagtccttgaaattgagtgagctaccttgctgcctttcttttctcccatatctttgttacttttttttttttttttttttgagatggagtctcactctgtcacctaggctagaatgcagtggcgtgatctcggctcactgtaacctccgcctccctggttcaagcgattctcctgcctcagcctcctgagtaggtg

SEQ ID NO: 57404 - DNA, 6033 bp, Homo sapiens
agcagagatcaaacccctgcactccagcctgggcgacagaaaaagactccgtctcaaaaaaaaaaaaaaaaaaaaagagtaaatgatttaaatacgaaattaggaaatatgttgtaatcaccgtatactggtcagtatgccctccgtaacagcatatgccatcctaaaatgtaataagaaggataggtactagtgaatcttattctaatttctcaataatttagttctgcagtgaaattcacaaaaaaaaaaaaaaaaagaattaaacagcatacctgccaagatttgcaaagaggaaaaggactattaaaatatctttttgtcagctctagagtcacttaggctaatgtcctaagagttcatggataatctcgtgtcatcttgttcaaggaaaagtgtgttggggggtgaatagcttgtatatttactcagtaaaaggtactactcagttctttccattattaacagatttgtcatcatctatattgtgtatatcagtgtctgctctgagttactgtattatgctcttgaattggcattgaaaacataatctattgtgtgatgaaaacagaacatggagcaatatcaggctatctgtaccatttaccttttcttagacattgaacaaccttagtaaatagtcttagggtttgacctttataggggacctttggctgcccagaaactttaactaagataatgtctgctcatttgaatgatggtcttgatagatgagaattagtaatcttttacacttctttttcttgccataagtgaattaaagcagggttgactaaatctattagttagtgattaacaatttaactagggatgaggagctgatagtaaactctattcttaactagcctgtaaactcttaggagcattaactcaaatccaggagattctctttgcaaaataggattgtggtggctatagatgctaatagcaaacctaaagaagagtgatgattattccattgtgtagtagcaaaacgaagtagcccagctagttatgggaaatatataattgaaaagcccattattaagttcacctactgagggagtttactgtcagttattgcaatcataatcccagtgattgcaaaggttaatgtgccttgcatgactctggcagacagcatggccccaattttgtattatgtgtagtcatagcctgactttctgattacattctacacccagtctctcatctgacctctttagcaatttaatcctagtcttctaagtctttgtttacattaaatgactaatgtggattgctcacaaaagtatcttaggaaacagtctaccgctcattaaaataatactgtcatggcttattcggtcaatatattgagagaggagtaactgcagaataccaaagcaactgctagataatcagctgatgtgagaattctgtaaggacatttgtgggagtccttacagagactcccttacagagacaaaaaagaaagaaaaagttgctttggaaaaagagatacagtatgagagtaaacagaccaacttgacagtctgttatttcaaatgggttggcttactgtaaggcatatagtttcctgttatatgaaaaggcagaaatacaaacaaaaagcaaagggcaaaccattcttttttttttttttttttagcccttttcatttcatgatattatttcaaaactaaaaacagaagcattgtaaaccagacttagtcattagtcaaaagttgaaagtcatttgaaatatagtagtataaaacttctgcagcattctatggaatatatttagagcaggttttgccttggggatagagcaggaaggagtcactggtgtggtataatggttttaactgctggggtttatctatctaccgttatgtttttgtttttgttactcagattctaagctgggtccagctgaagtctggacatccaggcaggctctgcaggacctgtaccagaaaatgctagttaccgatttggaatacgctttagacaagaaagtagaacaggatctgtaagtattacctatcatttgagaagtccctgtaagatcaagaatttcaccgagactttaaaacagtttggttcgttatttatttttcaacctgttgcagaataaactttttcaatggaaagtaattctagtatttgtgatatttggccattggtattatttcaaatacagtctttggaggaggtaagaagagaaatgtttagagttgaattctattaaggtcattacggcagctcttttagggcctgtcaaaaaaaacaaatatatctatttcaaatactaagagtgtttggattgtctgtggtcagtcttataattaagccgcgatttaaaaaaaaaatacaagaataggctttagaaaaatctttctttgttaaacgtgattctataatttccctgtcaggaaaatgtatttgcattgtaaggaaagttccttcttttaattaaataagttggtagtatttcctcccctacccccaataaaatgaaaaattttgtgtatttagacttttccgcttcttctttctataaggggcaaaatggcagataaccagattcccaagtgagtaattgtcttttgtggaaggctttgccttacaaattggaacagggacattagcctgatagaaatttaaaaatcaattaagagtactttgtctactaatgtccgttaccctaagttttggtgaagattagttttttctatcatttacatctgccttagatactttatatttttaggaagtcgagtaatacagctaaattacgaccatcaaaatccttatcctgtgatgttagagtcaaggataagatgtcatcagaaatgctgagggaagtgattgtcctcctaagtcattaaaaagcctagtgctctagagcctcagaagctgatgttgatatagaattaggtacttccatgctttccaggtaagttgtaaacctcttatctgtgtttgcttcctttaatcaggccagtaatatcttccctttgttctagttttttattccccactgtggtttccaggtgagagagtgactgtattcatcataactggacttaaactgattccatatataactagattaaagaaaagcattttataacaggattttggtatgccatatttcagcattatattgtttcttattgtaaatagccaaatttgaaatgtggcttatgtttcaatcacaagagaaataaacaaaactattaaatagcagtgaaactgaatgctctgggaaataacttttggggaagtaagagatatggcttactatttacaaaatccctgcccccatatacatgtcacttgttagggtatagtccatcacatttggcactatatgtagaaatttgttaataccttatttttactttgatcttgccaccattgttctgaatttctaccgggattcctaaataaactctagtagttctaaaagattaatagctgaagccacaatctgattattcgaacatttggtaagtgtttactaaggtcagttggattctactgcatgtctagtcttgttcaaagggaagcataaagttatttaaataaatgaataactttaatgcaggtttactgtctcgtgtggtataattataacagacagttctttcttgttctcagggggaccagtgtctgcccagtgagtcactgctataccaaatagaattacattttgttttcagctggaatcacgcctttaagaatcagatcacaacactgcaaggccaggcaaagaatcgagcaaatccgaatcggagtgaagttcaggcaaacctttctctgttcctagaggcagctagtggcttctatactcaggtgagttctgcattgtataccagttttcttactattagtggtaaatattctgctctttgtacacgtcttaatgcatgtaaacaattcttgtaaccactatgtgggccatccagggattgatcacctataatcttttcttttttggcgacagagtctgactttgtcaccccaggctggagtgtagtggtgccgtcatggcttcctgcagcctcagcctccctgactgaagtgatcctctcacctcagccttccccagtagctgggactaaggtgcatgccaacacgcctgactaatttttgtattttttgtagagatggagtctcgctatgttgcccatgctagtcttgaattcctgggctcaagtgatccgcccacctcagcctaccaaagtgctgggattgcatacctgagccactgtgcccagcctataatctcaatgcaaatgtccataagacctttaaaaaaaaaaacgctgtgcttttaaaagggttgatgtttagcttaaaggttggaagtttaactgtatgaatataaaagggataattgagcacaaagccttagtgaaacagtggaagtagtcagttacaagtggtattagaggaaatgtgaatttatggatatagctatagtcattaaaataatagctatgttgcgccagataagaaatagtcaaaatttgtaatatcaagtgagttttcatagtattatttatacaatggaatttatctggattttgagatgttattaaactaagaagtagagtagcttttcctctgtttgaataataagctattattcattgtccccagagattttctttttccttagtcacgtcctgatagaacttctaaatcaggcaaggtaagagaataaataaatcttatttttgaccatgggattttctttaagcagaatctgttagaaaattaccatgtcatccatttgtaatagcatttgtaattaacaaaatttttgtatataaattagtatcttataatgaatgttaagacagggttttgagaatcttgcactgaaagaaatctttggccagttcttactatatagtactgcctgactattgctgcctatattttggcttcattctgattttatcatttctttgaatgaagagaaaagaatctctgctgggtgcagtggctcaggcctgtaatcacaacactttgggaagccaaggtgggaggatcacttgagcccaggaattcaagcaggttgtggtgctacctgcctgtaatcccagctactctggaggctgaggcaggaggatcacttgagcccaggagtttgaggctgcagtgaaccgtgattgtgccactgtactccagccagagcaacagagcaagacctgtctcaaaaaaaagaatccctgtgttggaacaattcagataactgtcatttctgagattatttatgttttacttagactaaaacattcatcacagttcatttttgaaagaactcaagtatggttcttagtctcaaaatttattttaaaatttatgccaacttttagcagcaaccaaaaagttgatactttttggggaatgcttctcgagagagggattggtccttaaagcagatgttaaagattaattcattttacaagtagctgtcaaaaggctactatttgtaaggcacgatactagatgctgaggatatggaggtaaattagacagaatctttaccttcaaagaaatatctagactaaatgaaaagatggatacattagtaagtatatttgttttcttttctgattgtaaaaataatgcataccaatttcaagaaatttgtgaattatacaaagtcccaaaaagttcattaatcctcccattctggataaattgccactttaatatatactcttcttgtgtttctatacttttttgcatatttaagaccacactatatatccatttttgtatctgttttataaacataatgtaagcttttccttgttaacagtttagcatttttgtgtataaagcattttctctaatactgtattatttcctgaggaccagttgttcaaattgaaatcattagaaagtttaaagtgaaagtttaaatactgttgacaccattttgtcgttttcccaaaagttcatcatttataacatttttcactagtttcttctgttgtcctttcattttatttagagttgtttgaa

SEQ ID NO: 57405 - DNA, 1006 bp, Homo sapiens
acaattatcagtgtgagcagctagtcgagtggttgtaccatttactgagatgggaaacactagggggaaagtagctttttccctattaaagtagatgcctgtttgacatctaagtagagatttgaaataagcaattgaataaacaaggttggagcccagtggaaacatcataaaatcataaaaattttatgattatagtaaagaaccctgacttagtcagatggtaacagatttagcacaggaggagccaccattgcaatcaagaaaatgagagagagaaggtgccttggaagccaagagaaaaacatctgaataaggaagggagtcatcagccctgttgagtgctgctgagaattaaagtaagatttaaagtgaccaattaggtttgacaacatgaaagtcattggtgaacttaatgaataccatatttcttcatttctgaaactttttttttcatattttaacatatctgaaatagagataagtttataacagatgacaagtgaccatataacttgtggttttttctcaatattatataagatgatggttcatcttataatttatggtgtctttgtattgatgaaatgtaacttcagcagtgttggggatagaaacctgattagagtggattgagaagagactagtacttggttatccacagtaacattttctgtgaagatagttttttagttttttgttttttttttttaaagacaggcgctcactctatcattttggctgagtacggtgcttaatcatagctcactgaagcctcagactccttggctcaagtgatccttccccacctcagcctcccaaatacctaggactacaggctcataccagctacctttttttattttttgtagaatggagtctcactatgttacccaggctggtttagttttaacttcttagctaccattttgttaaccagttaaagcatggggcttaaagcagaaccaaattcctggtcaaagtaaagacataccattctgctgta

SEQ ID NO: 57406 - DNA, 1118 bp, Homo sapiens
agttatcctgtgaaagattaacgtataatatatatatatatatatatttttttttttggagacagtcttgctctctcacccaggctggagtgcagtggcgtgatctcggctcactgcaacctccgcctcctgggttcaagcgattcttgtgcctcagcctcccttgtagctgagactacaggtgctcaccaccactcccggctgattttttttttgtatttttagtagagacggggtttcatcatgttggccaggctggtctcaaactcctgagctcaagtgatccgcccgccttggcctcctaaagtgctgggattataggcgtgagcccctgtgccaggcccgaaagattaccatataattttcatgcagtttttgttcagatttcagcagtatgtggtactaggtacacatcttacagtttataaactttacttttagagcacttgtgacttactactaaattttgtttgtttttcttttagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattggtgagcctttgctgtgaaggaattgataatatgttcctccttttctttggaatagtcatagaaagaaactgttttcctttaagcggagcatacacacacaatttagattgtcataagaagaaactataaaatgtattctaaggaacttaaaatttctcaatatttttgggattggcagagcatcgtgaagaaagtaactttcatattaagatttaaattttattccaactttatgtaatttatataggcaaataataaacagcaaaaacataatcaaagcttaatttttcaaagtggtgccataatttctaaattaaatgtactcttctggaataaatgaggtttataaattactcctgaagcgaaattgccttctttctttcttaccaatggactaaaagttgatttttaattttgcttcctttttaaagtttaatttgtatttctattatttgcatttt

SEQ ID NO: 57407 - DNA, 2550 bp, Homo sapiens
gatacaggaaatacattaccatattgtgcttgtaagaaactgctttttgagaaatacaactacatattctcattttatgccagtattatttgaataaacgccagctgatttagaaggttagttgtagaaactgaaggagaaattttgtgggaaaattctagagaagagacaggatttcaggaaattttgaggaaagattaatgcttgatgtctttggaaaagggctaatcattctagacatatacaatgaaatagattgcaagaagactgacagtgtgatagaaagagttcatgtagaatggaattatattctctaatgataatgtaaaagacttccctcttagaatcgtagagcttactatggctatttcaggttctttatgtaaataaaaacaaaaatctcagagtagtctgggcagagacagctgtaagtttctgacatggtaggatctcctgtcactgctggtagaactgtaagtaaggattatctgttttccgccataatgctagtgataatgaatccctgctctctgcaaaaatttcccctgggcatagaggaagactggctatggctaaagtgtaggatgaaactaggaacttctgttagaaaagtatttttgcctgcaggtaatctaaaataattgcagatattaaagtagaagggtaattccattgagacaccaactgagagcatctgggtgattttttatagtgctggttaacagatcactgtgaacacagttattagaaggtaaatgaaatttgatgatcacgcatgtacttctctaagaggggaaaataccagttgataatttgtagaagtacctataatacatcctaatgttgttttagtatgccatttaccctgtgttccagaatatgtacttgctatgccttgtttataaaataagttttaatgtatcaagcctctgaaagagtaaattttatgacaaatctgggaagtcatgctttatgtactgggagttcaaaaaattattttttgagtctgttgctttctagtcatttgtcccaacttaatattttaatatgtatacatcttgtataaaacaatttctaaaggattaagttgtataaatttatggatgaacactcaaagacttttgtcaggtcatatttaaaaatatatagtttcctaggagaaaaaagtttgttgataaacaattcaaacaactctgtggtgtctagattaattcctttcaagacaaaaagtcagtttgggaaataattagacccagtcaaaatactgggattgagggcagaaccatttactcatctgtaattctattacacatggtggttctaaatgcagactaccagtttaatttcttgtgtcaaagatggttcctgttcttgataatatatgcagtacgtctgtcttcttttacagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttagtgagtattgaattacttaacatgtgccatcttttttgaaaaacatcatcttaggcatttcatcgatgtagcaaagcacagtgacataaaaaagcatagtgtatttcttacactgaatcaggagttcataataactttcaaccccaagttctatccttttatctgctgataccccctcatcaagttgtaactataacatttttaatatgggaaagaaagcgtctttttagaaagaagctgtaagatactcaagtgttaaacagaatatagtagaaggcacataatattttaatttgaactggcacagtttcatatttcttatgctttttgaatacatttttttttcaagtgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtagtaagtatttttagaatttcatgttaacttgtgtgctttgtttgtttgatatccataaatatgtaaaaactgccttctaaaatacaacatttgaacaatagaatactgtattttctgccgactctcgggaattgaactgaagacctctttgtacgcttttcatttgtttatttgaattcttcatgtgaggcttagtcttaaggatttgtgactccttgtacactcccttgttcccagttgctgtcctggggaaaaggcatttttcacatttcaaagtgaacttgaagtaaaaccagtttgtttcttatctattacagtattccttaattttttgtttgagttgaagggaagagatttttattccatttttttctgtacatgaactgtttgatgttgccttacagtaacactcaatttgaataatatttgtttatttgaagcataaagattgaaagttattttgattctcacca

SEQ ID NO: 57408 - DNA, 1053 bp, Homo sapiens
cacaacttagaaaatgccttttttaagccacatttaagaccctgtgggccaagcactgtggctcatgcctgtaatcccagcacttggggaggctgaggcaggcggatcacttgaggtcaggagtttgagaccagcctggccaacatggtgaaaccccatctcttttactaaaaatacaaaagatattagccaggcattgtggcatatgcctgtaatcccaccacttcgggaggctgagacaggaaaatcgcttgaacccaggaagcagaggttgcggtgagctgagatcgcgccattgtactccagcctgtctcaaaaaaaaaaaaagaaagaccttatggtctgtctgcttcataattgtcttttctctcatgtagttataagctctttccatgatatattgacattatcatgaatagagtttaggaacatagcacagcatactatatacatctccttttaatgttagcattggttttagtaatacggattttcagacattgcttccttgcataaaatttttatttcttaactcaggctatacagtttttctactcttgtgtactctagaactcaaatttatgtttaattcaatatattatatcagtaatgttacaaaagaagaactgcatgttttaccatttgcttatagagtttttatatttatgggtaggaattgttattttcattgtgttttgttttttcttattgttgttcttgtacagtgatccttttggcccattctgtgtgttcccatttcttctcatggcaaaagatgttgaaccagaaggaacagctttattggcaaacattttttccctccatttttttctgtcatttactctttccacttcctcctatcagatttaccaaaatctttagaattatgcccttgtaggtgtttgattctgtgttaaattatgttagtactcattttaaagactagcatgggatatcactttaaaactgaagatttttccttgtgtgtctaatacactaaagttataatgttcatttatatcttttaagtaatggaaaaacaatgactgtttc

SEQ ID NO: 57409 - DNA, 1046 bp, Homo sapiens
aacagggaatgtgatttgtgtggtataaccataccctgtcacagattaaagaactaacagcggcttccacaactcataatgtatgtgaaagctctataaaaacatagtatgttatttctttgctcagaattttctcagcctatttcagttttccatgtttaaaactgacaaattattttcaccatttgttgaattaggagcatgggaaatgatctacagtggtagtaggtctctgtcatggaaatttgtcccttttgttgtatctttatcattatctagtgtatctttgaaagtacatttttaaaaattatacagcctttgaaatgctgaaataagggaaaaatacataaagtccaggacctatagataccattttcatggcttattagtgttctggtttctcttacataaaaataaagtctgaactctttctttaatttacagcatttggccctggttgatttctcttctgaatagtttccatccccatgaagaggacctctcaagtattagtggtaagggctaccctaaccttgtgttgttgatgtggttctccatcattaatggtggcttaatgccagagaaaaagaggtttttggtgatgaatgattgattttaaattcagtatctcagaagtgactgtgaactctacataagtgggtgggtggaagtagataatgttctcccagttcttctggcagcttattctcatttagcatcattcaaataggagttcagagagtgtaataccttcagattctttcattccttcctcctcattcttactattttaaaaaaagcaattaacatgaacattgctctgtcaaagtaatacttactcatcgtagaaaatttggtacaaagaaaaagaacacaaatctcccatacagagataccttttactagtcacgatagtatatcttcttcgggcctttttcttacgtgtgtacacacacacaggaaatgattcatatcaaataaagttttgtgcctgattttgaaatttagtattatattgttagcattttcttttgtcattaagcatt

SEQ ID NO: 57410 - DNA, 1060 bp, Homo sapiens
tagtgcccaagattctgcatttcttacaagctctcagatgatgtcaatgttattcaatactttcagtaaaaagagacaggtaatctaaacattgggcttactggatccaagactatgaatttttaagactgctgattttttaaaaagccattctcctcagcattgagtattaggtgagtgttaggggaatgtctgtgtcccaaagataacatgcagagttttgacaggtgagttattttcatcaggatcatgataaagaagagcagagaacaataagcattataatttctttctgtatgttaatttttaaaaaaatttagtgaacagtattccaccaaacaacattttaattaaaatgtttgcaaattttgattttgaccctttagcgacaccacttccagaggagtttgaattacaaggatttttggcattgagaccttctttcaggtaggtgatagctgaagtacctttatcattgccagtgattgcagtattaaaattagcagagaattgggcttggatgtagaggaacctttgatctgtcccagctgtgtgttatttttgtaacgtcaactaatactgaaagttgttgtgaattggatttgtgtatgtcacgccttcaattcctgtgtaataaaaattaaaatgtaacctttccatctgtgcccttgatcccatcccttctcacctccctaagaaccttgctccatctgttatcctctctgcattgtatttccagtgtcttgtctttctttcctttcttttttaaacaactaattatctttagcctagtaacatttaagtgtgccccattcttttaaaaaggtaaaatgaatttacatccctctattttcctacgttgccttatcttttcatcatcaaacttcttaaaaagagtagtatgcactttgggaggcggaggcaggtgaatcatgaggtcaggagatcgagaccatcctggctaacccggtgaaaccccgtctctactaaaaatacaaaaaaaaaaattagccgggcatggtggcgggtgcctatagtcccagctacccaggaagctgag

SEQ ID NO: 57411 - DNA, 3093 bp, Homo sapiens
aggttggtttacccttctgatatcaatgagttattctatatgctttacgatatttatacatttttctgatttagaatggtccaccacaaagtggatagattaatattatttattaaaataggcacctcagagactcttagcattgccatggtcatttcaagcaaattacttggcatgcaagataaatgtttataaaactttattcttaaaatgataaaagaatctttcctaataaaaagttgtggtttatttgagctccctgactagaaagtgaaatgtgagtaaaaatattacattaatgtaatgaatttgtatattttcttttctgctttgtttcatagtttgtaaaaatctctggtagtataaattctaataaatgcagttgattacatcaagtagctaacctatgtgggaagtaatctgaagccattacagttaatcaggtgaacttggttgcctggaaaatatctttagcaatttaatattctcataacttgcttgtgtcaattttaggaacttggatttttccaaaggtcaccagggtattacaggggacaaagaaggccagcaacgacgaatacgacagcaacgcttgatctctataggcaaatggattgctgataatcagccaaggtaagtctggaacttctggtctacccctttttaaccacctttttagataaacacatgcgcgcacacgcgcgcgcacacacacacatctcatatgttacgtattttaggctttggtataaatattgtcaatcatgaactcttaaatcgacatgttggtagcacaacatctaattataaccctagtgagtaagtatactctttatttagaatctctgttctccctattgtgtattacagaggtctttcttgtttatcgtgagtttctgctctaatttataaatatctctgtaaatctaactgaactgtactttcacagtcatggtaatttgtattggcctgggcatggtagtcagtttcaggcaggacagaccaagatcgtgctagtagccagttaagtacaaagcagatgtggtcgttagtgtagggaaaagaacgcaggttttgtaattccattggtttgagttccgtttcgagttccgcagcttctcaagtgggtgtccttgggatctccccagtagattataacctttccaaagtcactaactacttcctcatttttgtattcaggtttctgtcatacagtaggtagttaaatgcttccatgtttgaatgaacttaccacctccaagcttcaattttcacatctatagaataggaattatatatagctaccttataggacatatcaagggccctagaccagtgtcttgcacttgaagcatgctcagaaaatgtaaattctagcaaacgttgaaagagccagagggataggttgtgacgatgttaagtgtgataatgagaacctcagtttctacataactactttttgtgttacctgaatccacattgttatatcctgctgttttcatggttattagtgctaggaatatattgacttggatccacacacaattcagttgttattttttaagttaatgttttttatatatggatttatttttgcttttttaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaagctgtatttgaactataaagcaggtagaggaaggctcacacaaaaggcaagatttttcattttgttctaaagccatgagaattggccgtcctggaagtttaaatgcattatttaattgcatagtaaggttatataaagagctgtgatagatggttactttttcaattcttgggaattgtgagtgaaaaaaaaatctcagcctgatttgacactttcgtcagtcttcaccaatttaagcagtttgaaaggattagttgcagagttgtcagtttcacacaggattatattttatttagaagatataactaccatttgtcaatgctatagtggagatttggggtcttctgtagatccagtagaaccaagagtatattaaggcttatgcagtttttttttttagattcactataatatatatatatgtgtgtgtgtgtgtgtgtgtgtgtgtgtgtgtgtgtgtgtgtattttttttcttggaaaaatatgagacttttttattgacaattatacttgtcccggctattggtattaatatcactttaatcttatcctggatcctgggaatttataaaggaagaacccaggtttcttgctgggaaaagataagcactgctcagttatttgtgactttctttttattaatatattttcccaaatagaaaagatggtttcatgtaaacagaaaagggcctttattctgtgatggttttattaatactattaatgtttgaataaatacttaagcagccatgtgagttgttaacacattttagcaaatgtatgtgtttgcatgagaaactttacattgttgaaggctgcttacaaataaatagtacctttgaagtatttctctaatttttttgagaaagagaaataagaaaataatagttccattttaacattatagcaaggagagaaacagaaagacaaggtagaaattaagacataggggagagagagagatgctagggaaaggcaagaaaaaaaaaaatgaactagaaagccaaaggatccgagttttagagataatgagtccagcattttctgtttaccttt

SEQ ID NO: 57412 - DNA, 1063 bp, Homo sapiens
gatcatgggaaagcaaaataattagtaaaactaagatagtaaaattatcttttattggctattaaataatttgctttgattttccatttttaacttaggtgaatttaaatatcttcagcatgtactttttgatctaatgaggttttaaatactttcttaggagtagggtcttctttctagcacatttgagtttcaatttattatagatagttttgcttctattggttacaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccaggtaaatatgttttgtaatttcttctacttaatcttttctgtgcaagaatttctattcagtcactgagaaatgtgttttctgttggagtaatgttactaagccataaaaagttctattttccctaatacttataaaattatttttgaactgtttgtgtgtagtgtacatacaagtgcatgtttgttattatgaaggaaatcctatcactaaatacagaagctactcacagaacactgattacttcagtggatagaggaaaaatatcaagtctatttttagttcttcaaatcaagttaaagattgacaacatgactaatctcttttgtgatgtgttagaagactccctctacctacctgttaaaaaaaaaatgactttttttgcaattttttgctgtttccttaaaactaaagctgtgttcttctgttttgaagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttac

SEQ ID NO: 57413 - DNA, 1591 bp, Homo sapiens
taaaggaaactgctgccttgcctagagttttgttggttggaaaacaccccaagttcattctgtgattctttagcattcattataagtaatattgcattttatcctcacctttatgacaggcgtctcttttttagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggtgtgtgttctttcctatcaccaggcaatttggagataggtctgaggttgactgtcttttgaatatctcaaatagatcttataaaaaggccactcttattcgttagtactatagaatgccactgagtattggtgtagctcttggtttcctcctcagagttgcacagtatgttttagtttggaagctgaagaattccgtaactgattttgaactctgatggtctggcaaagaaaccatgtacagaaatctctaaaacagcatgttagagaattctgagacaaagcactcctctcagttgggctgaatcatctaagtttaaaaataggtttactgatatttaaataaattgctctctgagaggaacaaggttagccagttatcttggacagtggaggtccctttctttgccctttttattcatgagaaacaggtgaatgttagtaactttttaaaagatctgtttctctgttagcacaagatatgctaatcattttgctccatagcattgttttactcactagccacattaaccttttgtgttctgctctgtcagtatttttgcttttctattgtcttgaactttctccattattgtccttgtgtcgctttgcctttgcatttcagagcgttttttctctttgcctaataccatctatctcactatccccttgactttagttgtcttcttccacctaattatgctactattcctttatgcttttgttatcccttattgcttctcactgtgatgctttctgtcactaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttgtatgtatttgacataattctgcttcttggtctaacccccagctgcttctctgagatactgtagtacacagattaggtgatttcttctcttcctggggctgtccttttcagaactgtaaaacatattttctaattgcctaaaccaaccttaagttggtagtaggatatag

SEQ ID NO: 57414 - DNA, 4283 bp, Homo sapiens
ttttagcaactgttttactatatactgcaaatagagctgcttaaaaagcatattaacaaagccatttgtcaaatggatttgaaaggctttttaaaagtcaccaatgttaatgttttaaaaattgtggggtggagagaaacagtgttggaacagttcagcattttgttttgagattaagtgcaactattgacaaggggattcctgaggtccatgcctcataaacactcagagtgctgtttaccagggtctctggtccctgccagaatataatctctgactaggtttgatctaaaaggaggattctatgcacctgtggcaactggcacttaggcggtgtcttggtgttaacagatttgaattcacatcttctgagcctcaaattgtactcagtgggcgaatacaggcatgcttttgctttggttccatagtatggtaagattaatattaagaaaatagaaggtataacttaattacctttttttctgggactgtgaagaaatccttattggagaagccctcagagctcatgtcacattcatcctctttcctgtccctcaccggattctctctcaatcaggtaggtgaacaatgaagaatcctgctgtgtgcttttagtgtagactgatcattgtctttctcatactgtttcagtatgtctgttttttctttattttccatgtattagtgtattccagatatttgattttatcccccttgtctctgattggggcatactagtgacttgtacatcatgaattaaaaccctttaacttctcattaatattgaaacccttagggctctctttttgagccaaataaattattcacattttcaacctggatagtttacacagagcaaatttaagggtgagagaaagcaaagaggaaaattaatttgactggaaaattgaaacaaaaagaaataaaagccttcaaaatttctcttcctaagaaaagcttaaggtgtaccaagcatccatgaacaagacattggattttctcaaatctctttccttggggtgagtttataacttcactgtcatgtctttcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcaggtattaactactctttaaattatagaccttacatttcctgtacactcagattgattaagggatagtgagattctgtaattacaaatatatcatttgttgggttatttttattttttgtttgtttgtttttgtaacttctgaaaggaaatagaaaaaaaaaaagaagaagccggtttatgtaataaatgctactgacaaaactttttacatcctcagtagccagcagagatgtaagggagaaaatagaggttctatcttatggttctcagctgctttttagttttatttgtaggtgttcattctttgcagaaaaattgcacttttttttttgagacagtgtcttgtggtgttgcccactctagactcaaactcctgggctcaagcagtccttccatctcagcctcccaagtagctgggactacaggtgcacaccactgtgcccagctctgcactttttaaaattgagatttttaacttagagtctgacttaatagtaattcttaaggttagcaaattctttctgatacataagaccaataaacatgtatctgaaatagccgtgtgagaatagggcattcattcagttgacaaaaattgcctactattttattttgcttttttaaggcgaagaatatgccttagatatgtgtggcagggcaaattagtgcatctagcagatctctttggagcctttagtttccctttccttcaaagccctgtggttattgttagtagaattttagtgatcagatctacaggaacctgtagttctttgtatgtttgtgaaacaatgatttactatatcctgtgttgctattatttaatagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccaggtgagatctacatttcattgccaggcaaaattgaaagaatttactctatccttccctggggtctggcaattggcagtgatagaacatcttcttgaatttttcttatctcttttcatcccttagccatgggtgggtttggcattgattatctctcagcaacgtcatcctctgagagcagttggcatcaggccagcactccgagtggcacctggacaggccatggcccttccatggaggattcctctgctgtcctcatggaaagcctaaaggtgagtagatttcaggaacaagaaccacaagattattacagcaaaggtgtctctgctttcattcacataaatagctagacttctcaggccctcggagttgactgatacatagcacatatataacaaagtcctagaaacatggtctgccttacaagattcttgagtgataatttttaatttctgaattcactagtggtaaagcagtatcttcaggaggacaaaaacaaaggttttagtttcattctaaggttaagaaaattctgattcattttggaatgtttgatttaagccttttctgacaaaataagagtatctaattttagaaatgttttatttgcctgaaaactttatagtaaatgccctgtgtggtaccacatacagctgagtttcagtaaaaagacttgacataaaatgtgatttcacttcttctggtttaaaatagtcttaatggaaactaactagctttaagagtcttataatgactttttctaatagctggatttttatggggagtggggttgggttttggggccatatatatgcctttatatttggctgggattgaaaaatccctttcagacaacttggcatttgacctctgctgacaagatctggactgtttttcagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtc

SEQ ID NO: 57415 - DNA, 1284 bp, Homo sapiens
tgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccagatctgtgtatcgattctttcttttctatcctaaaagatataaaagaagtattgaagaaaatccaacttaaaaggcaagaatttcaactactcacaggtcatccagggaaaggcataaatggtcagaacttgaatatttttcagggttaattttgcttttagtagcattccaaaccaatgaattacggaaattataattaattgtaatggaaaggcatgagtagtaagaaatcgattatcaaaattcttttatttaataaaagaatgccttatgttaaggaattaagagcccatcatttttatttttattcctattgtagctgttactgaggcagttcagagagtttatccttttggcctgtaaaaattcactgaatctgattagcagcaacattaattaattcttcttcttagctttggggtttcttttctttgagttgtgtccaaagtttccagtgattggtagcttgctgggtcttccaactgt

SEQ ID NO: 57416 - DNA, 1037 bp, Homo sapiens
ctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaataaaatgtcagtgttgaataatttatttttctctgactttaacaattatgaatgtatggttaattaagaggaaaggttttctgcttctaccaccaagtactgtactcttaacaagaacagtttggtagggtttttataagactatatagatataagatgatagagaagagagtcatgaatgatgtcagagcactactgaagcctttggagtgattccatagccttctggatggcagctgaatacctatatgtagtatcactgcccaaagacctagactagaa

SEQ ID NO: 57417 - DNA, 1005 bp, Homo sapiens
ataatgctttcctgggggccatcctttgctgttacacccttaacttccatcacaggaaacatgacagctgccctacaggcagctctgaagaacccccctatcaacaccaagagtcaggcagtgaaggtgagtcgcagactacaacacagtgatctctgctgatatcttattcttagtaaaatcctctgcagttgcaaaaaaaaatcaatattttaactgtttgctatctttgacatagaagagtttataatgtagtttgataggtaaaaatttcacgtgaaaaaatagccctataatgtagttatgataatgctgcatggtaagatacagtaagttcaaacgatagtgaaatcatttgtgtgtgtttttagaggagaccactcaggctgaatttgagcaaaggtttgaaaaataagttaaacctttacaaaaataaacagattgtaattgctttttaaagattttttaaaaccatacaaatactaaatacttattatagaaagctcagacatatgagaaggttaaaaagatagtggtttgtggtcccagcacccagagataacagttactactttggggccttgctgtattgttacagagttcccttttgtttttttaagaatgaaattttataacgtgctttttcagctatatgcaatgtacatgagctttccttcgcaataagtttatagcatttttaacacttgtatatggataagctgcagtgtatacataactaatcttttgttatatatttagactgactttttttttcctattgtaaaccactgaaatcaatattttttggtaaatttttaattgttctctttgagtaaattgctagcagtgaattactggatcaaagaatgcacttttttttaaggcttttggtatgcagtattgccaaattgcccttcagaacagttgtgcaacttacattctctgcagtcttttactaattcttaacctatttacgtatttatttaaaatgatgcccatagcatc

SEQ ID NO: 57418 - DNA, 1034 bp, Homo sapiens
caatctgagaccccctagactggaccgcagaaaagcgtttctatgggaacccccccaccgagaatcacgtgacgcaatcggacgaccaatcgcttcttacctctgcccgcggtccagcttttggccctccctctcgcccccgcctccttcgcccagccccgccccttgcctgcggagagcccgcgcctgcgcgctgtgtcctgcgcgctccttccctcgcgcgcgctctccgtggaagagcaggggcagcgtgggaggcgccaagggagcgcgaacctgaggaggaagaaacggggctagcgcgcaggcccagaacggtccgagccgcggcagtcggcgacgcctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaatatccttgcattcaccgccctccccaccccagcccagcccagcccgcccttctcctgggacccgggagcctgcaggatccgcggggcaccggcgcggagctgccctctcaacctgcggcttaacctgtctctttgggatcgcccgctctgagagggcaagggggaagcccccgtttcctacccagtcggcaggagacgcgagggtcccactcttggaagcctgccctcccccgcgcgccttccacgcccccagattcctcaggttgcacccgagtgcctgcctgcctcgggaactggtcccgccggccgcgccctcgcggcgctggggaaggcggccccggctggtggggaaggctggtgccgagcgccttagtttttcttcctagaactctgatttcctggggtcacattagctccagaaatttctgattgtgg

SEQ ID NO: 57419 - DNA, 1080 bp, Homo sapiens
cactcagagttgtcatctctcaggccccaaattttagtcatccctgaacttctggtctttctctcacatctttcatccaatcctttggcaaatcctactgtacctatgtttcaaatacatccagaatctgaccaattcttgccacctttacttctaccaccctgacctaagccacatcattctctagagcttgaactattctagttgcctcctaattggcctccctgctttcattgttggacctctacagtctatttcaaacacagcagccaaattgatccagtcctttgctcaaaattctccagtagctcccaattacaatatgtatggtaaaagctggaaaccttacaatggcctacgtgatctgtagtgcctctttcctgactgctgcagtctttttgctgttcttacaatacattgagcaacttccacccagggcactttcccctgctcccgccccaaacccccatggcttactgctcatttctttcaagtctttgcttagatgataccttatcagtgaggcctttccctcccaaccttttaaaaattgtaacggccctaatcactcactatccccattccattgcttatttctccctattgtgtttattattttctaatattttacatggtttgcttatttatttttattgtcttccttttctactagtgtgcagtttcctcaagggcagagattttgtccatcttgtccactactatatgccaagtgtttggaacagtttgcacggaggaatggttcctgaatgaattgaatgcatggtgagcgtttaatttgaaatttgaaatgtgattaatggaattttaatcattttaaattctccttgtattgcacaaaatgcttcttaaatgcacgttgtaacatcatgagatagtcaatccagatacctcagtgcccactcctgctaaatatttactcaaaggttaaaaactgtcattggttttgtatgctgaggccaaatttgaatttttagttgcgtgctggtacttcatctgcagatgtaggtatcatgcatttcaaccctacattgctaggttaatctaattgagtatattgaa

SEQ ID NO: 57420 - DNA, 1036 bp, Homo sapiens
gggcgcctgtagtcccagctactggggaggctgaggcaggagaatggcgtgaacccgggaagcggagcttgcagtgagccgagattgtgccactgcagtccgcagtccggcctgggcgacagagcaagactccgtctcaaaaaaaaaaaaaaaaaaaaaaaaaaaaaaaaaatttcactctgatatctataatcccaatgcctttgtacattatattgttctctcacaacacctagctcttactcatccttcagactctggaaattttccctgatctctctgcagaccacattatgtgcccttatcatttttttccttcctccctcccttctttccttctttctctcctttattttttcctttctttctgcatttcctttatgtacacttatcacattatatggcagttatttgttttatattcttttctagtagactatgagcttctaacacaaggaactgcacctatcctgttcaatttataccactgcaatgttgagatgtttgttgaatgaatggattaattaatgaacaaataaaggaatggacatataaccatctttgcctgtttgtgtttcgccctgagatgagcatgtgagtgacaggatttctgggaattagtggtgttttctctgatgtaatagaagagcagacccaaggctcagaatggcacgttttattctgtgacttgtacttgccaacaataggaaccattataattttactggatttctgagaatcagcaacatatgtgtgtagtaaaaataatgacaacaaaagcaaatagcctgatgaaaagagtccttagcatgcaggagtcttcccactctgatttacccttgtggtcaggtcacgcttccaaactaactcattgttgcctcaaaacattcatcttaagtagtatggatacaatgcaagaacaaatctgaatttcttcaaagtaaaaatgttgatcaaggaataaaaaaatggcaaacaaagagacttgaaacattgtgatggaagaatcatactgtatcaaggtgggaggggaagt

SEQ ID NO: 57421 - DNA, 1090 bp, Homo sapiens
gagataaagataaaatttcttactgtgctacacgttgattagcttatacagtgcctgagccccactgcctcagccaggaatgagctgagttgcttgtgaggttgtgactttctgaatcttccatttcctcacctgtgaaatggcgttaatatctgtttttactctgcctatgatttttgtgaggatcagatgagttaatgtgtataaaagtattttttaatatgtaagtttttatacaaatataaggatattcttactgtcatttaacctagaggcctttttttctctctgctcactacctaaatgcttgataggcatgtggctctgtttattagtcttgcctttcttccttcattccagaggcaatcttttctactttgttttcttcccacttgctgccacttgctgattaactaatgagaggtgatgttcagctaggaggagtgcttcctctgctaccaccgttgtccccactgggattccaggtgcatcgagaatgcagacagcaaggcttctgtttgtagattggttgtgggaaaaaaaaaccccatactcacaggattcttaagacaaatgcagtggatattttgtgtttgaaaatgttctatttcttctttgattcttccttttctttctggtacttttaatttgttgtgagaagggtgataaagctaataatgcaccaaggaatggaaagtgcttccatctttgcagaggtcctggaaagttaacttttggtctgaagccaaatcccgatgtaggacttgaactcatgacctaatcccagaggcaagaatgttaccagctgaccaacactgaccctcataaaatgtagacatttaaaatactcctttgagtagtcctgttgctgctttctatgttttcttctctctttcagtcgtttccagcagtgttcctggcctccctgttaggagcacagttttaaagatctatttttctcactgtctttccatttgctgattatagctgcttccttcttgctttccatttctcttgtgtgagttcctttttttgttcctgttccttcctgtccttcttctgacttaaaaatagattccagggtctttgg

SEQ ID NO: 57422 - DNA, 1013 bp, Homo sapiens
aggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatactta

SEQ ID NO: 57423 - DNA, 1192 bp, Homo sapiens
tcagttacatttattattggtttatgtcacagtctgggaacatattaaccaactgcccagattgacacccacttacacctcacatgtaggttttacatatagggtttacaccatctaaaagtaggcagccgagagagctgcctactgactataactacgcaatgacattgagagcaaaggaagagtttgagatggtgaccccttgaattactaagagaatgctccctgaccacacgtttaaatagtgaagaagcataacagccgattggaacaaggaagccgggtttgcacctactgtctggctccttaaatcagagtagtgaggatggaggttgtctgggtttcctatgtagcagatggcagtaaacaaggaaaaggttttcagcagacagattggaaggtaactggaggttggaattactctggagtgagttggaaagaaaaaggaggttgtgcatagtaatctctctctggataatttatctttcccagttaagttgtcagacaactatgttggagaatggccctgaaatgaaagctttactggtcccaattccagctttcattaaatcggctcccaaagcaaaccacggggctggcacctgcgagctagcattcactttacagctgtgaacagtgtcttaacgtgcttgactctaggtagggaaatgtactaaggagaaagaggaaatgtggattttattctgacaaggctttgaattgtttcttgaaaaagctgaaatagcccttggatctccattagcctctttggtagattgctgccactggtaattatatgtcaagtaatggcctcctccccattcagagtccctcactgagccacagcatgatgccactgagaattaaaaacaggccttcctccccactggcctgttgtatttgcttcctctggctggagggcactattggcttcctactctatggctgtcatccatctcccaggagccgatgatcctttatttcagcagcccaaaatctggacaggagattccattgatgccgttgtgaaaggtggccagtacttttggagcaaaggctgactgagttcaaagaaaccttgaagttctttcccccagatgttgatcaaaagcagggtatttggtggccctcagtttggatctgtagttactctgtcatatttcctttctgtcctcacagtagccactgttct

SEQ ID NO: 57424 - DNA, 1052 bp, Homo sapiens
ctcacattggggatcaagtttccaacacatgaactttggaggacacattcaagccagaggagtcactaaaaagaaattaatactttcttcaggctccttagttaatttattgatggattgatctatttatttattcacgtaattagttttagtcattgtagtagaaattcaactgtcttatctgaaataattgggagaaggtgttcttcctttcaccttgtacagaatgattatgacttaaaaaatccagacagataactcttgtcttcagcaactttacaaatatatttgccttccttagtttttgagccctaagacgataagggttacacatggctacagcctgccccaagtttactctggctgccagaataatacagtatcctttccagacccctgaacaatcaactgttaacaagtgagatcatttttggtagaagaattgcatatgtcattgtctcaaaagagacatgggctgcaaatcctgtctggggacttgcttccaaatacttgttcaaactcctcccagctttgtctgcacttggcattaatcccactttgacattcaaagagcttgagtgctgcacattctcaactaaatagatagtaaaacaaaaccagtaacttgttattaaatacatagtgaagggggcagtagtcattttattattcttttcatttattctgtcactgtcttagtctgttttgtgctgctataatagaataccacagactgggtaataatttataatgaacagaattcactggctcatggttctggaggctgggagtccaaaattgaggggctggcatctggcgacggcctttttgctacatcattctatggtggtagggcaagaaagggtgagagagaacaagagaggccaaacttgtccttttataaggaactcgctctcatgataacaaaccccctcattcaataacaatagtagtccactcatgagggcagagctcaagtcccacttacctcttgaatgtcccacctcccaacgttaccacattggggatcaagtttccaacacatgaacttt

SEQ ID NO: 57425 - DNA, 1012 bp, Homo sapiens
atattaaataattttttcttctcaatttgacaattatattttaattttcagtatctagaaatgatggaattagatataggagatgccacccaagtttatgtagcgttcttggtttacctggacctcatggaaagtaagttgtttgtttatattgttttgttattgggactgtggtagagatttggggggttggattgggatatagcattcttaacataataagcaatcttttatgcatttgctgttaattttgcaatttatttatttacattgggaattactgagtaacagaagctactagaaaagcaaagacaggaggtagtgttacgagtgatatttgctcagctgagtattaggtagaagtttggagtttttattttttgtatttaataaacattattgtccattcaatgatgctctttcaggcaaaagctggcatgaagtaaactgtgtaggattaccagaactccagctcatctgccttgttggtactgagatagaaggggaggggttacagactgtggtgcctacccccatcactgcttccctcagccataacaggtgagcaggtgattttggtctaagttcctttcccgagtaaagcagtaggaaacattaaacatagtgatgtaatacttttaatgaaatttgggatacagggttcatagctttactcttggctatttgaggaataagttaaatatgagtgttgtattcggccattcttgcattgctataaagaaatacctgagactgagtaatttcttaaaaaaaaaagaagaggtttaagtggctcatagttctgaaggctttacagtaagcatggtgctggcatctactcggcttctagggaggcctcaggaagcttataatcatggaggaagttcgtgaagcaagagcaggcacatcatatggcaaaagcaggagtgagagagagtgttgagggggaggttccacacacttttaaatgaccagatctcacgagaactcattgtcctgaagacagcactca

SEQ ID NO: 57426 - DNA, 3659 bp, Homo sapiens
tcactttgttctttaacactttgttggatattctgactcttttgcctttccatatcaattttacaatcagcttgtcaatatctacaaaacaacgtgctgggattttgaatgggattgcacttgtagatcacattgagaagaattggtatccaggaacatggactatctctccatttgtttagatctcctatgatttctttcatcagagttttacagttttcctcacatagatcctataaatattttgttagatttatacctaaatatttatcttttatgatgctgatgtaaatggtgttttgtttttaatttcaaattccaattgtttattgctgatatataggaatacagtggacttttgtatattatccttgtatcctgtaaccttgctataatctcttagtttttattcttccattttctcatacccccaaattaatttatcagtaaaccctgtcaattccttaaaattacatccagaatctgtccatttcttaccacttacactacaactgttaccactctggcttaagctgctattatctcacctcctggacctactaagtggtcctcctttaaaacacttgatatattaatgctactcaacatatttcatatttggttttctttgattatctactgtctgttttcctccactagaaagtaagttccctgaaagtgagaacttggttttgtttattggtatatccctggggtctaacctggtacctggtacatggtgctaagtaagtatttgttgaaagattgggtaagctatcttaggctactgtgttcctgcagcagagacttcctaattaataccttaaagaacataagaatatactataagcaaccttttaagaatttccaaaaaattagaatgtctgcaaaatctgccaggcacagtggctcacgcctgtaatcccagcactttgggaggctgaggtgggcggatcacctgaggtcaggagtttgataccagcctggccaacatggcaaaaccccgtctctactaaaaatacaaaaaattagctggatgtggtggtgtgtgcctgtagtcccagctacttgggaggcctagtgaggcaagagaattgcttgaacccaggaggtggaggttgcagtgagccaaggtcacaccactgtgctccagtctgggtgacagagcgagactctctctctcaaaaaaaaaaaaaaaaaatatatatatatatatatatatatatatatgtacatatgtatgtatctgcaaaatccatccacttgcaggatttatcaccattttccacgctttgcattgtaacctgccaatgttatgaatagcctctttactttttagttgaattttttttcatttatattctctctgccctttcacccctctttttccctagtgccttgggaaaaggacttatattaattctggagtagagggttactagaactagttctttctttggaacatctctgaagatattcttagttatgagatttgatcctcaaatgctacatactttcttgaaggaccgtccattattatttccctgtaattgaaaaatatttccactttctgaaagcataatccttattacaaattcatttaatgaccactattttatttgagtcctaaagtctcataattgcaaaatgacttctgtcatttggcttctctgcatattaggatgtgtgtcctcaccttccctctgctagaaatctgctgctggtgaaacccccaattctggcagcttcttttaactgatacagcatttttttttctcttacccttaaacaaaagcttgcagttcattacagaatgacttcccactggggtggatagcttcattgttcagtaaacccccttggaattttagctgccttgattttttactaggaaggcattggcatgaatttcaaggaggtggtctgttatccctgaaacttttctttgggactgagcctgtggatgaataaggcttctttggtgcctctgacaccaacttaattttgcattatgtttcagagttgcattatggcatgtcattccattatatcataatgaggcaaatcaaggaattattcccttttactaataaggctatagcatatattatttggccacattgaagaggataggagatactttctatgggttgaaattaatactacttttaacccatgatacattctatttcaatagcatttgaagttaaaagtaatgcggtcttcaacttcttgtcctctgtgtaaatctccagagattacttagtatctgtttcagaatcattacagaaaaatcaatgctaagatttatggaaagcatttaaatagcttggactaaaggtattagccaaatagtgttaactgtgtatttgcttcaggcttgttttcaagttagctatatgaagctctggaatcactttttttcagtacacagagctcctctatgaacagttatgagaaataaaaacctgttgtgagcatcaaattttgttgctgttattaaatagctattattattgatacatatttttctttaggtgggatttttccctttagatataactgagtttaaaacttgaaactgttagtattaatacataggttatatttttcataggttgatttctatccaatatgaactataaagaattttatcgtttattgttgtagatttgtgtgatgaaacatacaatatttccagtatcttcacaatatttttccaaagaactgagctattaaaatttatacatataaggaaacattctgtcatttctaaagtgagatttcaaaccataagcttgttagaaattaagtgagattatagtattctggtgatacttaaatgttcttgggatctttacaatcatatgtggttttttaagaacttaagaatcttttgttactgctattattaatagattgggaaaatataatctgttgactaaaaggcaaaataaacatttttaagattttatgcagtatcctataatggaaacaaacaagaaaggtcttgttcttgtttgttgaggaaaagatgatggctttgctttaaacatacttgaaaaatcgactagaagagatcctgaacaagaaactgtaagacttctggaatgtaccttgagtaacagaggcagataaactattttattctgttactagtgagaagattcactggtaattcacaatcaccgccccctccaaccaaataccataaacaaggcctcagaaatgggaacttccatttcatttttgacagtgatttctctcaactctgaaaacaaaaccccttttacaactctgagttagttttcaaatgttagggtttcctgcatgggtatttggggtaagtatgaaaatgttttgctgcttaaatcaaagaactctggaaacagatataaattgagaatggaaaaagagtagtgaataagatggaaatttctattctaaatttcactatatgggctacaattcccatatagttttccttagtgaacaccaccccccaacacacacatacaaacacaccttctgatttaaataacattatatcttcagaaatggaaaatgtgttaaagttgtgttaacaggcttccttcttgtctgtgtcccattctcatcacagtctaccagttagggatgtttagagaaatttatcttgt

SEQ ID NO: 57427 - DNA, 1146 bp, Homo sapiens
attccttttcttggatggatctgtattttatttgagtgtcatggatactgcagcagtttcagttcattgttaaaccacatgttagaatatattttactttgcctggtgacttatggtttttcccacctgaactgggtgaggaaaggcgattgagaagttgattgttttcactgaagtgtgggaacctttttcatacccatcatcatagatacaagtgctaagggatgtactctcaacaaaccatgacatgcatgcatatcatagccattcctaaaagcttcttcctgaattccacagttgacaaggaggtctagtagagcccctgtattagcactatgtccttttacatgagacaattgaaaggccaggtgtaaagtaaggagatgctgcgggctgccaggctgtgatttgcaggaaacttctcaaagacacagatagtcagggtgacttcagtggttctatctcaaagttctgccaaaagcagtttttctaagataattttgttaacagttcttgcaattaataggttataaggaataagcaacatatatctcattatatgtttcaggtggataatattttgatgaaggaagtgagaatccaggaacatctcttgagttgcttagtagttgctgaaaattcagatattctggtttgtgccaggaatccatgacagtctagatgcgactcccaaaacaaattttatgcctcccttccatggcctccccaacacccacccctgcctcaccctgggatatccttcttcccctctactgtgtctcttgagatccaagatatttctcaaatctcacttcaaatcccacctcctccaaggagccctttttctgctataagagtggtttctcccttaccttccatgaactgctgtaatacttattttaggcttaatttattttattattagttttgatttttattatatatatttttgtccccagccaaatgtaaacccttctattgtgcccactgggccttaaaagtagattggtctaaataagtagttattgattgattgacagcttgtcattgatcctgaggctcacagtttctgtctatgaagaccttgctcccgtttgaagccttctttaatataatgaggaagtatagtctggaatgagaaaagat

SEQ ID NO: 57428 - DNA, 1080 bp, Homo sapiens
gaagctaatagccattagagggaaagataattaactcagtttgcaagaggttgagtttctggtgtgtatgctctcttagaaggagatatctaacacataactgaaattctggtctataattcagaagagagggttgggatagaattatgagtttgctgtcagctcagtcatcattttctcggaatcattcactacatttccatgatgaggtcaaatccctctattctaccctcttaccacaccacgtacctcctctccttgtctgtatgcactttccaatattgtaattgctcattcatttttgagtttatttgattaatgctaataacatccccccaccgcctgcaactgtagggttcatgaaggcaagactgtatttgtttttgatccttttgtatccaaagaacacctgccgcacactaggggcccagcacatatttgttgaatggatgaataaatcagtgattgaaagagtttttataaatgtgatagttgaagctgttgtggttcagcatcagtttgcacagggaaagtatgtagaagaaaactaaacagtgagttctagggaacccccgtgtttcagaggtgtgatagaaaaggatggtgaaggagactcaaaccaggcaagtgtggtgtctgtcaaagaaaagggaggatcaggcagtggcatgtggtcagaattgttgtatgaagaagtaaaacaaatctaaagacattttcataatgtctgttattaaatagatgtgggaacgtttatttgatgggaatatatcaacatgttttctcaccgttaaaaaactgtatggctggctaggcacagtggctcacgcctgtaatcccagcactttaggaggccaaggagggcaggtcacaaggtcaggagatcaagaccatcctggctaacacggtgaaaccccgtctctactaaaaacacaaaaaattagccaggtgtggtggcgggcgcctgtagtcccagctacttgggaggctgaggcaggagaatgtcgtgaacccaggaggcagagcttgcagtgagccaagatcgcgctactgcactccagcctgggtgacagagtgaga

SEQ ID NO: 57429 - DNA, 2045 bp, Homo sapiens
taatctgtaccttttctcagtggagtccttagtccattttgtgctgctataacagaacaactgagactgggtaatttataaagaacaaaaatttatttctcaaggttctggggtctgggaagtccaaggtcaaggtgctggcaggtttggtgtctcatgagggcccagtcttggcttccaagatggctccttgaatgctgcatcctccagaggggaggaacgggaaagcagaagagccgagagaaagtgagaaagagggctggagttgcccttcttttctggcaccaattctacccatgagagtagagccttaatggtgtaatcacctctttaaactcttgcctcttaatacagttaccatagcaattcaatttcaacataagttttagaaggaacaaacattcaaaccatagcaaggcccatcccagaaggtatttctgaagtccagagaaggaaatccttgaatagattgtggcagttcttcacaatagctaagtgaatgttaacatcaattttaagcttgcttttctttagtgccattaaacagtcactctctaccccctcgtgatgcgtcctttcatagatttgctggccctaaagaatttgattgactgggcagagagagacctgcttggatttctatttgtttgttttctgatctgaagccttccacagatttccatcctcaagattaccctggacattaaaacctttcttggctaagcctgtgcaaaacccttgcatcccatttctccttgcattaaaattttatgtgtctgtttctccagcctgtcaaaattttaaaacctttttcttaattcttcagagattaccttatgttatgcaaattgtgatatcagcaaatgaaacgttccctggtcttttatctgaatcattatttggcatgtttttattagacccagtgctaataattcttttttttttctttttgagtcagggtcttgctctgttgcccatgctggagtgcagtggcacgatcacagcttattgcagcctcaatctccctggctctatcaatcctcccactgtagcctcctgagtagcttggacttcaggagtgtgccaccatgcctggcaaatttttgtattttttggagagacagggtttcactatgttgcccaggctggtcttgaactcccagtcccaagccatctacctgcctcggcctccaaagtgctggggttacaggtgtgagccaccacacctggccctaaaaattcctattatgctttaaagttacatcatgtttatctttgcagttcccccattcttgctacccctactttccactgatattttcgcagagaatgcagctgatgaaggggacagggtgggagggagcattcaaatgagcatttggttgctagggaacctagtttactcagtaattgtgacttcccaaagttgtttagaaattacagcagagctgtttggaatctctgtctattcctctttagattggtgctcctctagctttggagatgactgaagttcctaaagttattcagtctctttccctgggagctgttagacttgctttttccagggactgaagtgacaaaaaatttattctaatcaaaatgaggtcagtgtaagagtgaagttggtgaatccctatcttatcttctgatctgtagggatatgtgtgcctctccaagccccagcaggagagtttttatagtgatactaaaaccctctttatatcttccttctattttcattatatttgagtgtctaccaagtttcctttcggttgaaatgtcaagaaaaatactttctcttagtattatctcaaatgagaattttatgatcctctgtgtgaagataaaatctcttacatgtgttttgatttttcacttttttggggataattacatctcaaattaaccaagttaaaaatgaactcaatagaataaaataaactcctgtgattagcaagggagtaaaatgagtatatctagaaatgaaatgcatgtaaaattcatcttggttttctactcctatgttaaattatataacaaca

SEQ ID NO: 57430 - DNA, 1437 bp, Homo sapiens
ttttttttttttttttgagacggagtctcactctgtcgcccaggctggagtgcagtggtgcaatctcggctcactgcaagctccgcctcccgggttcacgccattctcctgcctcagcctcccgagtagctgggactacaggcgcccgccatcacgcctggctattttttttgtatttttaatagagacagggtttcactgtgttagccaggatggtctggatctcctgacctcgtgatccgcccgccttggcctcccaaagtgctgggattgcaggcgtgagccaccgcgcccagccggttatgggtatttcttaagaagccatatataagagcttctatatgttctgtcataaacttgaatttgtcttcagtccaccaagtttgtctcagaggaatctggacccagatgtgagatacaaaacttatttgatgctctcctggtgctaatatggttggactacctaaaattatgcagagatgattgtatatttagacattatttgatatggctgtttattgcctaataaaatcttgaagagaaactgggatgaaaaggctttacaatctacctctgtctccctttattgcagaagtccggacagcttttcaatgtgatggattctgtggcaaggattacatcattggggggttttatatttctataattttagattagttattttagttcccttacccccatttttaaatattcctgtcagctaaaacaaggattttcttaggaaatgatgaagccaggtttaatttctacttagtgagaagactgcattaccaccccactgttaaggtgcaggtattgtcagtagggcaaggatgggttttcttttgtaaggaatgcatttgaagggatagattacagactcagggtaatgtgaacctgtttccatgcttgggaatgtcctcccaggtgatggacatcccttaggggaagcctcaggtaggataagcaaagcctaggttcttatttgcttgtttcttaaagaaacacaataataaagacaaaaatggtgtatggatcaaacagatgaaaccagaagagtgttaatatccagaaatgtattctctaaggctctgcctaattatattaaaagtaatttgcaaatctggccctgagttttctgtaaccatatgaaaacaagaaacactatcagtcacaagattctgttatagcctgggcaacatagtgagaccccatctctgcaaaaaagaaaaaaaatagttgggcatggtggcacacacctgtcatcctagctgttggggagactgaggccagaggtttgcttgagcccaggagttcaaggttgcagtgagctatgattgtgccaccacactccagcctgggccacagagcgagaccctgcctcaaaaacaaaaacaaaaaattcagttataagaaaagaaaaatatatatcattgc

SEQ ID NO: 57431 - DNA, 1005 bp, Homo sapiens
aaaaacagaaaaaaaaaacagagcttaaaggacataaaattttaaatgaatctaactgggagggtaacatttattcaaagctttgaaggtgcttgagttagccatgcagctatttgagggaggaaccttccaggccagggaacagccagtgcagagagagtcactgggcatcgaggccagtgtggctggagggatgagcaaaggggagaaaaagaggaggcaagggcacagcgccagattgtgtgaggccctggaggccactgagggctttggtttttactcagagggaaggtgaagggtttctaacagggaaatgacatattctgccttagtttttataggatcactggctgtgactcagagtaagcagatggagacgtagatggcagaggacaccattaattccttcatgagttaggatagaatgtggagtcagaggtcaaatcctgggtctgctgccataccactgtgagtgtcagacatccaaaatggaaggaagttttcagggaaatcttgaaatatctgattactctctaagagccaggatttaggttgtgcaagaagaaaaaaaaatgctggtctcatttttttttaactaacagtgtgtctttggggtatgaaaactgaggcatttttgtagcctaaaattacttttgtgggggggtgggctggtttttccacatggctgtgtgtttttagatggattattcacgtaagacatgggatttcattacgttggctctgacattttattagacttaaattttctagttctggttagctataaagttcactgtcaagaagttatgggaccaaaatacaaaatacttcagtggtgctaaaagttaggcctgtggtaataaatcattgttacctaaagaaagacatcattgctaaggtgtctaattttagattattaggaggaaaaaataaatagtttggtaggcttgccttactatgaggccttttcatttttaactcccagtctctctactttacctctgc

SEQ ID NO: 57432 - DNA, 1062 bp, Homo sapiens
gcagcattcttagcaccttgcataggtctggtcatttaatcataacaacatccctaatgaggtaggagctattattattctcattttacaggtggagaactgaggtgtagaaagggtaagtaactcgcttcaggacacacagctagaaagtagaagtacaaagagtagaacactggttctttgagttcagaaactatgctcttaaccactccactagaaccttgctaggcggcagtttatttgtaaagccttgtgaaaaaattttcagcacactattcagcatgcggtagataattggaagtcttttctattgttaatatttcctgtctcctcagtttgattgataggattttcttcccgtacatatctctctgagagcattgttgcactttgccataactgttgaattgtctatttcacatgttagacagaaagcttcttgaggtcactctacgtacagaacttgtcccccaatggcttggtaagtgttgatggactgaacgaataaaatgttttgtctggcacagattgacttgctgcagggaaagcagtcctgtggagtggttcatacgcaagacgttaaggcatgtactactaggttttaatccagcccctaccatccattggcattatgtcttgtgtaaactatttatcctcccttaagcctccacttccttgtttacttaatggggacaatgagttgttataaagagccaaggagacaatgtgtatcgggatttaacagaatgcctggtttatgataagcaataaacaattacttttattattgctgaataactgctgaaagtcaggtactctgctacttgttggaggtgcagaaataaagattccttcctcattcaggaacttcaccagtctcatagaagagaagaatggtcaccaagtaaattataatctatgcaataatgtacaaaacagataactttgtgaggatgaaaggtgaagagaagtcttcatgatggaggatatatccaagatgggttttgaaaaatgaataaaagtccttaaggcagagcaggaatgaagccttcaaatactggg

SEQ ID NO: 57433 - DNA, 1035 bp, Homo sapiens
atattttgatcttcctctttacaaaaaggggtggcagggcgaagacctggtttgtccagaaatcgggtatcagatctgcccccaaatcttgattcacagtcatgacacaattcaaatttattcactagtttgttagtccttgtattcttactcaacctaaaggaacatttttgcttttaaatccaattccaaaataggagggcagtaggaatgttgagtgattattataatgtgtgattattacgtgcagctaagcacatacatgacttcatttaagtctcgtaccacagtgccttgagataagttgtgtcatctccattttatagatgagtaggcagaactagtaatcctaaccactgtgtttacactgccagctagtactgtatagtaaatttacaattctaaattgattgaaaatttatttgtgtatttaaagctgttataaacctaagataatcttaaattttttaatctggtttagaagcatgtcagaaaatttgacaataattaaagaaatgtgtaggcccattttgcaagtgtttcctgttcagctggtattgatgttcgtagggcttgattgatattcactggtaaaattatgagcaatattagtgaatgtcacagcaaactcttggattccatttagttatgttgtagtcagtgaatggaacagactggtaataaagtgtatcatggattttcaagtcaaaagaaactcgattcaaatcctgacttttcctctatgcttggatgagcttgcaggccactcatcccttctaatatcagtatattcatctgtaaaatggaaataataatatctcatatggtaatggttaaattaaatgggacaatgtatgtaaattgcttagaccttgtacataatataataacatccaataaaattgtagttgttcataacaatcatcatgatcatagaatccaggttgggaaggatcagacagacttaaagatcaggcagacttagtgcaagttctgattctactagtaaaatggcctttgttaagtcactttgcc

SEQ ID NO: 57434 - DNA, 1001 bp, Homo sapiens
catgttaactttcctcccttctctctcagaaggagacttcatctcctctagcattcatcaagaacatatgccctgttgtgggctcctgaaaccctgaaaagaaaatttccttttaaacatagtacctgtaaaagttaaaataggtttgtctacttggtgttatttaaggggcactgggaaagttcttcattccaggttatttcctccagtcattacactgttggtgatttatttctctaggattcacatctatcctccctcaagcctgcagggacagtactgaacttccccctaaccacagggaagggaaggatagagctacagaaatgatagcaggccaagatcccattggtgtggagtccctgaaatggggtcatgaggcactggataccaagcatatcctgaagtgcactggattgcactgtttagagcctcctgtccctgctggggaggaggtaagaaggcccaatcccatgacagggggtatatgagggcagtgttttccatagcgaccagaagcagatcatggcctttgagaatgagctggtcattgaaaattatttcaattataagactcttgcctagggggaatacagcctcctaaaatgcctttcatttcaatttgtgtaacctgtgtctccatggaagattctgcctcccaatgaagacattctggaaagagatcccagggcctaattgtcagcctctgcaaaggaagattttaaatgttttcttcctttgcctcttatccccagctttgtacagtaactaccttggttcatggatcttctcacccagtgattctcaaaatgaactggtgatatggtttagctgtgtccccacccaaatctcattttgaattgtactcccataattcccatgtgttgtggaagggacccggtgggagataatttgaatcatggggtcagtttccaccgtactgttcttgtggtagtgaatacgtctcatgaggtctgatggttttatcaggggtttccact

SEQ ID NO: 57435 - DNA, 1046 bp, Homo sapiens
gcttggtgcttcagagtagagtatacagtcactttttatatttttctgtctctctcctcactgtctactatattttatttctattccttttcctattcttcagcctcaccttttttactggcttctttcccaagcggcaagtatgatttgtcagctctatcttttaagaaatcctacttttgtgtcgtctgatcgagctcaacactccctataaattattcttgccaaaatattgaacctgaatttgatcaaatcactatatccaagtgccaatctgcaggatatagaagaattaaatgaacatgttaaatgatacttcaatgatacaatcagcaaagttccaaaacaaacagaactttacaggacaaataaccaaggggaaaagaaagacagacagacgtgtaatggatacctatagatcagaagagactaaagacacttgtcagccagtttcagtgtatggagcttacttgggtcctgagtgaaaaaaaaaacaaaacaatatgaaaaaatatgaggccactgggggaagttgaacactaatcagatatttgatgattttaaggacttattgttaattttttaaggtgtgatagtggtagtatggttatgattttttcgtggttttttttttttttttttggagacaggtactgatatttcgggatgaaacgatgacttgataattgaagtttcatcgtgggtataagagactgcattatactgttttctctactttgagtatgttgaaattttccataagaaaatattaaaaagcaacaacaacaaattaattatctgttttgagactcagtcctgtctatctgtactgcccattacttcacaaacatttctagatagagtggcttctaatcactgtagaggctctaatttttctgggctgttcttacagtttcttcttctgtgtgctctgcttcttagctgtctccttcctcagtcctctcctagtcttgctttatactaggcattcttggcctgtgggttcagagatgagcttcgaaggatctgtcattcctctgaaatat

SEQ ID NO: 57436 - DNA, 1111 bp, Homo sapiens
ataaaattttagtttgaagtactgacgaatatacaatttagtgacacatttttgctagtgctgcctttctcaggaaacgaatgtttcattttcctaaaggaagctactcaatgtaaacattgatctgcgttttaatgttttgtctttttattagtttgctgaatatactgatgttaatatcctctcttctgttctgaagccttgactttgcttgatactgccacctattttagtttgtaatctctgaagatatctagaccaaaactttttttttattaggttatttgtttatagctgctgtgtttgacttgttcttcaagaaatagctgttagcttttatgtgtgaaacctcagaggtgaagggacagtgagggacagatatttcacagcctttgtctacttgagttagcatataagattgaatgaagctactgtccctactttgcccagaatgtgcttttgaattatagtttcaaaaacgaactctgaaagagaagagagattatatttactctttctttccagctgttggagagattgattgaaatttatttctaaaattgaaagcaagaaacaaagcattatatgggcagaaggttaatgggaattgtgtagggaccctgagtgctttgtgctgaagacatcactggcatcagatccatgaggaaaacactaacaaatacttagagtcaatggatttcttttgtttacttttggagaagcaactttgtatgtttaaaacttaatccttatccagttactgaaactgagaatcaaaggaaaggatagcaatatttcaagttttgctatattttatatttttcagtatgatatggttgagtagaataggaacttgttattttgtatggataatcgcttatcaaggtatatgtaaatagaatcagtaattataattaaagataccttgaaaccaaagaaaatgactgaggtgagtcttaatgaatttagaggtttattttgccaaagttgaggagatgcctgggctaaagggacataagccacagtaggacctgtggcctgtactttttccaaagaggattttgaggtcttcaatattgatatggtttggttctgtgtccccaccaaatct

SEQ ID NO: 57437 - DNA, 1093 bp, Homo sapiens
gttctcaaagcctgagtctcttaaaagtcagaaggagccttacaggtctgattctgccacaaatgtaaggtgacctgtgtttaaacttgtaaataaaacctatcagagcaacatttctgaaacttcagtgtgcatacaaataactagggatcacttgggatcttcttagaattgcagattctgtggtctgggctagggctgagattctgcattcctaaaaagatcctaggtgtatcccagtcctgttggtccctaggttacactttgagaaacaaagtcttagaaagtagctgagagacatccaatctcctcccatccccaaatcagggactctccttttctaattctcccttacaggtgttttttccctttggggacagcgtgaaaatactgccatcaatgattacctttctaggattgctaatattaagatatttcaaataacctttcagataaccactgaaaacttcattccttgttcccatcatagctccagcatctagaatggctcctggcactaccagggcctgaataaatatctgctgaatgggatcatgaatgggtgaatatataacattcagactttgggatattatgaatactattcatgtttggttttcactgttaaatttttgatagcaaccctagaaacacatcaagaaactgtataattctctatgtataggtgtagagtgttaaagcctttggaacgttaaattattttgagccctgagaggaatgtgtctatgtagcttgagtcatgtgagtatacagttgtaacttctggtttttcctgtaaatgagtaggaatgactgagtggtgccagaggtaagaccctctcagaacattactcctcctcacagaatgttaaagcagccttccttgggatgtagcaagctatattaatcaaatcactgcaatgtacatattggccttgtagggaaaatgttgccatcctcccaaaactgtttctgcctatataagtgaaaccttagcttctctattttgaaccactgaccccatccctttggagtctgtgttttctgtgtgcctgtcctcaagctttgtgcttgaatcaactctatgcttagt

SEQ ID NO: 57438 - DNA, 1050 bp, Homo sapiens
gtgcctcagtgacaagagaggaagtcaaaggtttctttacctattgcacttccccttggagttattttctcctgagtgacactacagattcagacattcaaaacaatggcttcttcctggactcctggctggtgtgactgaagggacctgccttgctatgagcacctctccaggcagcccctacctggcccctgggcctcattaggccctggctgtcctccgtagagactagtacagctcctgccttctgcacttggaactttacatgtgactggttattttgcccctgaaccgttacaacttggatttgtgctttacggtgtatgaggctttttcaaacgtaattattatcatgattatccctacttgatagaaggggaaactgaagttaaaaactaccccagttcacttaagaagtgggacggtggctacaatggcagatgctgactcgactaagggagattcctccttgggaataacacattgatattaagtccaaaccaacatttgctcagaagtctttgagaagtcattgttaactggccacttgaggtcagactcagtttttaaatgaggatgtctggagattctaatatggtcattagggctattttccgtggaactgaaatacaatgttatggtaagcacacagactgaaaatctggcagattgttttcagatcctggctcggctactcactaacatgtagtcttggcaaatttttgaggctctttttgcctgggttttcccatctgtgtagtgtggggaataaaactagtacttgcctgccttcatagggctgttgtgagactaaaatgtattaatatttgtaaatcttagcatagtacttggcacatgataagcactgagttagtatgctcatcatcatattagcagcctgcagttgcgcagacctctgacctatgcagtttgcatttctgaaaatggttgcttggtttcctctgattacgctggaggagaatgcgtcatcagtttatttgtagatgtataattctctaaacttaaaagatgatcaattgtccatgtaat

SEQ ID NO: 57439 - DNA, 1019 bp, Homo sapiens
tgaaaatacgttccgtatcactagaacagtggataccctcttaaccagctctgcaaatctctctctgaaagatactggctgcagccaaagcatgcttgcctggatggctggtaggctattcactagaacacctctatgcatttgctcccacagttaattgtgtgttttccaagagctggtttgctggttcccaaactggttcatactggttgaatgccattgtaattatgtaatttagttagataatatgtaagccaatgaaacacaagtatggaaagagctgtttcagtgaaaattaagccaaatgctttggaaagtcttgatgaaggcaaattactaaaagcttggtgttaaattctgtgctcagattatttcacaaggtctttacgttccctcttcacataagaaaccaaaacagagaatcttagatgagatgatgtgatcagtgcagaaggtgaatgtgcagccctagtcagtggttccttgcttaaaggagaagccttgttcctacatcaaaaaatgggagtgggctacgtgcggtggctcatgcctataattccagcactttaggaggccaaagtgggaggatcacttgaggccaggactttgaggccagcctgggcaacatagcgagactctgtctctacaaaaataaaagtaaaaatagaattagctgtgccttgtggtgcatgccaatagtcccagtgactcagcaggctgaggcaggaggatcgcttgagcccaggaattcaaggctgcagtgaggtctgatcatgccagtgctctctagcctgagtgacagagcaagaccctgtctctaaaaagaggaaatacacattcatataatttaaaagaaaatcatatatttaatgtatatatacctttaactcactagattgtttaattaccagtttggatggtgttgcctaataggacttttattgtaatcagagaaatgcagattatgacatgatcccatttttcacccattagattggcaaaatgttgaagtttgataa

SEQ ID NO: 57440 - DNA, 1073 bp, Homo sapiens
agtgctgcatcagtgatagctttgatgatgacaatgatgatgatgacagtgatgatgaaggcaatgatgatgatgatgatgacagctacatctttggaccaaataactttactctattttaataatataagtaattctgtgccttttgagttctttttatgctttcccttggtcatacttcattaatttctcccgagagtcttaaaagtctcttttttcttttttcttttttttttttttttttgagctggggttcacttctatttctcttttgtctattttgtttcaatattttcatcagctattagattcatcaagcccaacacttatgacttttttttccttatagctatttttattcagcaactatcctaccttgaatttatgatcttgcttacttatttccaagtggaaaactgacttcatgatcacccataccctactgaacgtcagtatcctccctttaagagattgccccttttcttctggtatttggggcaacagtcttgatatttgtagaaatggcattgtggtaatattgatgcaggcagaaacattttgggatacctacggccatttaaatattatgtaggttttaccctcttcccaagtccccagtccctatactcccactctcctgttttctcattagaattggtttttacagcgggaaaaactaaagctatacaaatttccacctgtttcaaagtgatctggttttagacttaaaaaagcttttttctttgcctaaaacagatagggcttcatgtgtttttctgcttacaaatataagagaacacagagcatttcccatctttacaccacagatattttgtatctggctttggtgttaacttctggaaaatcgactgtctttcatttgttcctttcttcttagagactcccattgcttgcaggttacatctctacactctattttctatgtctgccatcttctctctccttctttcaaccctccatatgtatttcttgtatctatttctgattcactagcccagtttcctgcagtgttgattttaatgtttactatatgcagtgatgatcttattttg

SEQ ID NO: 57441 - DNA, 1048 bp, Homo sapiens
tgacagggagaaaatatgtgattcttaaatatttacgaagagatctcatcatggtcctctgaggatgttaagaacccaaagaatcttaattgtttacagtgctctcccattaaaactttaaaagcagtggcctgggtttcttctttcagagtggacctggcactccagagggaaagctcatttgcttgattggctttttgggaaaggtgtgccaacgaatgtgttttcatttaataatctggaaaccagggggatcacggactggcgtgcagagttgctcagctagaagcgtctgaacttgagtgggaaggtgacaggattcagtgtggcttcgggccggtgtggtttgtgagcttagccagctatcctatgacagttttacaagtatagaactcttgaatatgctgaagttgaatattctgggaaaggaagggcgaaggtgattgaactgtgctcttgtttttgctttcaggcaaattcctcttctataccgggtgcagtcatctttagcttgtcagttattgtcacaacttgttgggaagatcatcagcttagccacatagagttgcctaaatatttgagcagaaaccccagcccttctgcagggtctcacgtgaacatcctaccagatgtggggatatcaaggtaaaagacagggcaattcatataataataccaacagcatacactatgtgccaggcacagttctaagcactttacatgtcttaggaaaaggtttttcgtatccttattttagagatgaggaaaacttaaacacttaggtaacttgcctggggtcacacaaccagtaaagaatggagctagattcaaacccaagcaggctggctgcagtagccagaatgacccaatcgtagttcacagtagtattcactcaagggattcagtaggatccataatgattcataggacagaatgcatatctcaacaaaacatatgtttgttttgtgttgtctgaaggttgtagatgaagtacctggcaagcatgtcagaattctgagctgccactggatgagaaacttccatgtca

SEQ ID NO: 57442 - DNA, 1023 bp, Homo sapiens
tgtggttcagggtctctcatgaagttgctgccaaactgtgggcagcagctgcattcatctcaaagctcaagtggggcaggggaattcacttcccaagcacactcatgtttgctgttgggaggcctcagttcctcaccacctggaccttccgtgggtggcctgagtgcctttatgatatacatgctggcttctttcaaagcatataaaccaagagagacagagggagccagtcagagagcacccaagggggaagctgcaatcatttataaccaaatcttggaagtggcctaccattatttctgctgtagattattgatcacatagaccaaccctggtacaggtacagtgtgggaagggattacacaagggtgtgaatcttagaagctggggtccttgcaggccatcttggagtcttcctaccccatgaggctactctaaaaacacaaaagcctgagctgtgtcaccaagctaaatgaccctctttatgctaaagaatgatccatcatactgtggaatgtgtcgcacctgttaaaaagaataaaaaatctgtatgtgcagatatgaaaagatctttaagttatactattaagtaaagaaagaatctgtaatagtgctatatggcttgatatattttagataaatttaaaatatatacatgtaatctggtgtagcatatatttttttttctagaatgaaaaagtgttttgcatttttccctccctccctttccatagggagaaatttttagaaatttagaattgaggcacctaagtctgtaccgatgctcgtgttccctgcctgtcttcagggaactatacagatctttattttccaagtctcagggctgttcgggccataactactcctatgctcgcctcagatcttcacttgaagctggttttcctgttgtgcagtgcactaagtgacacacagaggctttctgcctcagtgtcttcagccaactgagcaagaattcttgttgcaacaagttttgcaagttccagggttcttggtctgcctgga

SEQ ID NO: 57443 - DNA, 1192 bp, Homo sapiens
tcatacttttccctatgatataacatcttttgagttttttttttctttttgtttgattgtttttgtgatgtgtaaaaattcaggagtggagcagcagggaaggaagggactgccaaccaggcagttctggaacattccaggtgttttttctctagtctatcacttttccttttaatgaaaaattcatcactacagtcccaatatgagtaatcttcctatttatttttatgtatacaaataatatacataaatactagatttagataatgtataaatgtttttatatttcactgaaaatatccaatcatacacagactgtctggcatacaatggtttgatttatgatttttcaactttacagtggtgtggaatcattctgtttttcacattcagcacaatattcaataaattacctgagatatcagcacttaattttaaaataggctttgcgttacctgatttggcccaactgtaggctgttgtcagtgttctcagcatgtttaaggtaagctggtttaagtcatgatgtgacaaaatgtagtagttggttggggttgttatagatatttttccttaaagtcccagtgactattgaatcttgttttgtaaaaacaaatagtataagtgtttaagaataaaaaagatttaatatcaaggaacgcatgtagtgctagatgagattgtaaaggttgttattgtctatttttgaaaaccttttaggaaagtaaattaatttgttttaatttcatggactgctcagttttcttcacccaatacaagaaaaaaagaggcaaattataatactatttagaacacatttgctaaatttctctttgctgccttcttaattttatctggcagggctgcaagacaggagttacagcagtagacctggctgtcgtgaagtgatttcatctcttcaagttgtggagattttatgttttgtttgtttctttgtttgtttgtttgtttgttttttgagacaggatctcattctgtcacccaggctggagtgcagtggtgcaatcctggctcactgcagccttgacctcctgggctcaaacgatcctccaacctcagcctcctgagtagctgggacttcaggtgcatgccacctagcctggctaatttttccatattttttgtggagatggggcttcactgtgtttcccaggctggtctcaaactcctg

SEQ ID NO: 57444 - DNA, 1530 bp, Homo sapiens
ccatcgcctcatctgggcagaaatgaattggacagaaaggggctttgggggtccagggtgcagtggctcatgcctataatcccagcacttttggaggctgaggtgggagcatcactcgaggctaggagtttgagaccagcctggacaatgtggtaagaccacatctctacaaaaaataaaattagccgggtgtggtggcatgtgcctgtagacctggctatggctacaccactgtaattgagcctgggtgacagaaagagaccctgtcttaaaaaaaaaaaaaaaggaaccttgaggtgatagaattaacgtttttttaaaacaaaaagaaaacaagagggctttgggcaggctatggatgattcatttgcatacacaaatttgaaactttttacatgaaatagtacagtaaacatttaaaagataaatactgcccaggaatactgttgcaataccatagtaactgcaacaaatattacaggaaaaaaaattaatacttttaacatagaaagtgtttttgtcagacaagaaggatatccctaacacagatttttaaatgggcaaaggataggaatagataatttgcagaacaaagaaaatagcctgtatggaaggaaggtagaagaataaccttatagtatatagtttaaaaatgcagatttaagaaaacaatcagatactttttttcctaagaaattggcaacttttttgtaaacttttttgtgtgtttttaaaatcacactgtcatttctgacaaaagtagaggagtcaggcactcatattcatatactgctgctgagagtgtaaatagccacaacctttctggatgaagatattgcaagcccaaaagatggtcatgttcaaattaataattattttcctaggaagagggaaatcaaagagatgtacaaagatggttactacagctttatttgtcatggtgaaaaaaagggaataaccaaatttcccagtattacccggatgagtaattaatggcttatccatataatgagatagtataaaccaccaaaaaagcatttgctcaaagaatgattacataattccaattttgtagataaacagcagagagagaaaaaaatgacataggaaacattccaaattttaatggcactcaattggtaggataacagatgatttattttctacaatgaaatattgctttggttataagaaaaacaacagcaacaacatatttggtatttataccaagcaaaatgtacatttttgtcatttggcctagagaagagacatgtctgctcaacaatgaagttatttccatgaattctggcatattggttaagaaggactcagagaatccatctaaagctcttggtctactcctggtggtcataataggtgctcaataaatgtctgctgtgcatgtctacagggccctcaagtctaatgaggatggtttttcaattcttaatacaatctgggtacgacttgtcacagacacgaggatgagggatggtgtattttttttgattttagaataggaaaaaaacc

SEQ ID NO: 57445 - DNA, 1032 bp, Homo sapiens
tattatgttttattttggaactattccacatgttgaggaagaatgaaggaaggggaaacagaatcagacttctaaagagtggaaaggtgatatctgtatcatatgaccaagcctagggaaaaacacatgagccacactcactttttgaaaatctgatccttattgttaaggagggtgactataattttagaagggaaaagatgaatggaagactgtcttggcttagaaaacccttttctattttttgtccaactgaatcactctgataaaagcggcctgagcatcacaagacttaactaacctttatgtcatttcccctcccactctgttcccaaaatggctggtatttttttatattcatttttatcttgctccaaacaatatgtagtttctcctcattgacaaacattctgtcaactcgtgaattattgctgattcgtttgcatgtgtgtgagctgctctctgctcccacctttgcactatcagatggaattttccacgtatatgtcttagcctcctgacgctcattaatgtcaatgtgggggtcatgaactgtgccattattgttcttgtagtgtttagttagcctgagaagctcaatttgtgtgtatgtgtgtttttttcttttttttaattcaataggttttgtgggaacaggtggtgttaacttacatggataagttctttagtggtgatttctgagattttggtgcacccatcacccgagcagtgtacactgtacccattgtgtagtcttttattcctcgccccactcccaccctttcctctgaatccccaaagtccattgtatcattcccatgcctttgcatcctcatagcttagctcccacttatgagtgagaacgtacaatgtttggttttgtattcttgagttacttcacttagaataatggtctccagttccatccaggttgatgtgaatgccattatttcattcctttttatggctgaatagtattccatggtatatacataccacattttctttatccacttgttgattgatgggcat

SEQ ID NO: 57446 - DNA, 1068 bp, Homo sapiens
gatctatcagcctggctctttagggagcaagaagaaaaggagagttcagtttctaatgcaacatagtcatgagtccaaataaaaaccacgccatttctgtgcatcaggtgtggccaacaacactctgaactcaatagcagtgtgaggcacaatcagtgaatggtatcattttgccatggatgcaagtatttggacaaggaaagaaacccaaggtacaactgagagtaacaggaatgttggtgtgtctcattcccttgactagttctcattcagcttctccttgccctctcttcagctatccttttctcttccttcccattacctttccattcattaggtttggcagtcatggatgttgcttcagccctgcagagaacacgcagggagagaagggtcccactcttggtaactactgcattgttatttacgaacatctaaaaggactcactttagactgacagctccctaaggataagaattgggtctcatttgtctttgtttcctcagaacctagcacagggcttgggacaaaacagatgcttaagaaacttgttgaatgagtgaatggtgcagataagaacactgggcttcaaatggagacagaagcatacaaaggcaggaaatgttacctggaagactcctagagtagacatctctacttggagcagcgtagcaggtatagagcaagcacagtgccagataattggattgatagaggccaagggaaggaggcagcatggtgcaagagaaagagcccatgcttcaaacctgggccaaagccaaggattggctctggcagcagctgtgtgaccccaggttaagttaaactctctgattctcagttttctcaccaataaaatttgagaaataatactaactggtctgggatattgaagaaaatacacagagtctccagtagtgtttgctgtgttgtatgtgctctgtaattggtagccttcattttggttgaagtcgcctgtgtttgtaccatcaaggccatttatacaggaaggatttgggatgggcttgttgggggtggtgctaaaccgaacctgaaaatgcagaact

SEQ ID NO: 57447 - DNA, 1277 bp, Homo sapiens
acccccctttgtggagaggaaagaaaggaaccaacttaaagtatgtccctcacctctccctctccagaggcccagcccatggaacagtgaaggggcaaacccaacctcttctttctccacatgtgactggatgagtcagtcaccatccagagggtctcagcaggtgtgaggcaagggactaatggggacctaccaagttctctaatccagcaagaaaactgatcctcatctaactctttctgtatttcctggttaaaaactgtaatgaaaggagatgtgtgattagtctccccaaacctccatccaagttcaacataaattctagggtgtatgtggaacagagagctctttcagagcaaagagctctaaagagtttgtctggaaggcacatcaagaggcaaatgaattaaaatgccagatttgctaaagccattgtccaaaaggaagtgaatcctgggggaggtgtgtgaggctccagtctaccaagtgggttttcccaggtttcctggcttgagggcaaggtggtagcatttgcatcttaactgttacacttgagaagacactaagacatcccttttaattaagtccaacaaatagcatggaaatcttccacaaaaaaattccacaaaaaattatgatatgtctgattagaagaaatcagtcacaacagggaagaattttacaagataacgttaagtgaaaaaaagcaaactaaaacactgtgtctataataggattaaaatggtataaaaatgtcatgcatatggacaaagattgaaatgaaatttgaagactgattgggaagagatgctgttggagatgaatttttccatttaattttgattttcaatgttttcatgtttgtaaaataagaacagtttttgcagaagagctctggagagatgtctctcaaggtggaaattatccctgctgtttgagctctaaagagggcaaaacccttgaacagtgttagcctctgatgctactggtggttaattctgttctctggggcagggcaggcaaactatggcccataggccacatccagcctgcgagacaaaaatggtttttacacatttaaatggttgggagaaaatgaaagaagactattttgtgacatgtgaaaaacagcatgaaattcaaatttcagtgtccataaataaagttttattggaactcagccatactcattcatttacttttatctatggccgctttcaagcttacaatggcagagttgaagcgcagtgagaccatatggaatggaaggcctaaaa

SEQ ID NO: 57448 - DNA, 1039 bp, Homo sapiens
ttaaggattcttgtttgttgttttttgtaatccgttttagagtgaattaaactcagacatccctggattgtatgctgtctgtagaatgttgattttcaggcacggggatgtagctgtagaatgtggcttgttcattcttcctgataagaaattgatctcctgaatggattggccatttggtaatttcttagtgaaaggctgactcttgaatatggctgttataatataaattcttaccaacataaagtaagggcttatttggggcttggtaaaactgtcatgccttgaagtatatatagcttataaattggctaacatgtatttatgacgtagctacccctgtgccagctatcactgacaaagcctggattctgttgcaaggagacatatattgagagaaaattgattacaagtaactatttcaggctctgctttgaatttctcattcacatgctcttttttctttttccctccaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgcca

SEQ ID NO: 57449 - DNA, 1813 bp, Homo sapiens
agcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactgctaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtca

SEQ ID NO: 57450 - DNA, 3033 bp, Homo sapiens
ctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgcccactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttaggcttgttcatggaatataagccaagtttacctctccccattttctgccctggcccacttcccactcacctccacctcattgccaggaagggatcaaaatgcctccatgccagttgttaatggctacatatttgcccttcccaagggtatttgcattttatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaagggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaagagttggcctggctttgttctcttttatgtctttcttctttcctttctcatggaggaggccattgtaaatatctgcaaaagaccctgttagtgtccttgtccctcctctctttttgccttccctatttcgtgt

SEQ ID NO: 57451 - DNA, 1882 bp, Homo sapiens
ccctgtccttggcttgacctccctccctccctccttctcaccacaccagttggaaatcatgaagacaatctgttcccaagagcaaggctggagggcggaaggctggctgggctgatgggaccaacgcttgtcagaaatgaacaggctcatgcgacagtgaagacagagcagagggaaacagcttttggcttcatgctttgacaaagtgccctgagaccgtttgtccatgtgtgtgcgtatttctgttcggtaaatcctggaaggccagtgcagtgggagaatccatatgttttcagcctctaaaacatgccaggtagttatagttgacagtggggtatgtgagaaactatatggtactggcctcattcttcatgctgccactctggcctttgaccttggagtggggaattccttaaattcacacatccctgagcccctttgtgggtgacccaggccctggcatacactgtacaattaacaaatgtcagctgaatgagtagaatgaataaacaaaaaagagtcattgtgtaacagaaggttgttcattaagcacttcctgtgggatctcctcaagtcaaactcatgagaaaatgattgtttttagtaggctccggaaggttaaatgacttgtccaaggtctcatagacaggactgtgtgtgtgcacatggtgtgtgtgtgcgcgtctgtgtgtggtggggattgagcaggagagaaggctcatggcgttattttatgcattgcccattcttgcaccttcatcaggtctgaatttgtgaatttgctgaggctgataggacagtgtgggctgtccctgaaagttggaggaggtgacaacaaggttgggggccttccatatgggtgcctgctgtaccacatatccagtaaaaacagaacatttacgaatggtaagagaagcccttatgtacacgaaatagggaaggcaaaaagagaggagggacaaggacactaacagggtcttttgcagatatttacaatggcctcctccatgagaaaggaaagaagaaagacataaaagagaacaaagccaggccaactcttaaaaattatttaatagaaagtccaatgtcaaaatgtaacaataaacaaaaatacacatgtataaatatgtatatataattagacctgtacactttctcagacccttttcaaaatggaatagaatcatcattacatcttggtggtcaaatcaaaaataatattcaagcgacatgggcccactgctacgtggggggtagtactgctggagcacttcgagggttcaaagaattccaatcaggagagagctggggatattgccagtgtccttttctggagacccagagagggaagatgaacaatcaatcgcatggctctgtccagtgtacctgacttttgcttagcacctgtagccactactgtctagggacagctctcctttagggttttgaattatttacatttatgttgtttgtgagtgagttttctttcctcatctcccagatttgaagttcctggggattctgccttaggactttcttattctgcaggccaaatgtcgcacagtggtttgggatgctatttaggcgtgctgatttgcactaaagcaagggtgttcaaagtggggtgtgcacataccaggaggtgcccaaggtccccctcaggagttcagagagaaaatgccagaacctctgtttataatattttgtgtcttattcatttaaagtttctatgctgtatactttttataatgtgcctaatatagtagtacaaaagtaaagggatatatgctttaaataaattaataaacacacagagagagtgcatctcacgaagtttttgctgacaggcatgtgtaattgaaacagatgggggcccactgct

SEQ ID NO: 57452 - DNA, 2652 bp, Homo sapiens
ctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagttttaatttgaatttttagaatcactgtgcatatcctcatacttttatgtcttgatgtttatcactctgttttccttttttttttaaactcattttatcctccggggattgaattctggggacattttaggctgtagaaacccaagcttgtgggctaaagtaaggattttgttctaagaaatcactgaaagtttttcaacaagtcagtagcatgcacaaaggtaatgctaagtgaataaaactctagaattgtgtataaattatgatccagcgcttgctcactctctccatacacatatatacatacacattatatatatatacacacacatatatataatgacattgactcatttattcaacaaagattaagggcgtgcatgccttctgtatgccaggcactattataggacctggggttgtagtggacagatggacaaaatgtggtaaagaagatagaaaataaagtagtaagtaaaaaggacaatgagtttatga

SEQ ID NO: 57453 - DNA, 2051 bp, Homo sapiens
tggttagcgtacttcttggcttactaatgtccactgatgtcagtcttagttattgtcattccttccaatttggaagaacgtttattttctaacactgacacattttgcacagtgaatctataggaaaatgtgactgcataaagacagtcttcatttcagtgctgatgctcacctttctgcattaacatgagtctctttcacgttttatttcatcttgttgcaaaaaccaatatgctttggaaagtgtaatagtacatttttttagagaagtagcatgaggtttgtttctttctcatacagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgt

SEQ ID NO: 57454 - DNA, 1066 bp, Homo sapiens
aaattcattcatagttctatcactgtaatccgagtcattgattttttcctttctaggcttttccataagcatatgaaatttttatagtcataatcatagaattctgtattctactttttaaatgtattattattctgtgtgtcctatcaagtaggtcattataatttacttataatggtgtacagttgtttacaattataaatagtctagtaaaattatttgggcatagggcttttcgctacttttgaattatttcctttggatacgtttctatgagaattaatgggtccaaaaattatgttggtttttatggttcttgatgcataaaattaattctgtcattgtaaaaaatcagtaacaattagtagatagatctttttaatggctggatattttgatgtttgctgtatttattttctggctagatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgaggtaagagtaaaataccatttgtttttttatgcagcgtaatattaattttgctagtttgataacaagaatgagtcacaaaaaattgttttggggggttcactgtgaaaacaagtaaaacttttagaagatgatttcaaaatatatttttcttttggaaataagaataataaaacatttattttgctttgttttctgagttaggatgtttttagacatatgtttttatgtgtgatttgtaatttttgccctgagtctgttcaggtgataaaaatacaagagactgcttcaggaaagccattttaacatccggaaatgttcacaatttgatttcactgatactacatcttacatgtcttttataaggaatgagaagacatatatagaatgttgtatacaatatcatagtagttagtctcaacaggccacctataatcaaatgactgctgtcttggtga

SEQ ID NO: 57455 - DNA, 2105 bp, Homo sapiens
tataaactgcaaagcacactagaaatattggttgagtactgtgatatgcaaaatgtttaaaacaatattttatggtgactatatgttagatacgttatcattagaaaagaaatgagttctagttcttttaaaactctagatattgaggtttaatgacttgattgccatttgagaagattaaagtatttaagttgcttttatttctgacagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattggtaagtaatcatccatgtcattgtgttgactgaaggggagataatttttaggattttttcccttttattttctaaaattttatcaaagagtttgtcatagttttttttacctcacctagacaacaaggataggtaatccaatgacttttaatttctagatatctaacatcttttttaaaagtctagatttgaatttctgtatattaatgtcagtgaaaatacttgggtttaggtgtgagggtgaggtagggctgagtagtaaaaaaattcagtaccatggataagaaaaggtgcccatgagatccataacccccgaagggcaagaattacactgtgccacgtccagtggggagccattgaaaatttccattactccacaaagatgcaggctttggaggcagacacatgagagtacagttcctggctctaccacaaaattgcagtgtaaccttggcctagcttcagttttttaatctgtagattaaatagtataatttttttttatttgatagtagaatatttttgagctccagtggaagtgataataaatatattttaggtgattgtaaggtttaaagatatataaaatttcttggcataatagcagacataggataagtgctactataacagggtttacagtattgctagcagatctttatccccttggatctttttctaccgaaatgacaagttaccacctttaaatcatcttacctatatgtatcaactagtgggttttgcttttttatctttcatagacaatcacttatatcatgataaacaggccatgactattaggggaaatataaatttttctgttttaaagtaaataggagtttacattcagaaagaactgtaagacctgggctcacaatatgctgattgtgagttcttttgtacagcttctctcacagggaaatccattttggattcccccctcccctgccgcccaatagttaaggtaaataaaaaaaaatagttcaggtaaaacagaatattaacacttattatgttgatttaatggatgcataaattttattaataaacattaggagaagtcctgtttaatgacttaaatcagcagttggcaaactacaagactataggccaaatccagctcattgcccatttttgtaaataaaagttttattgggacacagtcatgccaatttgtttgtgtatggtctatgactgctttgaactgcagtgatggagttgagtacttacaggagagaactacaaagcctgaaatatttattcatcatctagccagttacagaagagatttgccgacccctgacttaaatcatgctctttatccttgggtatttcccacacttagattagttttattgcagaatttattatattaaccatcactatcattttgaacagttcttaccaagacttcaaaatgaaaatgtaaagtataaagtgtagaatttatgcattaatgtttaaaaatatttctttgtgtagtattttggttttttatatttttcagtgaagtctaattctcatgatcttctatagtatgcaataattgtcaatttttgttttgtttgttttgagatggtgtcttgctctgtcacccaggttggaatgcagtggcgtgatcttggctcactgcaacctccatctctcaggttcaagcaattctccctgcctcagtctcccgagtagctgggattacaggtgcctgccaccacgcctggctaatttttat

SEQ ID NO: 57456 - DNA, 1799 bp, Homo sapiens
taaagccttctttttaaatcacttaaatagctacataataaattccgtcaaatttgtatgactttttccagctctctaatttaatggaagattcttatatgattctcactagtaaaatttatcagttacctccctgctgttgattctctatagaagaaatggagaactttccctcattgaaaggcctatagaaaaatcttgtctgcattattcacaagattcagtgtatcagtgtggtagacaactcctctggtctttttcattaacatagaatatacttggagtcaaggttattctgcccctggtagattgatacattctatagttctttgaacatctaagttggtatagacaggattattaaccttgactctatggctttcatatagttggcatttaaattatttttatctacttatatttatttgtgactttttattttagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacagtgagtttttaaatgaaatgtcttattctcttttttatttctacatgttttatttttccaagtgaaaagtaatccatgagtagaattcaataaatatatgtatggtaagaataaatatatacattttcctattttttttcttttattgcatcctgtatacacttatatatttcattaactgtttccttttaaaaattatgttgagtaggccaggtgcggtggctcatgcctgtagtcccagcactctgggaggcccaggtaggtggatcacaaggtcaggagattgagaccatcctggctaacatggtgaaaccccgtctctactaaatatacaaaaaattagctgggcgtggtagtgggcgcctgtagtcccagctactcggaaggctgaggcaggagaatggcatgaacccaggagatggagcttacagtgagcagagattacgccactgcactgcagcctgggcaacagagtgagactccatttcaaaaaaaaaaaaattatgttaagtaaaataattatttctgtttacataaaatgtttttctcttgtagacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtgtaagatgtattattttatattttctaatatcaaagttgtttcttagtaaatgacagagaacttagggagcatgtatcaacagccaagaagacattcacataggccgaaaatgttgaggtatgtagctatcactggttaaaataaaaattagtagtaaagttagatagtaaagcttattttgcagtaatatcttttttattattttggaaactttcaatatatcttttattttatgaactaaggtaataatagtgggcagcatgtaacagtttttaacttctataactcatttttcatggaatagtttcatcgaatattttctggccaggcatgatagctcacgcctgtaatctgaggacactgggaggccaaggcaggtggatcacctgaggtcaggagttcgagaccagcctggccaatatagtgaaactctgtctgtactaaaaatacaaaaaattagccaggcatggtggcaggc

SEQ ID NO: 57457 - DNA, 1001 bp, Homo sapiens
caacagctttctgaagtgtactattacagtcttcattttaaaggtgaagaaaccaagggaaagagaagttagggaacttgcctaaggtcacacagttagtaagattaagtcagaattctaatctaggcagattggctcttgacaatgatgttatactggcaattcattaaagaacaataattaaacacctactgtatgccagccactgcacttaagtgtggggtagaaagataaaatagaaccagtccctgcactcccatgacttgtagttagtgaataagataggtgtgtaaagaaataatcacaaccatgtgatatgttctaaaatacaaaagaggtaacaagttgaagaattgcagaggaagacatgatttactgttcagaattctatttttcaaagtgtaacatccttctttttttccccaccaaatactccttttatgacattgtttctggacctcttaccactgacattgccccattctgattgcattccagtatatataataactcttaaaatatcacatccagaattaaccatactcaagatgtgtctggcacacagcaccataactgtctgtattcaggcaaagggtcactaatgttctatgaggctgatgagtttccaccctctatccagttgaggaccactgcttcattgactcactgttcctgaggggattgttgtgcctctcagatgtctttagccaaatgaaaggttaagaactaccattcttcatcatattgtgttattagatgtgctttagattttttaggagctttattatgttcagctcacagtgagcttgtgatcaactagtttcacatacttaactgtatggtctgctgacaaatgagtgttctccaccctgcctttgagcagccaagttttcttttttttagtgtaaacttagaacttttatatttaactcagcaaaatttctttttttgttttgtttctagattttggtctagaggttgaatctcattagctaaactac

SEQ ID NO: 57458 - DNA, 1068 bp, Homo sapiens
tttatttctaaataatgctctgtcttattccacaaaggatttgaggcttttagaaaatataagctaaaatatgaaatatgtatgcttacacattgctaagagagattttaagtattctcaccacaaaaaaagagaactatgtgagataatgcatatgttaattagcttgatttagccatttcatagtgtataaatatatcaaaacatcatgtcatataccataaatatatgtcacttttatttgtcgatttaaaaaatttaaaaataaatatgagaactaggagagtaataatccagaggaaaaagtagagggaaggataaaaagaaaacacaattatgtttaccaccaggacccatgtagtggcattgctgagtttcattatggagtttttctgagttttctaatagccagaatgatcactgaaaaaataatcaatttaattggtaaaaatagcagcctttgcaaaatgaattgttattttaagcaatgaaaattgatgttttattgatgaaaatgtcctgattgctattttaattgcttttacctatttatatatattctatatattctggaactacttgtgtatttaatcacattttttatgccttttgtatgttgttttgttcaggcatttaccacagatttcagagtacactgggctcaacatcctttaaggccagaatttgcagaaagtacctacttcttatataaagtaagaaaatataccccattttacttaaagtttagcctccattctctgttggatctctcattctttcataatagtaattgggttttcagagtccccttttaatattataatgattggatatatcatgattcttattcatctagtccatagaattattgaatgatgcaagaattgacatgcaaggtttttttctttaaaaaatattatgtaaacatttctttaaagagaaattttatgttctagagctgctttctaaagcatgtctcttgcctttcttcaggcagcctttctgagcattagaaatttaaaaactaaggttatatagttaaattttataattgtgtatttaagaaat

SEQ ID NO: 57459 - DNA, 1003 bp, Homo sapiens
tgcattagtttagatagtagtgagcaccaaaatattgttagccgagaagggatcaaacttccaagatacaggaaaaagcaaattctgtaatacagaagctgatagctatattacaaggggacctatgagcatcagtgggccgcaaagtcataccaaccacgggctaacgccacagggcatagagatgttcagttccatttttctcagaaggtcctatattacagatagtctttaatagtctgcatgtgagttagaggacataaaggagtacatatatattttagaaagatctccatctaaaataacttaaatatttatataaattggtagttatttagtgaatttatatataaattctagtttaatttattcacagtgctatttaatgtgtttagagtagtacctcttttttcatctaactttcatgaacacatgttgtgatcttttagcactatgatgccataatgaggtatattagccagccacctcttctacttgatgtgcatatccacaaaccaatgctgaatgctcggacttggatggatgctttgcttgccttcttcccaggcttgcaggtataaagaattctgtcttcttaatatgaatgtaagatgatgatgttaattaggcgcatttttgatctttaaaactgaactacaaaacatagttgcagttcagaattgtatttgtatacatttttctgtttatgtaatgattagagataaaatcagctcatattttattaggtaattttattgttgttgatttctaggtgttaaagggggatattagacctgctattgaaactcatgaaatgttatatcaggtgattaaaaaacacaattttctaccagaggtaagcaaataatttttggaataatcttacacacacacaaacacacacacacacacacgtacacatatacactataagttgctaatataaaggtagaaaatgtcatcttcaaggcttgttggttctttttatttttttcctattaaa

SEQ ID NO: 57460 - DNA, 1031 bp, Homo sapiens
caaatatgcacttcttttttttttttttttttttaaattacaggaatatgccagaaaagctcttgattttctctgggaaaaaagacagcgaagtagtaatttagtgggcgtgactataaatattcatactggagattgggtacgaaaaggtatgtaagttaggctttttaaatcaagcctttgcatcctcaaaatggttgggaaataaagaattttcatttgttaaaataatctttgggatactataaagcataggttctcacaagattgctggaattttaattaatttagccagattttcttttttgatgccaaatgtgacacacttcttctacatgatttagtattctatttcttaatggatatagcattataggtatagggtgtagatgaaacgctataatttatttgaaaactagagaaccagatttctgcagccatctcacgtcaaggtgtggtttagtaagaatatgggtttaataaattctttttttctcctacctccagaaatatagtagctaagagcatagactctggggtcatgttgttggattcaagctatgtgatcttgggaaacttatttaacctctgtgtgcctctctattccatatctgtaaagtgggcatattaatagtaattagttgttctgtatgaggattaaatgagttaaccaaagtaaagtgcttagaacagtgccgggcatgtactacacttactatgaagtaagtgcccagtaacgagatgttagtccttttgattaataattttacttctgggaatctagtctgaggaataatacaaaacatagaaaattatttgttcccaagatgttcccatgcaattatttataaatagcagaaaattgggaaacagtctaaccatcagtaaaaaaagctaagaaaattattttacatcagcgttggaatattgttattaaaataaatcaggagcatgggaaggaacatgtaacaatgttatatgaacaaacaggatattgaattgtacaaagaactgtgattttatctttataa

SEQ ID NO: 57461 - DNA, 2115 bp, Homo sapiens
atttcctttcaaatgtataccataacaatccgttttttctctatggtgaactagttaatatataatatagactggtttttcacaaattctaaactaaccctaatttcttctaaggctggtctacttccctattcttgtacttactagttcaaactgtccagagaacaaaattgttataaaagataccttctctgtgtaatttcccttggattataatcatgtcacttgtttactccaagggaagtaattgagttttgatgtcaatgaggatggaatgaaataaaagcttacttacttcatgaatattatatgcttagaatatatttccctacatgctaattggaaagtcagagatcatcagattgaatttcagtgtttagttattttatgaattattttcatgattttatacaaagacttgattgaaaagtagtttcttatcagaaggtcattgtcttgataactgctaatgacaattttctaattgtattcagattaatttaaagtttggcatcagaaaaccagaagctcggacaggaactgagacagatacctgtacagcttgtgcaggtaccttgatccttgaatttgctgctttaagtcgattcacaggagcaacaatatttgaggtttgctttttacggtctttgatatcctgggtattgggcataactacctttatatcttcttcattggttaaatattaggattattagttggagaattactgttattttagtgaactttttgtctaaattcctttacatggtttttaattgtcaaaaacctagaacattgtgagagagctatgttaaatccaactttgcattttgttcaccaactatgaagtatatgtttaggtttagtcttagaaatttttttagccatattacttaaatgaatttgatgtctccttgatatcataaatgtcttacgaaatactatgtccctgtgttttatttgttagacttccatattgcacttctgaaagttctgaaaccttcactaatcttctaaaacacagtgaaatttttgttcttaagtcttgattgagactgtaatctgtaaatttgtttactgcaagggaaatgttattcattatccaaaagacttaatatccccacatagttgtgggctagctatgtctctcattaaaaaaatctaattatttaagcatgtcattggagtgcagtggtaacacaaagcaccctctttttcaagcatatgacttaggttaatgtttaaaaattcaacaaatggcaaacagaacaagcagaaatagggactgtatagtagcattacagatactagatctgaatgtaaagaaaacaaattgactttgtatgtatgtatgcctttgaatgtatgtctgtatgttcaaatgtctcaaggacagatttatcatgtttggttggttaatcttttaaacttaaggttttgctctatatcttgttcactaatattttcccttcattaaaaagtgtggacacttttgcatactttaataactacactctcagatattgatgcagttacaggtgaggaaaataaggctcaaagagtatgacagacctgcacagctggtagatgatgcatggagttggaattagaatccatgtctttctgaatttgaaacccatactctttccagtgggctattttgtgtttattaataaatctgttgaaagtcatgatttaaaaaaaaaaattcttgaatacgcagtaatttgttgtcagagaagatgcagttgacaaagcattgatataatacagggttggcaaactgcagtctgtgagcaaagtgcagccactgcctgtttttataaataaagctttattggaacacagccatgctcaattgtttgtttttatctgtgcctactttggtgctacagtgacagagttgagtaattgtgccatttactgtgtgacccatagcgcttaaaatacctggttcttgtccgaaaaggtttgctgacccttggtctaatatatataaagagatctgaattctcatattatttttttgtcctgtaattcaattttaaactctagctaatcttgaatttcactaggcctgttttcttagctgtaaaataagactagggaaatctt

SEQ ID NO: 57462 - DNA, 1035 bp, Homo sapiens
tagcaggtgatgtatagtttaggaacaattgaacatgccttgaagaaagtgctttcttctgagaataaaagcaacttttagaatgtatctggtgaataggatgggttttaattttgttttgacttagaagccaaattctactagaactcacctcatgtagcctgggtcattaagaatccagttaacaggtctgatgatggtagcttcaaagtcctcataatatttcggtgtatgcaaagaagtgtataaagatgctgtataattagatacttaatttttttagttttagacattattacatttttataatatacttagaaatattatttgtgtatgtcactttttagagttttaaagtagactgacttttaatagctcattctaggaacgtttctccttgtcttggtagaaaagaactttatttcataattttcttctcccaggttttaaataaaactaaagaatttgaagatgcagtgagaaaagttttaagagatgttaatttagataacgatgtagtcgtatcagtctttgaaacaaacatcagagttcttgggtaagtatgaaagacactaaagctataattttattttatttttatttatttatatatattttttgagacagagtcttgctcagtcacccaggctggagtgcagtgacaatcttggcttactgcagcctccgcctcccgggttcaagcgattctcctatctaagcctcctgagtagctgggactacaggtgcataccaccaagcccagctaatttttgtatttttaatagagacggggtttcaccatgatggccaggctggtcccgaatgcctgaccttaagtgatctgcctgcctcggcctcccagaatgctgggattacaggcgtgagccaccacgcccagtctataattttaatatcagaaaagtttaggatatactgtttatttcttgatggtaatcatgcaagaagtttcctgtgtttaaaagatgtaagttggaacattatgaaacacagagtctgtggcattaccttgtattt

SEQ ID NO: 57463 - DNA, 1021 bp, Homo sapiens
tcagggtatccttttaagcatgcttgaaagccagaaaccataaggtgaaagcaagataaagttaaaagccaaacaaaagagaaaaatgtttactgtgtgtgacaaacataatgtatgagagtctcttgtggccaaaaaaagcaaccaatggaaagatgggcaaaagatcaacagacatttcaaaaaagaaataacaatggataatacaaaaagatgtttatccttattagtaatgaatctttagataccatcttttacctaggagtttggcaaaatgtgaactattgatcatttcctatgttagtgagaatgtaattgagtgtagattggtgtcctcaatttgtagcatttaccaaaaattagttacacatacctttgaccctaatgggtctatttttaggtatctgatacatagaaatactggcatatgttcaaaagatacatgcacataggtgtttattgcttcattgtttgtatagaaaaaaattgaaatcaacctccatgttcatcagtaaagggatactttgaggaatgggtactgctaaggggatagactctggagtcagggtacctggctttgaattctggatcatttactagatgtgtgatctaggcttacttaacttctctgggcctcagttttttcatccatgaattagagataattgaatctacttcagagcattgtgacaattaactaaaatatatagatagaatatcacttagaatataagtactcattaaatattagctaatgttatcagtttgtagttattagaatagagtacatctgtaacattctaaaaacgtgggaagaaaactccattatttaagtgacaaatgttagagcaatatgtgcatatggcatgaacacctgttcataaataaaattttagaataatatatgtgtatgtatttgaatgtatgtgggataaatctggaaggataaatgccagtcttatcagtagttagctctaggaagtgagattggggaggggaggggaagcagattatcagtttt

SEQ ID NO: 57464 - DNA, 1034 bp, Homo sapiens
caaagaaataataaacttaattaaaaatacaagtttaaggtgaatttcagggcctgtaagtcatttacttttttgtagtcagttgcctactatcctaaaatataaaatgcctggtacatggcaggcttttaataaatgttgaaagtttttcctcatttctcactagttctttctaatactactctccagtctggtctacagtagaacaattcctttaaccttcttgcttcccaggaaagcagtggtgttttccaaagacaagcaatatagtattattaagagcaagaactctggacttggagcaggacaccctgagatggctctgccacctctcatctgggttacaatgggaaagttacctagtcttcctgagcctgtttcttcatctctgcaaaatgaagacaatggtttgccagcctcacaatgttgttagaaggattaagcaagttaatataatgaaagtgcttagaactaatatctggcaaataggaagcatgatgtaagaatttactgctgctactgataacgactactactatcattattatttatttcctgcctaaattgaaattgccctcctaaaatccacttagcctgtaactcagaacttgttctccagatagtacatagaacttgcttaaagcgcatacattctttcctgttcttggcatgtgccctttgaacttactttctattaatgtaatagaaggttctattaatgctatttcttaatagaaatgtcctgccagctttaggtagattactacaactctgccatctctggacttaaatctagggatttttgggtttttaacacttattggcatgactattaataacgactatgtttgacaaatgtctagccccagtcagtctgcagtttacccacagtgaattgcacagatggctttctcgtttaccaaatgacatgaatttgatgtttatcttagcagttcttgtgtgaccttatttaaccccaggccacagtcactttagggcttctgttagcatgttttgagtatttgtgttcagtt

SEQ ID NO: 57465 - DNA, 1307 bp, Homo sapiens
ggcatctatcattcatcagttttcttaggaaaaattataagatgaattgtacataaattactagtaatcattaaagtttggctcagctctgtgtggtgagttcatgaaagcttgtctgctagctgttgtagtttctgattctgtttatgtccctttctacctaaatttttcttttgtttttattggtatattttttatgaggaagaattaactttttgaaagataataaatagaatatacttacctttttttttttttttttccatttctgctcttttaaaattaggaatcaagtactggaaatgtttgatcatgcttatggtaactatatggtaagtaggaagcttatctttacctaccatttatgtgagttgattattatgtgagcacagtcaactgggaattttgaaacctacaatacaattacattttttaaaaggaagtttttaaaaaacagggcaaaaatagtctttctggtagtggtttttagggaaccagtttattgaacagataagaataaattgaaattagattatgaaacttcattatttaaacagcttccttgggtgccatcaacaattatcattgagtgctttatatagctagatattgtggatatatacatgaagatgttatctctggtcttaagggagattattctcttaatttaaaaaaatgtttacaatatttatacactgaagaaaaccattgcttaaaagagaaattgttacttagcctctgtcctaattgtatcctcatggactctgcactgaatatattttgctttttagtttgctgattcatattatttaaaaatgttttagggctcacttaagattaaatagcagtttcagttttacaagatgaaaagttctggagatctgttgtgcaacaacgtagatgaaatagcaaattctggaattcaaaaaaaattttgcacataaattgtaatttgaaaagagtttaagcatattatcctgaaacttatcccttataaccttgtttttacattttaaaatatgtcagcagattttcttctatgattacaacgtataaaatgtagttgggaaagtttggcagaggactagctttagttctgcttaaaatatttttcaactgattctgtgaatccattttttatcatatattaaccaaatatcttcatacactaacatcattgttatctatgaacatctaaatatatgtaatttatgcatttttagttttaaaacatgttttatatttgacagtcctcgttctcttttatattgtaaatttggagagagcacattttgagttcttaatgt

SEQ ID NO: 57466 - DNA, 1026 bp, Homo sapiens
cccagccctgcagagagagggagagataagctgtggagcggtttacatctacttaaagtggaggtgccaccaaaaactagttgaagaaggctccagcctcatcccttaatcagtggctgcaggtatcaaagaataggagtgcccacgggagatgacagaatgcttgctcagtcccatggccttgggttttccaacttcttcctgctcccactgtgaccacgtgaccatttgtttcacagccctggtgatggggtgatgttgccttgggtacccccaccgaatagcagccgaggggactcatctctgatggcccctactctgcagtcccacttagccaggcctgtgggtggtgatcccagcccctgactgttgtctgtttctgtgtcgcttctggtttctagctaatggagaatgcagtgttcacttttgagcagttgctttccccacatctccaaggagaggcctccaaaactgcagttgccattgagaaggttaaactccgagtcttaaaggtaaaaccgttctcttgtttgtgggaagcataaaaagagaacgtgacccctgtttcttttgtaaagtggaaaataccaagttctctccttggctctaatctttccccactcctttctctcccaagtccagtgactgtcagtccgctgcagtttctccagtgtgacttccatgcctcttctgccatctagcggccactgctggtcctcagcatcattacccacagctacaggccccgcgtcccagccttcatagagatccaactcgacaaacacgtattagctgtccactataagcactgcatgggatgtaaaagtaggcaaggcacagcctctttcttcaaagaggttacaatatagtaaaatccattaaactggcgaataatttattgattttgaaaaatcagaacctcatggcaaaggaaatactccaaagaaaagaaatctaccatatgaaattgttttaaatgtacttcagagtgtttattaaaatagttttaataataggagctttcac

SEQ ID NO: 57467 - DNA, 1034 bp, Homo sapiens
catatattataggggtttttggtcactgttttttgttttttgtttttttaaggtgaccatgtgatacacttttctctatttttctttttttcactcaacagggtctcatggaaatccctccaagtcaattgatactgttttaactcctttattagcagctatataatattctgtggtttgcaccctacatgattcaaccattctcttcctgatggcctttactctgttcccaggtttaccactatcacccatgattaaatacgtgtccttgtacatatatcctcatgttcttatttctatgaggcagtgcccgtgaagagagattgctgggtaaatgtatttttaacttaatagatgttgccagattaattttctgatagactataaaatttcatatttctacagtgtatgagagtgccctttttccagcagccctgccaatcataggtatttcggctcttgctttgtttttttttgacaagctgatggataagaagtgaatttgctttttattttgagtggcctttcccggattggccatgagtctgagatcttatctcatgtttatcagccatttagatgcactttcatgtgaattgtccgttgatgttctttgccattttcattttcattcatttattcattctttttcttcttcttccttttgttttgtaatattcttgtaagaactctgaacatttagatattaaccctttttatatcttttcattgtcattcattccttccttctttttcttgttctcttgttggtaattttcttataagaactctgaacatttagatattaactcttttttatatctccattaaaaatgtttttctcaaattcattgctcatgtgttattataaactaattatgttattattaacctttaattatgatatattttgccatgcaaaggtgtctatttttatgcagtcaaatatattaatctttatttttatggcttttggattttctgcctgtgtttagaagattccccttaacccaagattatatttctaatttcct

SEQ ID NO: 57468 - DNA, 1035 bp, Homo sapiens
atttcctgtttgtggaaagaggtattatggtgtggtgtttgtaagcttagtatttggaatttgattttgaaagactattttggattcagatcttggctccaccacttaggatctgtgttactcactctcattactcttcaattttctcatcagtgggacagaggtattgtcagtgcccattcatatagttattgtgaaaattacctgagataatgaaaagacagtacttagtacaatgactgacatacagtaaatacttaatatatatacactgttaggatttttaagatacaaaatattttcataaaataacacatcaatttttgtgatgctactccataaataatattcagtttttgttttttatcctaatagaacaatttttttcacaatgtctgaggataaataaaagcaatgacttctaagtcacaattatacaatttttggaagctaattttataatattttgaatttttttgcatgtttacaaaattaatttttgttttactctggaagtttgaggtagatctgcccccgtctccctggccccccgcccccgccgcagtgctatatttagcatgcttcctcccacctgcctacagctttgcataccctaaaatgcccattaaactccttttcattccttctgtctacagtctgggcctatattagtcctatggctttgattccaaccccactcacaccatagttctctggttcattttcagctagttcatgagtgggtctattcttccagccttttcttactttccctttgtggtctacggtccttgcatggacatgaccacttcccaatgcctccccacagtccttcgttccctgaagttctggctttggttccactttcccatggctctgacttgcaggagtgcttggttgtaggctaactgccttgcacacaccctcatcagctgtccgctttcctgatgcagacctcagctccttgctgagcaatggcatcctcaccatgctgcccatgaaacccccacccagcccttcccttaaaatatctac

SEQ ID NO: 57469 - DNA, 1035 bp, Homo sapiens
gctcttaaaccaaagtttccccctctgtctcgtggtggttatatactgctttgaatcacacacaaaaattttaaaccagaaatattggagcagagtgagaggaaacacttgttgattttatccaggactgtgagtcacaagactagaggtggagcctcagggatctgaagaaaaagggagtgatggccaggtgtggtggctcacgcctataatcccagcactttgggaggccgaggcgggcagatcatctgaggttgggagttcgagaccagcctgaccaacatggagaaaccccatctctactaaaaatacaaaattagctgagcatggtggcacatacatgtaatcccagctactcaggaggctgaggcgggagaatcgcttgaacccgggaggtgaaagttgtggtgagccaagattgtgccattgcactccagcctgggcagcaagatggacactctgtctcaagaaaaaaaaaaaaaaaaaaaaaaagagagtgatgtgcttgcagaattgaaggcatagacctgggattatcatttggagggaggagctgaatgactggaggtcgaggagaataaagaacaagtagaagtggagagagggcgaggtagaagaacagtcttaggaggattagaaggatggttgagtttatggtcatggcgatagtctattgatagaaaataaagcaaaactcaataggttacgggatttagtccttagggtcaatttagtccttagggtctgtgaagcctctcaggatgatgccagaaggagagggagagatggggcatgtgcagcaggtagcaaagttctccgggaagacagactactggcaaatatctgggaaacaggggtgactggagggatagaaacaggggtgactggagggatagaaacagagagactggagggatggtttttggaactctgtagataggtgtatattctgtgctatacttaagaattctaattttcatatttttctagggaaaactgaggctgccatcaaaaacttcagtccctactacagtc

SEQ ID NO: 57470 - DNA, 1176 bp, Homo sapiens
tgataggtagaattaagcttgaacacatggataataatattatgtatggatacatacatacgttgtaagagtctaaaatgattgacaggtgtaaacaccagttttagcgtagtggtgcctggtgatgttgtggggcagggtagagggggttgcaaatgtagctgtagtattttgtttaaaatttttttgaggcaaatgtggcatagtatcaccattttatttagctgggtagtaggtatatatattattcactttattattctgtctgaactgtttcataactaaagaaaacatgcacgtacaccaaactgttgttatagtagtctataactcaatgtatctcatctcttggctcatataaagttggatacagagcagggtccagagaagctttgttaaagactttttaaataccatgcagatgatgggactggttcatagcagtactttttaaccttgattttgtgcaaaacagattcttaatcagtagataagaaaatctacctaattagtgcattttcccagggagccttatggtattagccagcaaagactgcagctttaattgagacagtgatgcaacttaattggaacacctgaatgcgattaagggagggggtactcatataaggtcagctggtttccctggtgcccagagctctgctgggtctatacctttttgctgacaacctctgccaactgggatgaagctgagccaaatgcttttactgtctttcttagatcacttaatgaaatgttttaaatacagattccatgtatttcagtgtgtattgtgaaacacattggcatgctgattctactggtaaactttagaacttattacatagaagcactagatatttgcattgcttttaattgttattgatgcaggagtttaatatatattaagtgaaataaattgataattgtgttgagactcaataatgtattttagttgattacatctttatttgggttctccagagaaacataactaatgggatatatatatatgtgtgtgtgtgtgtgtgtgtgtgtgtgtatttgttataaagaattggcccacacaattatggagactgacaagtccaaggtctgcagctggtaagctggaggcccaggaaagctgatgatgcagttctagtctgaaagctagcaggctggagacccaggaag

SEQ ID NO: 57471 - DNA, 1049 bp, Homo sapiens
gcttaacccgctaggagatgtaggaagtcaacctgttcaacacatctcaagcagatcgaatgatgaaatgttgatgatttcaccataccttttccactaagaaatggaatgatcctcctcatatttttgcagcggttatctatttcatctattaactgagaatgcagagtgtgcctgagcatttttactcacagaactaatgaaaaaagttaaaaaatttttatgcaagtggtttgcttgactttcttgcaaaatgctcataggaagttaataggaatcatattattatcagaaggttttaagacaacactagttctccccctagcccactaccaaaatacactgtggtatactaatttacacaaattaggttactatatacttgttactatgctttcatcacaaaagtatttaaaaccaacacatcatagattgttttctttcctatattttaaagccactcaaagctgagtggtatgggagaagtctgtggtattatacaatttgaggaattcaaaaagttccacattactgccaggcctgctaaagtaatttggaggaatttatttactatcatgcttccttgctaccatttacaatcactgatttgttaaaactagatgttttgcagtggaagtggagattgtatttagcctctgaggtccagccacggttctgctggtgccggcaatccaggggttttggctcctggggtctcttgtcaacatcatctctgggtagccagttacccccaatgtcctttttcagggcacagggtgtctggccagaatccccacttagcccaggacctggccccttcacctattccctcttattctgcatctggagacattgccttctcactggttttgtctcatcccagaaacagtctaaagtctttcaaattcagaatcaccatctgcttattggatattttctcctgaagatattctgagacactcccggaaccagatatttgtcactgaaaattttaatttattccatattttccaaatgccataatggagtgtggagatacaaagatgaat

SEQ ID NO: 57472 - DNA, 1068 bp, Homo sapiens
ttactaatcctcagcttcctttttctgtaaccatatttagtctactattttaagtctgaaaatcactattcttggaagagaagtaattgcgaaagtaataggggagcagttctcctttcactttgttattccagcaacatgatgtcattggtgccaaacatctggcttatttctcccttgtgttccttttgtgcctaacataaccattagaatgcttcttgttgttcttacaaattataggtctcaatctatctgtccctgtttttggagagacccaaaactctcttgcatttgttcttgaggagcccctctttcttttttttttttaatcccagcgctttgaaatcaggtcataatagaactatgtaggaacctccatccttccttccttggtggaatcaccatctgtgactatacagacaaaattgtccatagtctgcggacagatggatgctatttgactctcattcagaacgctcttcccacagagtcatgatgctgtttctgctgattcttttgaaatctgccttcttgaagtccatgctttcttgtcatattttcagcgactctctatctggctatcagaaatgtcagggtaaatgtcttttgtctattgctgttggaatggagtgggacaattaaccaaaagaccgttaaagtagcaaatcattaaaagatacacatatcttgaatcttttaacttaaaatatgttaatgaaacaaatatattcactcgctactctttgacctagggctaaggtctttttttaaagattgcttgcagttccatattgtcatttttgcatcatctataattttcagtcttaatttcttttaagttgggcaagaccttgtaaagaaatctgatgacagaatccatctagatctgtatttatagttgttttacctacatgtaatttaacagtaattatttttagaaactctttatcaaaactttctaaagcatattttacagagtgaaaagccttggatgagtggagggtggttaagagggtttctgccatgttctctcatgacatcattgatttcacccaaggttcattattt

SEQ ID NO: 57473 - DNA, 1035 bp, Homo sapiens
aagtggaacatttgggggacatttctgtatgtcttatagtttaaggagattatggtaaaggaataaacatcacgtgcttgctcttttggaagggaatttaaaggtcattaaagataacttcatgcttgaatgcccttaccaagggggtaagcagctttcaatacctccagtaataagaaactcactatctcctgaagccagtcaattcatatttggacagttattttgttagtgaattgtgccaggactgaattcttcctaatttctgcaccaccccttggctcacacttagctcctgtgccaagtcctctgccacttcctcttgcctaggcccagccagctctctctggcctctggcccctggtcagcacaaggctcctgtctgtataggaaggggggttcaatatacaggaatctgggcttcaaacccaggattatttggtcaaagccaggccttttaagaaattattgctggaaaatatacatatttatcatgttaaacattggcaacttgcaattcagcagcattaactatattcacaatattgtataaccgtcaccactatctactcccaaaatgttttcatcatcgccaacataaactttgtgctcattaaataactccccattccttctcctcccagaccctggtaacctctatttcactttccatctatgaatttgcctgctctgtgtacctcataccgctaaataatacattatttgttcttctgtgtctgaagccaaacccctttttactacagcaccctaccttcatagcatcgctttctatcactaatgcaatttgtctacttaaccttcttaaagtcatttgagtacaagagctgtcatacttttacaaagatctcaaagacttggactacatgtcatttgatccaacagaaagcaaggtaggagaaacaatgcatttcttttcttttcttttctttttgagatggagttttgctcttgttgcccaggctggagtgcaatggcgcggtcttggctcaccacaacctctacctcctgggttca

SEQ ID NO: 57474 - DNA, 1016 bp, Homo sapiens
atctctagcaattcatctttttacctagcttaatggcccttgttacatattaggagaatgatggagtgaaaagacaaagtgtctggggcctgcctgcctaagaatgtggagaaaattacattggggaataaattatattaactccttctcatcattcacttaccttttgtaaatttcatctcactatgctaaacaatcctggatggcctgggaaaaaagtcgtgcaccttctcactaacaggctcagattccttgttcatcgttaagataatagagaccattatattatctcatgagattatctgcatctaaattaacagactcctctgcactagtgaacagggtgaatgcattcatttgggttggggttgggtggggttcttacctttataactcttgttttttttaaaatgattttggagataaagcaaataaaaaatcattatcttgatagagtagttttaaataaacatttgatggaattatctttttattgtttcattcttggcatccattcaataataatgatggtggtagtgatggtgatgactgttgattgcctgggggtgcaagagccttacctatggctggtctgtgacagagcagggaccccaacccagtactgcataattttctgtggatattgtcatccccaatttccccattagaaactgagacctaaattctagtctgagattcttcacttgattatgtgccccttagcataatcctagttcagttttaatagtcactctgaaggaaaactttttcacaggactaatgactcctctgctttcaaagggaagtgcagtgtgctatctcttactcttatttaaacttatagttagttggacaagcaggagaaaaacttgggtagccatgtgactcaatggaaagagtggaagaaggattggggcagcccatgtttgggtcctctttgcgcaagttatataactgagcctcagttcctttgtatgtgaaatgggataataacaactaatttacattttgttgtg

SEQ ID NO: 57475 - DNA, 1057 bp, Homo sapiens
ctcttcaatgcagggaagctggtggcaatgttaaccagtggcagtggcctgaagccatgtttcagttgtacattaattagaatggtctaactgctgaaacagacatcaacgctcagtggcttatagtgatttgtatctcactcatcacactatccagggtgatttggtggggggctaatgaagggcagtgggcttgtgtgtggacccagactcttttcatctagtgcatggtaccatggacacctttggtggtttgttaaagcctatggacccctttttagagtaacatttttaaatgaaaaaaatatagagaggatgataaaagaaaccaattttattgaactgtagttatcaaaatatttttaaaatctgtgatatggtaatatatgtgctctttattaatgcattcaatgacaaggtctcatggagggtttaataactactgtcattttgaagaagtgctattctaagatatgcagcaacttaaatgtgctacgaaaacatctgtgagctctattggtgacaaagtcacaagtactgctaaattacactgttttgttgcctacattcagggttggagaagtgctgaatttgagttgaaggttaataaaacacaggtgttcttttcctccattcagtgtttggatggcctgaattctatccacagagcccatgagggtctacaggctccagatcaataatctctgacctggctgggcatattccagcaccttagaaggcccaaggcaagaggatcgcttgagaccaggagtttgaggccagcctgggcaacatagtgagacctcgtctctacaaaaaacaaaaatgagccaaatgtagtggcgcatgcttgtagtcctagctgctaaggaggctgaggtaggaagatcgctggaacccaggatcaagagatgctgcagtgagctgtgattgcacaactgcattccggcctaggcaagagtgagaatttggctctaaaaaaaaaaaacaaacaaaaagaaaaaataatccctgacctaatggctagtggcttcatgattcttagggccacaaagac

SEQ ID NO: 57476 - DNA, 1055 bp, Homo sapiens
cagctagggatgtgtgtctgcatcgtgggggtggggtagggggcactttgtgcagatatcgctccttccttctggggggtcggagtcggggttccagtgtagaggagctcctcgacctcggggttcctcggggagaccccttcagcttcacacattcctggagtgccgcctcctgctctggagtatctgttgctgctttctaaaaccgtgagcttacccaggaggagtcgtggggggagggggtgtcttggttagtttctgcgggaagattcgcgttttgaaccgtgtcgtttacgctgagatgctagtacccacttttgccgggagcccacgtcctgctggtcagaatcgtttaccttctacagaagtctccttcttgctttcagagatggtgttagtaaaaattgatctcaaactttgaggttcattccagttatttgcccgctaagatcaattatagactcatctatttgaagcccctttgggtatctttttcgaggctgtcggaagttttagagaatgtaactttacattgtaaaatgatttgaagatgtcaggtttctttgaagtgccgtgaaaaggatatacatatgcactcagtattttagtaatacgctgtttttcaattaaaaaaattaaggcatggtttcagtgttctaaaccgaggatatgtttaaaacgaatgtacgagcgatttgcattacataatctacttttggtaattccaagatgatcagctggaatacttagtctaattggtagctaatctatctgttttgtattaagtgcagttgttgaatattctaataactgaggtgggtgtgagagtttgcttcttatagtgaaatttgatccttggatttataaagtatttaaatagcagcaatatgactcttggttattccctttttcccctgaaatttctacttttcacaatcaacaagtatctttaaaaatcttgattgtactcttaaactactttttagcaaaataataggtagttataggtgactcctttttctaggggtagcacagcaaatatggtccctcacttt

SEQ ID NO: 57477 - DNA, 1167 bp, Homo sapiens
agcaaagaagcataatttcttccagcaagagaaatgagttaatattaaaacgcactttattaaaattatggcagtgtttctagtatgacttaaagcgcttcataattttgaaatgactcattaaattctggataaactaaaaatccatcacagtttgcagcttttaaaagaaaaataagagattatgtactctgcgcacgtacacatctacaattggtttttaattcgtgttattgcacacactgtagaagacattgtcatcagacaatggttaatttctcgattgattcatttatttgacatctaagctgtcatagtaacttagtgtttatttgcatttaatactgagtaggtgcccatataatttggggtacaaaggtataatagcatttacacagtccattccttaagggtccagatatcctgactgtttgcctactggtcttctaccctttctacctaatgtgtctactgggtcttctggtatttcttgggggaagcgcagtttgattggtcttacataaatattttgactgtggtcatgggactcttggcatttaagtagaagctagtgttagtgtgttgccaggcaggagctaggtgatgagtccctgactataggtgctaagagcgtaggtgtgacccattatccagttttatgttgtgtggagcaactccggtagaattggccatgttcttaattctcctttgctttacggtttttagacagctgaggcagagtggtatgattaggcttagttatgtatcttgttggatgctcaaggagctatatacattactaaaaattctaagatttctattgcttaaatttacttctcccatttcattttgagaattaacatgtttgccatttatcataatttttaaaaatcagtttatctgtattaagtacaatggtgaaaagttatttttgaaattaaccttgggttaaattttctaatgagagcatactattaagtgaagtaaccagccaaatgaaaaacatgtaagcattttggtcatttgttttcaaaagatatgttacttacgggctcttctgcaagggggatttctttttgtttctatgctatagagtggagttgtatgaagaggttagattctaaagtcgatgcatagaatgaaaatcacatgtagtaaaaaaaaaaa

SEQ ID NO: 57478 - DNA, 1038 bp, Homo sapiens
gagagcagttagaattattgttttacaatgtgctagggtacagtagagaaaacggagactttagtaagaatttcaacagaaaggatttaatatagggagttggttagatgagtgtaaaaaaaaaaaagcgggggaggggggaacattacagtaatcagaacctaagagctcagagaagaggttctatggacccggtgctggacttttgagtaggtcagcattgtgtgcttgctgctagtacttataaaggcatgtgttattgctggttctgggagaaccacaaaaacctggagactggaaccatttgctaactgccagggtcaggggctgcatttgctactgacaggaactggaaagatgtcccgtctcccatcttcctgttttccagtcttcacttactgctgctattggcaaagcctaaggagatcccagctggcaaaggagttgatgaaatatagttgcagtctcagccataacaacatagagtctgggagggtagttttggagttgagagacaataagtaaatgatctggacgaatagtgtaggttaagatgtagtaatttaaatagggaattctgtgttaacgttgcctttcaaaaagtatttatcttctgtatgccagaccctgtgcaagggattaggaatagaaaaatgaatcgaaaaaggtctttgtccttgaggaatttatagtgtaagtggcaatgacaaactactgtacagtgttttcagtgcaatagcaaatgagtgctatgttttgggagcccaaaagacagcaaccaacttgcctcttctctgcctacctaactttataactactctttttatcttctatcctgattaaatccaatttcattctttctgactgctatgttcaacccaactcctgtgaaagctttttctgagatgtctcaatttcgtcacataattattattttgtatttctctgtgctttattcatctagattataaagaccattgctttctttgcacttttagcttagtactgtgcacatagatacttgagaaatactttttt

SEQ ID NO: 57479 - DNA, 2055 bp, Homo sapiens
aataaagaagctattaggctaccaagagtaatttagatgagtattccagatgttcagtacagtgacaagcttttcagtaaagaacactttgtgtctttagaagcttacagaaattagcgtctgtcttacagctgtagttttagattgaactgcggaaagtggtttttatgaggtgttaccgcaggcagtgttatgatggcagttggattgcttactcacaatttattatttgcctagtcttgagtaaatttctaaaatataacacctgtatcctgtaagcaagcattgctttaattaaggaagaaattatttgctcatttacatttgtgtaatataacataaaaggaaaagaaaaatgctaaagattgagagagttaatttgatgtgacctttattttactgtgttcagaagggacagtaactatgagagaaaaacatatctcattaaaagagagagaaggcatcttagtttttctttgtttcatagtgcttagggaagtgtatatcaaacaaatgaaaaaaatgctttgtagggaaatgggataattaagtaatttaaaagtatccttttttttttttttttttttgagacggagtcttgctctgttgcccaggctggagtgcagtgatgcaatctcggctctcggcaacctctgcctcccgggttcaaacgattctcctacctcagcctctcgagtagctgggactacaggcgcctgccaccacgcccagctaatttttgtatttttaatacagatggggtttcaccgtgttggccaggatggtcttgagctcttgacctcatgattcacccgccttggccttccaaagtgctgggattacaggcatgagccacagcgcccggccttttttttttttagagacagagtcttgcactgttgcccacgctggagtgcaatggtacgatctcggctcgctgcaacctctgcctcccaggttcaagcgattctcctgcctcagcctcctgtaaagtggttacattttctgaaatgtatttcacatttgtttaaaaacaaattaaggaaacagcatgtatgcaggataaagacttaagtgttgtctgtgggtagttggttatattcattggtgggttatagtcactcttactttggtcagtgtggtaggctgaaaaatgtcccccaaaagatatctacattctggtctctggaacctgtaaatgttaatttactttgaaaaaggttctttgcatgtgtaattaagttaatggtattgagatgagattgtcctggattatccaggtaggccttaaatgttaccacatgtaactttataagagaaggggcagagagagattacagccacagaagagcatgaagcagtgtgaccacagaggcagattggagtgatatggtcacaagccaaggcatactggcatttgccccaacctgaaagaggtaaggaacagattctcccctagggcctctggaagccaagtgcaatcctgccagtacttttattttggcccagtgatattgaattaggacttctggccttcagaactgtgagagaataacttactgttgttataagccttcaaatttgtgataatgttacagtagccatagaaaactaatatagcaatcattgttcagaatgtaaatggacatttctaagtaactcagtttacctaaactctttctccttttggggagtataatttatagctcactcatattaaactatagctttatttcagatactctgtatagaccagaaaatttttacgattaaagcagctgttaaacatttttaggtgcagaactcttgacagttttgctcaaaatgttacatttaaagttccttttttgagtaaaatgtttcatccaatttggaagctcccttattgctgccttctccctcataactactctggtaagagtacaatttaggctcctaaaattttacaacatagtgtaagctcttttgcctgttaatgtgctatttattatgaattcctctttcacctatactattgaaaatatacatttggctgggtgagtggctcatgcctgt

SEQ ID NO: 57480 - DNA, 1053 bp, Homo sapiens
cttctttttaatttttgagaaccagtgaataatttgttttttttattctcaagattaacaattcctaaaaatcagttttgagatttacttcctatcttaatccatttagcctgctataaaaaatactttaggctgggtaatttataagcaatagaaatgtattacagttctggagactgggaattccaagatcatggcaccagcagatgcagtgtctggtgagggcctattccttatagctgcttctctgtgtcagaacatgctggaagggccaaaagtttccatcaagcctcttttataaaggcactaatttcattcatgagggtggagccctcataacctgatcacctcccaaagtccccacctcttaatattacttcattgagattagatttcaacgtaggaattttggtgggacacatacattcagaccatagcacttcccttccaaatactaaaattgtttttctctcttctttatttccagcaatgtctcaggctgtgcagacaaacggaactcaaccattaagcaaaacatgggaactcagtttatatgagttacaacgaacacctcaggtaatgactaagatgactgccaaggggcatatgagacgtgtaaactgggatacatttttagaacatgaaaacttaaatagaacatagagtaataataaatttatattcaagcattcctgacttctgtatgttggctaacactttattcattgattgaacaaataatctgaatactctatacaagcttttgtggtaggtactgggtgaacagtggtgaataaaacagatgtagcaccaaccatggactttacagacattgaaaaagtacatatctataaaattcacatgtgagaagttgtagaaagttgggcaagtcctccttgctgtaataagtactgataaggcaccaaggaagactgttttgagatgatggcagactaggggaggagcaggtttgaaggcaacaaacatgcttaacactggattaattttgagattcctatacaacaggcaggcagagatgccaactatagatga

SEQ ID NO: 57481 - DNA, 1031 bp, Homo sapiens
tttgaaggtggacgttttctgagggttaatttagccctaactttctcattttgcaggtaagaagacaatgttaaataattatttagactcagctagttaatttgactagaactagatctaacctaaggtatatgattccaaattcaattttttgtattataccagactaatttcccactagtaagcttttaaatacattaatatgttatctttagcattaaagcaagagcatttttataacagtggtggtgaggctgaggggagctgtaggcgattatagttgaaacaaaattagctgtgagttgacaatggcagtggctgggtgatgggtacatatatgtttgtttttaccatttccagtacttttatatgtttgagcttgtccataataaaaaattaagtagcttttaattttaaagtgactcttttacaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtgggtatgttgaaaagagttgttatactaggtacttaattgtaccacgaaagtgctttccagggtttgagaaatacattttcttttttttttttttgagacagagtttcgcttttcttgcccaggctggagtgcaatggcacgatcttggctcactgcaacctctgcctcctgggttcaagcgattctcctgcctcagcctccagagtagctgggattacaggcattgccaccgtggccggctagtttttttttttttttgtatttttagtagagacggggtttcaacttgttggccaggtttcagcatattgaactcctgacctcaggtaatccacccgcctcagtctcccaaagtgctggaattacagacatgagtcactgcacctggccgagaaatacatttcctttcctttctcctttttcttctttcccctttcc

SEQ ID NO: 57482 - DNA, 1546 bp, Homo sapiens
ggcgaggctggtctcaactcctgaccttgtgatctgcctgcctcggcctcccaaagtgctgagattacaggtgtgatccaccacacctggccttggagtcgcttttaaatctcttttacacatcctgtattccagtccgtaaataaacaaatattttttgctttctccatagtatatccagattcattcaggccacaacaatctttcatttgatgtattgaagtaagttcccaactggtttttctacttcccatgcttactcccacatagtctattctcagcacagcagccagagatactgttaaattgaaaggaagatcatggttttcctttgctcagagccctctaatagcttctattcacattcaggctaaaaactaaaagactttaatgatggtttttaagaccctatataaggtgggcattttccttaccctcatcttcttttcctctctgacattatcgtctgatttattcaggcctcaaggagaatcattattttccatagaaggagataatagtaaagtccatctcagtctagtggttttcaccttggctgaacatcagactcactcagaaaactttcaaatctcatggctttaggcatcatcccggtcccagtaatcagcatccaggcatttctgcttttaagtttccatagataattctggagtgtagtcaagatcaaaaaccactggcttaaaggttaaaagatgtgctccattctaacagtattaaactgacctaccactctgtttaccaaagtataatgtactaaatgttaaatgtatttatttttagaagaattttacattcctaagcgttggaaggactttaatggttgttcagtttagccttttactaaaagcaagactctccttgtaaatattcttttggttttgcttgtacatttctagtggtggggctgtatgataggcactcctttcttttgttggcaactttattacagcttccttactgttcttcagactcaccaagcatgcttctgcctcagagcctttgtacttacactactctatttcaggaaccttcttccaaataatccacatggcacactacctcactttcttagcaggtatctgcttaagttctcatcttccattctaggactctgtaattccttaccctccctgcctcatttttttcccatagcacgtatcactctctcatgtgttacctgctacactagaattatgacccctaagagggaagagactatgtcagtatcattgattcttattaacaccattatttagaaccatgcttggcttaaagtagtagctgctcagtaaatatttatctatgtgtgaatttttaagttcttcctttatattgaattaaaattagtctcttgtgtgcagcagtctgggtttgtcttatgttgaaatacttatgttgacttctacatacatttcagattctacttctgtgtttacaaatatttttatgtaggtatatgttcgtatatgtccctctaaaggcttaatattcacattcctcatttcttttttgttcctcatatgac

SEQ ID NO: 57483 - DNA, 1133 bp, Homo sapiens
acaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctt

SEQ ID NO: 57484 - DNA, 1067 bp, Homo sapiens
aaagcctccgtacccaatccaggtccttctttataaagattataagagtacacttttggggagtttgtgccaaaggagtgaaagcatgagttagctctccttcctaaactcctctcctcagggaaaagtagtggttaaaagcatggactgtggaaccagactgcctgagttcaaatcccagctttatcgctttgatagttgtatgaccacaggaaattgtgcctcaatttgctcatctattaaaagaggagactactgctactaccatgatgatcagcattagtaccatctcagtataaatatggtaaaagtgatgaggtgatgcttctgattatttcccaagtcgcttggatttgaaatttgaatcatgttattactccttcttttcctgttactcttcccatatctactcagccaccaggtctgttctaatttttcttttctaatataactcacattttccattccatatccaccaatttaatgatttcatagcaagcctattgcagtagcttctaaatagtacccttgcttccagtcatttctctcctccagtttgtcttgcctgttactgctaaacagctattcctctgaagcaccacattaatgttatttatcaatcaaaaaagtcattcatctttattgccgggagtccagacttctcagactacatttaatatcttccatatctgatcctaacctgcttgtccaaatttatttctcagtattcttcaccatacaccgtttttctttactcttttgagacagagtttcgctctgtcacccaggctggagtacagtggtaccatctcagcttgctgcaacctccgcctcctgggttcaagcaattctcttgcctcaacttcccaagtagctgggatgacaggcgcctaccaccacgcctggctgatttttgtatttttagtagagacagggcttcgccatgttggccaagctggtctcgaactcctgacctcaggtgatccacccgccccagcctcccaaagtgctgggattacatgtgtgagccaccgcgcccagcctcttaactcttttttaaatctgaa

SEQ ID NO: 57485 - DNA, 1108 bp, Homo sapiens
aaacataccacattccagccaagggtggggtggcatggttgtatgttttctacacatggatttgttcatgaggttacttcagttcatgaggccagttagcaaatctctacttaatagtgttcatttcatcctatctcatatgatagttagaagttgacatattgccttctcccacctgattgaaagttctttgaagatagaaaacatgacttaacgtttccttcagtattttgtataggacagaaacatttttcatagaattattttgactaattagataaaattttaaaactaagtttatacagtggggtctccccccaacttttcattctaaagcacacttgttattttataaaccgagttgtggcagtattccccatctaggtccataacactgtgttataggaaataaacttctatacgatgtgatcaataaaaatggaactagaatacaaactgttaaagcataatcttctcaattttttttttcagagagacacatctcaattcaaaggcagcttgctgatctagagaatttagcttttgtaactgatggaaattttgactctgccagctcattgaactcagataatcttgatgcaggtatttccatgtttgggttttttttttttcttagtttctaataatttatcatctttcaattcacaaaaataagtttggtaagagtagacttgtttattcttactgaactagaacagtggtaaaatacagttttttattcaggaaattggcaaccgcttatgtgcaaagttgctatggaaataagttattttacaactcctcaagaaaattataatttcacggatgtctaggggctgtctattcggcaagttaggaatggcatttggctacaagtaacagaggtcccaaaaaacagtgtcttaagaggttaatattctgtcaggtaaatgaagtcccaagataggcaatttagggctggtatgagagttccacgttatcagtgccccacactgctctctttctgctctactctccttagtgtttggtttgtatcctcaagatcgctgactgcgtggtttttttgaagtagacagtgtaaaaataaaaattgtacctatactctatt

SEQ ID NO: 57486 - DNA, 1315 bp, Homo sapiens
gtaacactttcttaaggatcttctaacattttaaaatgtaaggtctaagaaagacataatttaagttcttttaacatttagtttgtggtcataagttgacctttatgtgctttctgaattggaacttaaaataatctttaattcattattttttctacttctaggccagttttgagtttaatatttataaaaggttagatagttatagataggattattttgcagttttgaaacaacatacaaattgttatagatttcagagtagggctaatcacaggaaagacaaaagtcagaatgcttcaggtaagccccttctcattatataagatcagagcttgtaggtacaaaataaggccagttgtttcttcaactacagtgggtagggatcggggaggcatggggagctgagagggttccaccctcctaagtagcctcctacctcacttcgaagttgtatttgtttatattagtcagaagtggttcagcagctttgggaaatgcatgcattctctacctcctcaccatcaaaaatatgttaaacatagaaaagacttatctatatattccaaaatttacaaatatgtaatttgaagaaggtatactatatgggaaactgaaaatgcattagtaggacaaatatgtaatgattgagaagtctgaaatgcattagaactaatacatatattaatcacattttaaacattatttttagttgatctagttagtcctttgaaatcagtcataactaggtaagatgaagatagcctatctgaaatagaattgaaaattgaggaaaaagtaatagaataagttgtaaaagaccctcctagcatcttggagacatctaatttaacaagaagtttgcctgttgacttctggattaatagtgtgttacaaaaagcagattgagtattttgcatacagattgtctgatacgcactatcttaaaccagaaggtgatttcagagatgtttataggcatatcatgcatttttaaacagatcttcaagagtttcttcagtagtagaccacaggatttttagttttctaacttaaccaagctcctttctcttattttgtgctatttaatagaataatttcaataggcacgtctttattgattgctgtttatcttgttttacatacacagatctttgaactctggaaccaaaagcctttatggttacaaattagataggttagtttgtacacatggattcatttctggaatattgctgtctgacctagcaaaagatttttatgaaacatgaagaagttttacctgtttatagaaattatatctcattataactca

SEQ ID NO: 57487 - DNA, 1972 bp, Homo sapiens
gcaggatcatcagcttcaaaggtaacacactcacatgcctggctgttagttggttctggttgttggcaagatgccagtagttcttcccttgcgagcctttccatgggctgtttgagtgtcctcatgacactctgactttccctagagtgagcagtccaagacagaacaaggcagacgtcatgatatcttatatgatttagccacataccactatgtagcagtaatatcttattgattacacaggtcagccttattcattgtggtagcagattacattaagtgcatgattaccaagcatcaggaatcatcaggagccatcttgaagactggccagcacatgaagtctcccctcatttatgttttgatttgcataaaatcaataggaatttcacactagtatgaatatacaacatttgtccgaataaacataaacataagtgtttttctgggatagtccacaatactgtcatccactaacagtattgacttggtccacagcagggctggaaaagtgagacggggatgggaggtggacagaggaactacagtgagtgaattggaagtggttcagaatgaaagagttaatattccaaggaagaagaattcactcatttattcactcagtaggcatttatgagcacctaagtttttaatacggcacactcaaggagctcagtgtctagtagaaagacaaccatacaagcaagtatgtatgtagacattactgtgtaccaacctatgcaagatgtatatgtacatatatatatgtattttaatatttttttatatttttttaaatttttgagatggagtttcgcacttgtcacccaggctggagtgcagtggcacaatcttactcactacaacctctgcctcccaggttcaagcgattcacctccctcagcctcctgagtagctgggattacaggcatgcaccaccacacctggttaattttgtatttttagtagagatgaggtttcatgatgttggccatgctggtcttgaactcctgacctcaggtgatccgcctgtctcggcctcccaaagtattgggattacagtgagccgtggtgcccagccacaagatatattttacatccattgtttcagtacctcaaaaaccctgtgggatgggttatctattttacaagtaatgacacaaagacttaaaaaaagcatgtgatttgccaaagtcttgttcaatgaatgactgaaggtattttgggaaaatgaaacttatgactaattggctttgaagtgtgggtggtgaagaatatagcagtcctggaggcagttgaaaatggtgatctgatgcttaagtgagaagtcagggatcaaggcatggtttgagactcattcctggaaaggtgatagatgaagctgaaggagaggagtgggtaattttgaaggagaatgaaagtgaagaaaagtggaataatgagagaatcttgtcatattgggaatggttaaaaagtagtaatcatagtgctgggagtggtcactcacacctgtaatcccagcactttgggaggcgggtggataacaaggtcaggaggtcgagaccagcctgaccaacatggtgaaaccctgtctctactaaaaatacaaaaaattagccgggcatggtggcacatgcctgtaatctcagctgctcaggaggctgaggcaggagaattgcttgaacccggtaggcagaggttgcagtgagctgagatcatcccactgcactccagcctgagcgatggagcgagactccatctcaaaaaaaaataaaataaaataaaaagtgatcatattgtaaaactccaatctttatataactgaaagaagacaaatttctattttctttttgagtgcaaaaacaaatcctatatttttaatgtttatgttagcttttcaggatgtccagcaaagaatcctgtgggaaaaaagagacatctcagaggaaagacaccaccacctcatcaccca

SEQ ID NO: 57488 - DNA, 1049 bp, Homo sapiens
ccagtgtttttccacttcatccagaataaaagccaaaatccttaccagggttgacaaagccacctcctctccccatcccatccccctgacactctcctgacataatttgcttttctactccatggcctccttgctgctgtcccaacaagccaggcatgtttctgcctctggggctttgcccttgctggcatcccctttgagctgaaaaaactctttccctcagtattctaatggtttgtttcttcactttatttaggtctccattcagatgtcagctcgtacctggggtctgactactctgtttaaaatggcgagtcttcccctctgactcccagccttttctgtttcctttctctgctttactgactcccagcccttcctgtttcctttctctgctttatttttttccacagcatcgtctgacacactaaatatattacttgtttatttgtaaattcctgtactagattttgaccttcatgaagaactgttattattttttcattcctctctctccactgtctagaatgtctttggtacatggtaggtacttcaaacaagtttgtcctaggtctgttgaattcagaatccagtgaaaaataagtggatgtgtggttttgcattgtagaagactgactctcaccatggcagtgccacctcacaacaaccttatctgagctgtcagctggcttcctgctctgatacctatatcccacctcatctctattttgtgagcatttaggggttctggcttctagttgaatctcccttccttttaccaaagtttgtgtatctgtaaacattgttccccaccgaagttcattattgaatgtaaatgttgatttgtaatactagtgatgaaatagttctgtttatactatgctttattttgtgctttttaaaattcattttctttattgcattcttaggacaagaaagagagaaaaaccccagcaagttctactagttcatcttctataagatcagtttcatcagaaaagagaaaactggtgagtgtctagatataactaactaaaagttatttatgc

SEQ ID NO: 57489 - DNA, 1068 bp, Homo sapiens
catacataaatgtgtagactttaaacctaaagatatcaaattgacaaatgctgggagcaagcttgaccatggaattaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccaggtaaggtagtaaaaaatgaagaatataggttttaactgagagtttattaatatagttaagttttttctgtatttctatatttttttctgtttttttttttttttgttgttgtttgttttttgtttttgagacagggtctcactccgttgcccaagctggagtgcatgcagtggcacgatcctggctcactgcagccttgacctcctgggttcaagcaatcctcctgcctcagcctccctagtagctgggactataggcacacatcaccgcactgggctaactttggtgttttttgcagagatgaggtttcaccatgttgcttaggctggtcttgaactcctgggctgaagcagttcgcccctgctcagcctcccaaagtgcagggattacagacgtgagccactgcacatggcctttttagttgtttctattactgatgataatcatagatggctgattcaaatttattc

SEQ ID NO: 57490 - DNA, 1027 bp, Homo sapiens
aatgagaatgaacttactttaatgtctaggtatttggctctgtgcaaggagcttcacctagcttatttcatttattcctcacaaaaatcctaaaggaaatagatattaaagattcctattttgtgaattaacaaactgagacccaaagttgttaaataatttgcttgcataggttatggaggtaagaagaaaactattttgaaaaccacgtgtgtgtttataaatctttgttcttttactatgctccttcagagttttataaaattttttctttccataaaccatctcaagtgaattaattaagaattaattgctttcctctcttgtcagtctgcaaagtaactcaaaatatttcactggggtcttttacactttagatgcagatagtagaagagcttcatgctgcacgtgtgggaaaaagtgtggatttacctggagagttaatgagtatggaaattgacttagaagatgatgtacattcctcctctggtataccctatatgttgatgtgtatgctcccctatgctttcctaaaaattaatgtgccaatattcaatttttataatatttagatgaaaaatgttaaaatgtgctcacttgaaatgaatgataaagtaatagtttattttttaggtacaggaattagatccaatatttgtcttattggttttacatatttcatattattggatagttagatatttttctctttttctgtcaagaggtagtaattagaattatgagttgtcttttattcttgctgttataactttaacaatttcaatgatgtaaagcactgatcagaaataatgcagaatagctggtgcagtggctcatgcctgtaattccagcattttggaaggctgagatgggaggattgcctgaacccaggagttcaagaccagcctgggcagcatagtgagacctcctgtctacagaaaataaagttagctaggtgtgatgggatgcgcctgtagtcgcagctactcaggaggctgaggtgggaggattgcttgagcctgggagg

SEQ ID NO: 57491 - DNA, 1595 bp, Homo sapiens
aaggacttctcttaagaatgctctcaaaaacattctccatggctggtttttcacagtcttggccccaggtttcccgtgtatttctgctttgccaacccttaccttctctgcccactttgacttagacgattctccaccccactcccactccaaacaggggttgcaattcctatccagaggaccttaattgattggggagaaatttacttggcaacaaggatacgggccggatagatatcagcttgagagtctagccaactgtgtaaatctctgatacagttaacaagacaaagaggcgttttaaatttaattgaattttcaatgcttctgtaatatcaaaattttagtcattatataagtctgttatcaagtgtcatgaaatatttgctctttttctttagcaaataatacttcagacagaaagcttctaattgttattgacacaaatattctgatgaatcatctcaaatttgttagaattttgaagacaacagaagtaccaggtatttacagaacatatttaaagattctgattttcttccttgagttgatattttatattaacaatgatgggctttttttgccatgaacatgtctccatttagatatgctatatattaagcatattcagtgttataagtttataaaagcctttacaggttaaactagcaatctgaactcactctttttttgatctccaagagtaattatttttttaacattcttttgacacgttattttctttttaatttccattttataatatattgtctctcaatttattgtgaatttcctaaaggtagggactgtgtgctttaaaacttttacctcttggacagcaattccatttagtagctcaataaatgtttgttaaattctaagaaatctttttattttttaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattgtaagtattgttctctcagagtgcctcctgattaatacttgtttgggtgcagactcattattggagggaaatggtgcaaaacttttaaaacatttaaacccattggaatgtgaaatggaaggggcattgtgatggtttgtggcttagtttaggagtctttgacttttatttttctgcttctcctagacgtttttacattatgtctatatttcacagatagtgactgtatagttgtgtatgcataattatctatatcccagaaccttggactccttttttaaaaataccattgctgagtgatgaagtctgtaagtgatctaggtttctagtctgttaatatcaccatatgcagttaatgtactgtggagacgatgttgctttcctgtggtttgtcagaatcggtaataatgaatgaggtgtttttacaataaagtagtgtatagattttcccctcatttaatttttttcaatattagtttctattaaggcatttaaaaaattgctt

SEQ ID NO: 57492 - DNA, 1074 bp, Homo sapiens
taatttttgtatttttagtagagatggggttttaccatgttagccaggccggtctcgaactcctgacctcaagtgatctgcacacctcggcctcccaaagtgctgggattacaggcgtgagccactgtgcccagctgagatatattttttaatagagtttttgagagtagttttagtttcacgggaaaattgcacaaaagacatcaagatttcccacatacttcctgcccccacacaagcatagcttccccattatcagtatccttcactggagtggtacctttgttatagttgatgaacctccatttgacatcattatcactctgagtacatagtttacattaggttcactcttggtgttgtacactctgtggatttggacaaatgtataatgacgtgtgtccaccatcatagtatcataccttaactaccttaaatctcttagatatttttgttttgtaaatacagcctagattatttctgtgtcacccacatttctagtgtacttactgactgttgcctttactaaatttgcagatggattgagtgatgagaacaatgatgatcgagtactaaaatgctgtctccagcaccaggaattattcccttgttcttttgttattctgtgcacgtgagtttcatagtcatttgactttttatttttaaaaaataaaccaaataatttaaaaaaatcatatggtatccagcataccaaggatcaaaaacatacataattttccaaatctgccagtaagcatacccacttgtatctgacagtcttataatgtgtgagcactagaggaatgagatctcaactagatgaagtttcatttcagtttaatttttatacgattcagaaaacttgaaaaagcaggggaaaaggcaacttaatatccctccaaaattgtttaaaaatcagaatctgacaggatgagacaagaaatttatttacttacatattggtgaggtggagataaggtagtttatgttggagttgtgtgctgggtgcctattacagagttagactgcctggcttggagtcctgatctatcatttatcagcattgtgaccctg

SEQ ID NO: 57493 - DNA, 1068 bp, Homo sapiens
catattggcttctttcagcaaacagcaagtttgtgctatttgtcttatgcttaatctgagtaaatttgtacttgtctgcctactgtgaattatttctcatacatagctctctgtttatttctctttggataatcacattcctgtattcaaatccagctcccacttactgggtgtaactttggacaagttacttaactttacacctcaattccccatctgtgaaatgggggtaaagttaatactactcctacctcagaagtttgttgtgaggattaaatagatttatatatatatatataaagcactttagaatggtgcctagtacccaaagctcatatttttttaaaaaagttgttattctttcttaaggtataggctgagaatcacctgcctctgactagatctcatgtgttttgatttgccatgtggtttaccttataaaaaatattttttcctcctaatcccaacctcccaaccttagggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcaggtagtatttttactataaataattagagatatatcttattttatacactaagattatttataacattagaatcgatagtaaatttttattttgtacatttaaaataacatcgtttggaatacttgctggcatgtaagtcattgaataaatggaagttatgatggtaatccaaaagaaaacataattaacattattaccttctatatgtacttttacaaattaatttgatgtttttgtctgcacgcttacatacatttttacattataatcactgtgtacatgctaatttgtaccttgcagagtgtacctgtatttttcaccttcattttcttcaagtgaaacagagtattccttttaaattaatagcagttataggagatatttagttgacatagagataattttttagtttcttttttaagttggctttctatttataac

SEQ ID NO: 57494 - DNA, 1154 bp, Homo sapiens
cttattgttttttaaactcatagtgccattgaacagccatgctgatatttcagaatacaatagagtctctgaaactgtgaacattaaaacaaaaagtaaacaacagtatagcatggttattttgaaaactgttaggtagcattctgctttaataatggaaataattttttctgttctgagttttatgatattacttaattttattgtttataacttttgaaatttttgaaattattgtcaccagctttcccaactagtttgagaagttaatgtaattagttttagttccttgagataaaattgttatacctttaaattattgtttgtagattttctcacttttaatttacaggaaaaaaattctgcaggcttcttttgcttctcactgttgcccaaactttttttctctcctgaagttgtgttgtacatatagagataactcatagttttcaataaacatagtattgagtttcatgcaatggagttgaagataaatcactatgtagatagctgaggtgatgacgagaggtaccatatataactgacatgcttaccagtgtagtctcactcttctgatctctccacagtactcttatgtgaaatcacctcagcattgaaatctgtggtttgacttgtttctttggtgattttctcttttttctggggagtgtaatattctttaactttacttttactttgaagttgaccgtgctgacagaactcctgaaatctgaattcagaataccagaatcaactcaaaggactttatctataactaaatctatttaattattgctttttgtaccagagggataacttaggagtggcatataggtataaatgtatactctttttaaatttcaaaattaatattagtgttccaaagacatttttatgatgtatactcattcttccatatttttctgtcttaattttctgttaccagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtaagatgcctttggaatgccagttagagtagctaattatacatgttctgaaaatgtgt

SEQ ID NO: 57495 - DNA, 1034 bp, Homo sapiens
atttggtcatgtctcagtaacttgagcaacaaatagattacctccaaagatatggtatctcctagtaactgtaaaaactacctaatcttaatttattaagtgtagaaaatcaggaagagaggaatattcattatttgattgctttgagaaactaaaatggagataaactaactttatcattttccagatttttttttgggagacagggtctcgctttgtagcccagacctgagtgcagagttgtgatcatagctcatagctctctgtgaccttgacctcgtgtcaaatgatcctccagcctcagcctcctgaatagctggaaccacaggcatgtgccacaatgctgagctaatttttaaatttttttgtacagactaggtctcactttgttgcccaggttggtcttgaactcctggcctcaagcaatcctcccgccacagcctcctaaagtgctaggattacacgcatgaaccgtcatgccctgccttttccagattttcatgtaagaggggagaaataggaaaaggatacgtacactttcgttttatgggccttctaaccactaaaaaaaataggacttgctttttgctaagatgatagagtaattaaaatcaatcttgttaataagcttcagacttacatgcctcaggatcctgagttgtggtatttttaacctctagttaattaaactctctggaccttaattctctcttttgtaaaatgagtgtaataataatgctggccttagaattgtcacgtgaattaacaagttaatatttgtggagaccttaatgtctagcatgtagtaagtgctatgtagtatttgataaagaaatccacttgcgtagtatatacactactatttaagagctaaagaaaagaggcattaggtaaatgctgggctgtattttaaatatatttggtgataaaaaattatctcaggataaaatgtcttttcatttatgtctattcattaaattcagaatttaaggtaaacagacaaaaatgggaagaatcatctttttaacttttct

SEQ ID NO: 57496 - DNA, 1029 bp, Homo sapiens
gtatggttatatatttggcagcaaaatacctaattttgcaaagttagaaaagggatgaggatcttgcaaattcctatattttctgaacactttctttttaggtaggagaagaacttcaattagcttatttgctattcatttagaaattgcttctctcctcatcttttcttttatatgtatacaggattaatttgagcacttttgttaatagttttctcatctaaccactagatagccaaggacaatgttgataatttttttttcagatagacaaaagtgttttaagatttgtttttggtcagtactacatagtcttaatttatacttttgtaaacttatgtctagattgatcaagtaactcttaagaccacagaaaccttttgcttagtatataaagatgataaagtttcatttggaacaaaattaattggagagttgaattgcaaatttctaaaaatagggaaagttctactttctatattgatcaaaaacattgtctacatgtatttttgcttaaactgtcatctttgcagagttaactaaacaggtcatgtaatccaactctgaggcacactgtaaatgcgtgcagcttcaacttgaaagctaatattcaaagcaacaatacaagtgttgtagatatgtttctgtttctgtgaaatagatgatgagctagctgcctgatttagaagctaagaaggagggtgaaggtgagaaactttaacttgcttaggttttatgtttgtatttcacctttataaaataaggtagaaattatgttttaaaaaacaaaaaaaggtaatattttaaatccaaaaatatactagctcatgcccaaatatgtttggtttaacatgtaaaactttgcatatgtgagtttcatgaactgaagtagctttatttgaaatgtttgagataatgagtgttttcttggtttattattttgactcatatttggggtgggaaagaggcagagggaatttctattccttataaataggtgcattttgaggacatgcttttatattaaaa

SEQ ID NO: 57497 - DNA, 1249 bp, Homo sapiens
gaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaagagaacttgttcaggatattcactagttggtgtagaacctgttaagctttgggtttgccagattagggaaccacaccaccagccgcacagatggggctcaaagtgctgtcagagattatgagcttctgggcaaatggggaagctttaagagggcatct

SEQ ID NO: 57498 - DNA, 1089 bp, Homo sapiens
aaattcaatctgtcaatgtagttttagtccagaaccaaaccagtgatagttaggaattacagagttaccaaccaaactgatttgctttcctggtggttctttgtgtaacagatgagagaaataaagtggcagagtaccagtgaacatttggagaaaatacctaattattttcttcctaacccaagttagccactgaatagtcatctcagaatagtcacctcatcccagttggcccattaggttcctgtgtgcttcatcttctgtgagaaaaaaaaaccttatatcattccttatttcagatgtaagatgccaggtgagttattttccacaaatttcttaagctcattactggaaaaaaaaatttctcaaaacttttagtaatgaatgagtgtacaagcagcaattggatattaatcccatggtgcaaggatttcctgcaaagtacctttaatgtgtttaaatcagcagcaagcattaggacatgctattttggccccataagttaggtgtgtagcactacacattagacaccaagtcatcccaaccaatatttatccatatgaacagataaactgaacaaaaacatagttctgataaaacctgcattcacaacctaatgtagtttaaagtaaattttttcacaattgagggctgctatttaggactgttttgttaataataaaaacaggaattatatagaagataaaacaccattttttactgctatataatgtcttgctatataaaacataccctcaacaagtcaaaatatttaaaaccagtgtttcaaataccaaaaatcacagctatgttactgttcagtaactccactcaaataaatgttagtactgcattcttgaaggaaaaaaactgcagccaaggcaagaactctgaagtttgcactcagagtttaaaagacagacccctactctgcaaactgaagactgccactctgcttcaataactccagcctgccacattttacttcaattggtaaagcactctgctgagaatataaaaagttataaaaaggcaatcataaaagattaaatattggtaggcatgtaagcttccttttaataaaaacaa

SEQ ID NO: 57499 - DNA, 2175 bp, Homo sapiens
cagtgcacagaactattctggtttgctacttagtagctgcatctgtaggataattgtccagcttcttcctgcttttcttcttctctgaaataataatagtaactaccacagagttggtgaaaattgtacttatttagatgctgctactgcttcctctccctcccccttttaagttgcctaagttccacgtgggaatggtttttttattgatttgattcccagctcttagagagtatttgtcatattaggcatttaataaattctttttgacaaaatgaacaggcatttctatttttaaaaccactgatttttaagcaaaagacagatttaggggagttttaccttattacactttaatctctggatttaccccatctcatttctcttttaggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggac

SEQ ID NO: 57500 - DNA, 1372 bp, Homo sapiens
ttacaggactggaaaccgtggtccagtttaatattttaaacataaatctttatggttttattttttaccaggtggctataacagagaggaatgtcttcgaacagtcgaatgctataatccacatacagatcactggtcctttcttgctcccatgagaacaccaagagcccgatttcaaatggctgtactcatggtaagcgcattatgttgcaggagcaacccctatttagctttttcctcgtaacttcaggatgttagaaattctcatctctcacttttggcatagggccagctctatgtggtaggtggatcaaatggccactcagatgacctgagttgtggagagatgtatgattcaaacatagatgactggattcctgttccagaattgagaactaaccgttgtaatgcaggtaataatagttttctcctgagatatccagtatttaaatatgataattaaattatcaatatgtaactttattttatacttacataggagtgtgtgctctgaatggaaagttatacatcgttggtggctctgatccatatggtcaaaaaggactgaaaaattgtgatgtatttgatcctgtaacaaagttgtggacaagctgtgcccctcttaacattcgtaagttgattttttttcctttttttttttaaagaccttcaaatcaacagtatgtgtagtatacacttagagtctgggagatgtagcaataatcttgacttgacttttcttgtagggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggtgagtgttgggatttggagaggtgaagagtagatagtggcaagactttgttctaaaactctgagagaaaaggccaatgactatagttgtacagttaagaattcagaagcagtcatctcttttgatgcaatggagattagggtgatttgtcctttagaaatatattttctaatcaaagacttataatacttgatatataacttaattcaccagtcttttgatgggtgcactgagtgaatttccaagtcattttcttctataaaacatatccttaatgcatcatcttgaattttgagtttccccttctttacagccagaatttaaagaatctgatctgcaaaacaaaggcaaatccctagtcttttccaactgtctactccatacctaattggaaatacaacctttagactattttaacaagtttccaaagtattaaactttttaaatgtaga

SEQ ID NO: 57501 - DNA, 1846 bp, Homo sapiens
tttttctcaattacttgttatatggctttttgcttccactagcaacagaaatttccattagaaattttacctatccatgtgttctggccatctggaccagcacaagtgggatgagcaaactaggccaggtgctgaagttgctacctgttcatttggcagttcctctcagagtagtctttactcttccaattccatatgatcatatcctttggaagtggcaaaggctaaagtaattggaaggaagccatcaaggaaaactcatacatgagaacacatgtgtaaagtagttctcttacaatcatttggaaattggcagctttgttcatttctccctctttagtattcctgtatattctacttttgtgaatatttggttgtttttagtaatgtttcatttctgattactattttcttgtgttttgatgtaattttgtctagaaaaccactctataatacctataaggtaatcctaaagaaatattctttaagtgtttcttgtaattgccacttttttcctgtcaagtactttcagagaaactggatgaatctatatctgcttacgttttgctggcattgtatgaaggatacctgtacatatgatttagttaggtttgacaatttcatgaaaatagtgggttaaatgtattctctgttaattcacactattttaaatttatagcattcttttaaaagattctatacttaatataaaaataattatagattggttttttcttctgctgaggtcttgatttgcaacatgtttttcaaattgttaaaactgagctttttcttacctaggctaattgtgtaggcgtagttgtctcatcattgagtggagatggaagtatgccagtaatttgtgtcatttggaaagtgttggcttgagttaaagttagtgtcctataaatgtcatatataggtgaaggatactcagtgttgtggaatagctcaggaacaaaggtacatcagatgtggtctttggctaggtttctgtagctaccttttgattttgcagaaaaagccaccacgtgagaatggccataagcagataagtagcagttcaactggatgtctctcttctccaaatgctacagtacaaagccctaagcatgagtggaaaatcgttgcttcagaaaagacttcaagtaagtatatgacacttgccagattgttttcagcttacctatttttaagaaggagtgttgccaatttaatacctcttaaattgactactcgaggaaaaaactcagaagcaattaaatttggaaaacgagagcagattgttccagtctgggatgtggagactggagtccaattcaggatcatatacacaaaccaaaagtaataattacatcttaaacatggaactcttgtgcttacagataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtaagaacagaagcattcaactggctaagcatgtagatgggcatttttgtgacatgcaaactttcaaagagagggtttaatatgccatctttcacggcaatccaataagatagggaaataacaatactattgaatatggctaaccttcagttcaatgtctgtatctaatttttaaaaaaattatgtcatggctaaatttttctaatattcaagccaagactaagcagtttatttgt

SEQ ID NO: 57502 - DNA, 3619 bp, Homo sapiens
cccagcaatggcaaattatatacaaaggtaatcaactgggtgcagcgtagcatctgggagaatggagacagtctggaagagctgatggaagaggttagttttaaagtaaatgggattcaaccatttttaaaaattattttgctataacatgaaggattccctttcacttttattttataaccatgaccctaaagaatttaaattttgctataggtacccctaagctgagaaacagggggggtgtccaggtgagctgaatgaactgttcagtttggtcttctgcttttctttttttatttctttgcttattatgtgctgttaactttctttaaagtagcatgtaatttgctttagaaatgggaagtggtactgaaattttctgtagattcttaatttttcttcacaggtttttgctttaaatttgacaagtaggtaaaagcttctaatggttgttcctccccattgatttatctccccataggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggtgtttactcctttacaggattcttgtctttaaagctgtgtgtttttcaatggtgttgttcatacatatagtcactcacttaacttgggctacttttaaaaaaaatacacaagataaaattgatggagaaatggtgggaattgaaaacacgcaggtggagcagtggagtaaccttgagtttctctctccacttaaacctttcggagttcctttatgagggcttaccaaatctgttaggcctgcagaaacactgtcatcattatggtctaaaagggctaacagattatctttaaattctatgattcccacttgaaagtcagatgcatttgccatgtatttgcatctgtctcaatggagatgactctacagcttgcttgaatttttgcatttgttttttctttgtttttcttgacattgcttacaggaaggaaatatgtttatgcaaaccagaccacttatctgcaaaggtgtaaactatattcagtattttattgtaaatatgtatattctttaagagtatatattgtactagtgctttttttcttactgttatatgatagaagctatgaaaaaaatgaagatttctttcaagccaatcaagccaacgactcttcagccagtattggaagattttgtatttgattttggttttttgtttttgttttttaatttttaccaccatgacatgtatttttctttacctccggatcctgccagagtaatatgtcaagaagctcaagaagcacactggaggttaccttgaggcgtttgtgtaatctgcatactagtggagtagccatggtgaccgtagccacatgggtgttctgttgctgttttgcaggttcaaaccttgtactactcagctgatcacaagctgcttgatgggaacctactagatggacaggctgaggtgtttggcagtgatgatgaccacattcagtttgtgcaggtacacattgcacagtctgaggtaacctcaggttaaaatttgactagagaatttgatagcatacttaaattttcctttaataaaggaaagtggaccaatttcattggtataactggacagaaacatttttgggagaaaacaagcatatcttagagttagtatttttgccacatgaaaagatattaacaaattaggaaaccctattgaaatttttttctcataaagcaggaattacaaacagtaaaggccaataagatggaacaatatagaaattatttgggaagattatgaaaagcagttgtttgtgtcaggcatgactgatagttttttttaaaaaggggcagggggacttaaattgttgatggctatgaaagaaatttttggatgttaccttaactactgagctgtcttactggaaattagaaatggtatagttaagatggactatacaatgtaataagtctaaaagtggtggatcatatgttaaaacctgatctagatgtttctttaaccaagatgaattaaaatatagtagagttccactgtgctgattgagttactttgccttttataaaatccaatttcatttttcccctatgagtaaacacataattattcagacacattatcaacaattactagagaacaaacttctcaagtataaattttttaagtttatggacaaatacagaaaagtacacaagtcataattaccacatagtgaacctaccagtgtaaacactacccaagtcaagaagaggtttctagcatcccggcagcctttctcttgcctcttcccaaccgtttccgtatagtgctcccaaaggaaaccattatcctaccttctgacacattaaattagtttggctatgcttgaaaaaatttatataaatggtcatatagtatatatttttatttggcctttagctcaaattatgtttttgagggacaagctataaagcagtcgactcagcccagactaaggaatgcttttctttaaaaatcagagggtaagtggtagacttagtagtagcctatatggttacaaattatcaggtgttagctctctcaggtgtcctgtggcaacagtgagtgaatatttctaaaagttttggaatttgaattagttgagaacctatgtttgtgcattttgaatatattgaggatattttcccccttaactctaaacattttgagttaacattttaaaagtacattttcaacatgcagaggttgagtgcccaataagtggcaggccataatgttcggtatggcaacacaaaaatgtgtaagagacagtttctgcttgtaggaccttctaagagtgggcaaaacaatacaggcttataagaggtagctacgaaaggcctaaaggagaggacacagtgagacaggagagaagccagggatatttcacacaagaggtaacttttgagcagtgttaggatttagaggagtctgcatagcagataaagggagaggtgttagcaaagagtatctgtgaggatgatactcttggaattgcaggtcataagactgggaaagtaggtaaatgctccctgaatggggcttatactttatcctataggcagtgggaagccttaggtaagaatacagtgatacgaaagttttgcattcactttagtaatggtgaaaaactggggaacagtctattaggtggcagtctttgggctggaatatcccaactgatttctggttttattttctaaaattgttgccttggacccttcctatttttataaccagacacagaaaatcaataaaagtttgagcccagtttatagactattgccagcagtagttcaggttttaaaaaaatgatgagggattaatctaggggcatgaaggagaaaggatagattttttatttatgtctatatataaatagacatttatatttacaaaggttgacttagcaggccttagtgattgcttagcaagattagggaaaagaaagaatttgagaataagtgggattctgacatgtgtgactcattagaatgtgatgccatgaatagagatcatga

SEQ ID NO: 57503 - DNA, 2513 bp, Homo sapiens
gcccaaatccaaggaaacctatatgtactggctatttcaccctttcaggcttttagattacttattatatgggtttgggcaggatggagtttcgtttccttcccttcccttcccttcagaatgaatttgcttaatgggcatgggaacctggccaaaattgtcgagatagctgctactgtttgaatcctttaaaagtcttatgaccaaagtattagggaacaaagacttggacattcaacacaggtgttgtttcagctaagtttttgtgtgatgaaatttttatgtgttgtttataggatggaatttgagaataaagagactgtattactctttagcattatatttttaaaaccatcagttgcaagtaaaataactcagctttcttttcatcatctagccaaatttataaggaaaaatgattcccaatggatatttgatgtttgaggatgaaaattttattgagtcttctgttgccaaattaaatgccctgaggaaaagtggccagttctgtgatgttcgacttcaggtatttaaaacttaattcaaaatttatagaattttttattactaaaagccataagttcttagatttgcttatttctttttcataggcatttaatgaaatgattttttaaaagaatactgagaaatgtaagataaaggaatctgatatagtaattagctagagaagcacataatccacaatacttataattataattcttcataatttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagtaagtacatttgaagtaaaccatataattagggaatatcttcagaaaattccaagtcttgctacatatatttaaattaagtgtgttttaaggctttggtatcataagtaactttttttttaaataggttgaaagcagataaggaattggtaaaagatgtttattctgcagcaaaaaagctgaagatggatcgagtaaagcaggtagagtatcagaagtaaataaaatcatttatggagtcttattttgtgtgattgcaatgctgaatttgtcataaaacatcttgttagtttcaaggacttgaacatgtcccttttttccctcagagtagtcaatatgttattttaactgtttggctataataatgtagcaagatcacacttcttctcagataatttgggctgaagtctgaccctttcagcaatcttctctggtagggtggctatgtcagcctttgatagcatgaattaaaattaatatttttcttaagagttaatcacataacttatatcctcaattctgtgttctcctaaacttcctgtgctctctaaaagtattccttctagaatttaatgccagtaaaaagtacttttggaaaacaggcatttaatcccctaatgcatgggggtcagtaaacttaaggcctactggccagctgcctatttttataaagttttattcaaacacagccatgtgtgttcatttacatatggtctacactgctttccagctacagtgacggaattgagcagttgtgacaaacagaatggcctacaagcctaaaatgcttttactatctggccctttaagaaaaagtttgatttgctagcccttcttctaataccactcctttgttcaaaaatccttccttaatttacagtacatatccctgcatttagtttctagattttcccttatatagttgctgtctttccaaaactatttcctagttatcttttctccaaccaaattaaattgtttgcagcatcttctctacttctgtctgcattcaacatcaacatcatctctcctgtagagcccagttcagatactgcgtttcatgaagccttaccaaattattctacttgaaaatacttatgtgaacttacatagcatttcaatttgttgtacctctccttaaactaaaacttacatatctgtatggcataattagatgtttatcatttgtatacgtgttattaccactattaacatttgttgtattaagacagtgatttttgattctttgtatcttcacatagtctttaccacactgaacattaaatatttgttgaataaaagatatgtaagtgttggcactcatatatttcttttccaaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaaggtaaggagtaaagtctataaacagatatatactatctagttccaggcgtggaatcttggtctgtgtttcaagcaagtgagtaatgattatgaa

SEQ ID NO: 57504 - DNA, 1595 bp, Homo sapiens
acactggcgcgggtgaggcaggctgggaggaacaagagttttttgttcgaagggttttggggggcctgggttagggcgccgcgggcggggatgacccgccggaaggagggcgcgggactccccgttcttgctgtcaggaacggacgcctcgcctcgggtttgcctggggtttgggattctcttctggaagagctctcgagactcggctcgtgtgggcgggcagccagccccgggcctggagtagggtggcacggagtccccgatcgccgtgggccgcggggtcctttgttcccgctccacgttgcccgcttttcttgccaagcgcggggagaagggggcgggaggagggagggagcggctgccctgacgtgtcggtactgagtgactgcggggctggccaatccggggcgggggtgtgcgggtgctgggggcctcgcctcgcagcctgcggagtgggcgccggcctggctgcgcgaggaggaaggcctgggacgctctttcttttttatgaaagaaatcagtggcaagatttgctctttttccgtccctccacgcttttggttaagtgtctctgattataagctcttgatgataggaaggtatcaggctgagggttgaacctagggtaacttgaaccactacttgagaactacatttactttttcccccaataggtagtggacatatctattggtttgagacagctgacatttcaaggagaaatcagatgtccaaaagggcgcatttttgtgatggagcgtgcagtgatggagcgttagaacaccttggcatcaagctgttcgttgagtgtgtcgtggtcttctgtctactaatagatgacaactctggaagcctagtaccactcttaacagatgaataagtacagcatggactagactgccacaggccatgctttcttttaataattctagcaccagtgattgatttaggaaaaacaaaatactgatgattacttttaggctaaagcctgctgacacttctgtcttaaagatactgaaagagtagttgtatttgttaagtctggacgtgaggtaaacatggactttagaattgaattgagactagtatcatttaacgccagctggcaggctgcttatcaagcttataatttggtagccagaggtaaacggaacttgagccactgaccaaagagagccctggaatggttttcctctgtgttttcctaatagatgatatctctggttaactaatagatactaatttctatagccattgtcttaatttgtagttgattttctaactttccccccaagacaaaacatttcaggttttagtcttagttttaaattagtgtctttttggctacttgcttttggaaggtgggattttttcttgcttgaaggatttgttagatggtaattaaatgtagttttgcaaatacgtttttaaatataaatgttttcctgttaaggaagtatcttaattgatattaagatgaagtaacactaagtaagtcatttcatccactttttagcagtgcgattgtatagtcaaatcctgcaagtaggaattattaaaggttgggggtcttcccaccatgtcatgtgcatgtg

SEQ ID NO: 57505 - DNA, 1009 bp, Homo sapiens
gaaaacacacctgagaagtggtagttcctatcctaacctactggggccctttataccaggtgccaaacttcattatccaccccaccaccttgcccgggagggagatctgtgaaagcgaaacgtgatttaagctgggatctggcagcaacttcgtggactctgaagggcacgtgggaaaggagttttgattgaaggtgagggatttagtgaggtaaaattatatccaaattagagtttggtaaaggcttccaggttaatgtcctgttaacgcttatcctgatttgtggaggacacttaagctgtctaggcctaaccttgtgtttgatcactcaccttaatttgtagacattctaggagctctttgtcaatgcctcttaccatttttatcattaactatttatgcttatagaagcaggaaaaataaattgtgggagccttcatctgcaataggtttacaactttttttctaaaatcttgaggcaaggagacttattcccccgcccctttttttctcacagatttcttgtatgtctccctcgccccgcccgcaccccgtccccccgcccccggacaattaattgtaggaggaaacaagaactaagatgtctattcgagtgattttttatatctttcttaaggagaaaaagactgacatttgacactgtgctcttgttttgtcttgctgataataactgacagcaatgtttacttttcttacaaatgaaactatcagggtacgtacttttaagctctttaatacaatgggtttcatccttccagtgggagagtatgaattgcccactctgcgtagacacatgactgctggcctgttggacacatggtcacacttgctatactctaaatagtgtctttgtgacctgaaacagtcaacacttttcttaaagctacagtgtgcccacactcattgtatttttgctttgtatggaatttcaaatttacttattaccttctctatgaataatagcataacttatgcattccatttatg

SEQ ID NO: 57506 - DNA, 1052 bp, Homo sapiens
tcttgagcccaggaattcaagaccagcctgggcaacatagtgagtgagaccccctttctaaaaaataaaaaatccaagggttataattctccaaatacatgcctcagaatacttcggtcttgaattattcctgtcggctattacattatccaagcaaacttttactaataactttttgctagttttctaaagtaattactgttaaagtttttgagaacaattctagcctcctcatccaacaaccaggattccctaatagttgctctttctttcaacagtttcttaggaattaaaacttcttatgtcattcaagcatgtatcctgtaacactgtataaccttcaagcctgctccatctttggaaatgtcatattcagctgtgaactctgatgtatagcctaggcttcaatcaaaaaaccttattttttaatcaacttgattgctgagaatgagcaaggcatggaataagcagcctttatactaagctgagtttttaatgtaatcactaaattaaatgtataaacaaaagtgtggtaacatatagcacaatctatacaattcagaaagagatcttttgttgtgatcgcattcaaaactggatacctggtgaatgaaagttacccaatataattcagttggactcttcaggaagtagtgctgcaggaaataaaaacaaaaagaataataattcaattggactagctagccaactgttgcctgtgtaaactgatcactcaacatgaagtcaagagactacttcaatgaaaaaaaccagaaagaacagagctgttgggttgtaaacatgagttctcctttcttgtattcttattgtctaaagatgagcagagtaaagtacaaggagaaaatgatgttttgcaagagttgagtgaactggactttctttttttttttttttgagacagggtctcattccagtcacctaggctagagtgcagtggcacaatcacagttcactgcagccttgacttccctgtagctgggactacaggcgcgtgccaccatcccctgctaagttttgtattttttctagag

SEQ ID NO: 57507 - DNA, 1049 bp, Homo sapiens
aaaggtaagccacttggtacattgtaaatattcaacaaacatgaaggcctaatctaagagctgcaatcagatctgcgtgggcacatcccagactcaactggagtaagtggaggggtctaaagaagtggtcttcaaactggggtactcataactctggggatataaagaccttccaagggttcacaggcatggatagcttaaacagaagcaatgttcaaatccccagctcccacgtgtcctctcataacactgctctacagaagagaagtctgcagcggcctgtggttccctttcccacatcctctctcgcaaccaaaggccctgcaaccattttgtaaaagaaagggaaggcaaagccccactgggacctaagcttcctgtgtgcttgctccaggggtaaacacctctgggccaccaagcagagggaccagggaatggagatttcgggagaggtagggcaaggtgaagaaagccaaagcaaggctccatgcctttaccctgattttctctcccaccctccccaacattgtgtctcttacattcagaagtgaggttgcacagacatgcatgtaatcacatttattttcagtaaaaataaataaataaagtcaactttttcctgacagaaacagccagtgtaatttgatgcagataatttgctctatgaacaatttctgacctgagacaaatctgaaactctgtgattttaaggaaaaggtatttaaagcacgaagataatactgttaaataaaaatcacaagaggccattgttttggactaagtttctgcaccaggcctcaacagaccagataaaaaatcagaatgggatcactcatactaaagttcacttctaccaaactcaaactaagtatttatttgaccttctgagaaatcaggagaaagaggtaacagctgattttccaaacaagccagtttaaatcttcaatcagtacgaaaaacttctacttaaatccttacacatataaacagttaaaagttttaaaaagtggtaagttaaaatataattagatactatccttttttacgca

SEQ ID NO: 57508 - DNA, 1039 bp, Homo sapiens
ctgagtcaatggaggagcccgcagctgccgggtcacttggtttcaggtttgtgagagtcagctgagggacaagagctccgggaactttgaaggcaccctctcgagaaagcgttttctgtcttaaatattttcctgcacaggtctgaaattgtatcagtagaaattcatgtgggggtcttgatgccttctttagttttcagcaatctcatgatagaatgagaatgtacctggtcaccaggacgctgttgataggctgagaatgtggggtgtggtttctggaaaaggactgcagggaagccggcagtgaaggacagatgggccagatctttaggttctctcccttccagctttgcccaggaccagcctggatgagcttctcatggggcttacagaaagaagggtgttttggttcttccttgaaggtattaatacttacttctctgaatgtgaggctctgggctgggggcacaaggctacagtgattgcttcattgtttggtggtggagtctttgagatccttcttttgacctttcaggctctacaacattttgatcagaagtttttgctttttgtgtaagggatgtggtgcaattggggaaggtgctattggggtttttagtgtaagggatgtggtgcaattggggaaggtgctattggggtttttagtataagggatgtggtgcaattggggaaggtgctattggggtttttagtgtaagggatgtggtgcaattggggagggaagtgtggagaacaaacaaaggaaagcacactggccagccatacatagttcagtaaaacaacacacttctgtccctgccgctactaaagttcttaagctccccaaccttttttcttttaccttatctcttttttgggcctctagaaggaaaatatccgtctttttttcttactactgactccagtgtgtttataactttggtatttttgtttgtcattgttttggcttaaatgtgaatgtaaaggagagttcaacagcagtaaataaagtgctgagtagcctgtagaaatgcttttg

SEQ ID NO: 57509 - DNA, 1046 bp, Homo sapiens
tgaagccatcggaataaatgagatcatccaaggagagagtgcagactgagaaaaggaaggagacaggatagaacttagagaacacagtcatttaaaataagacagaaaaagggaagttcattatggactctggaaaagggagtccaggaagatagggagaaaaacaggaatgagtagtgtttggaaatctaaaacgttgttagttttaagcaggagaagttgtcaactctgtgcatttatagagttcctgaaaataaagggtaaacaatatggagctcaacaggacagttttactggagttgtggagcttccatagaaggctaaaatgatgagttaagaaaatggagctggtgagtacaggatgtttctttcatgaaagaagagcataggccccggagtctgatgtttggtttggaagtctggctccaccagttacttgctgtgtaatcttaagttctttgtgcttcagtttcagtatgcccaagaagacagggcctactcctagggctgctatagcaaactatcacaaaatgtgtgacttaaacaatagaaatttatcatctcacagttctagaggctggaagtgcaaaatcaagatgttggtagggtagtgaaggctgtgaggacaaatctgtttcatgcctgtctcccaacttctagtggtttgctggcaatctttgacgttccttggcttgtagatacatcaccctaatctctgcctttgtcgtcacatggtgttatctttgtgtgctgtgtcagattttccttttcctttttttttttttttttgtgagacagtctctctctgttgcccaggctagagtgcaatggtgtgatctcagctcaccgcaacttctgcctcccaggttctagcgattctgcctgccttagcctcctgagtagctgggattacaggtgcccaccaccatgcccagctaattttttgtatttttagtagagacagggttttgctgtgttggccaggcttgtctcaaactcctgacctcaggccatctgcccacctcagccgcccaaagtgttgggat

SEQ ID NO: 57510 - DNA, 1046 bp, Homo sapiens
ctacagaggggtttgcatttgctttttttgggattccaaaattagcttgtggactaatttttgggctttggattccggtgctgtacagctagtataacctctattatctgttatatgtttctggcttagggtttcaacttctcttaggagatttttttgacagatggcaagctttcttgacagtttttttgggttagtgggaggaatttttccttgttttactgatagggctcagctttataaaagagtactctattgtagctctctgaccaaaaaaaggctgataccataaaaatcgtgccgacatggacattaacactttaatagtcaaatcctatgtcaggatttttgtgctgctgtggtgacagttgaagtttatttctgttttgagcttcttttttattttgggcgttggaatatttccccttattcttacaactccatcctaactatttctttaaaaggaaattctatattttgcccagtgtttctgttttggaggaagagtgtcttgcatgtgaacttagtctgtcatgttactgaaaggtcacttctcatatcttcacacatttccttgcctctatattcttttcccatgtccaaatttctccctttcaaaaaaaggtctttctcatagtaaaatatttgcttacacagaaaactgtaggcccagatgatttctcagaagatctttaccaagtattcaaggaaaaataattataattgtaccaaactactttcctggcaatagaaaaaaggttatacttcccattaggctagcataaccctggtaccaaatgtcagatatgaatactacaagaaagaaaaattataggtcaacttcctttataaacctagaggcaaaaattcccaaatcaatgttagcaaaccaatctagcaatatataaaaaggagcagatgtaatgaccaggttgtttttatcccaataataaaaagattagtttaacactagaaaacaaataattttactagtagataaagaaaaaatcatatgatcatctaaatagttacataaatagtatttg

SEQ ID NO: 57511 - DNA, 1042 bp, Homo sapiens
ctaattattctttaagaatgtggtaatgaggtgaaacacactgtttgccagcaggcataatagatcatatttcatatcactcatttaaatcagggcattaattttcattacaagataaagtcagtgatagaaacagaggcaaactatggggaatgaaaagtttagcaagtataggcaataagccacacaatagttggctcttgaaatgctgatctcatttacttgcagccagacttgttgaaagatggctatcagaagaaaaacaaaaatcccctctgtggtgcaatattaatgttaatagcccttaacaaggaaaaaacatgaagttcaagttaactgccataaaggataattcctttgaatgcaacatgaagccagagagggaaatatagtttctactttttgcattattattattcctcaccatacgtttactaaacacctatcatgtcaaaatattgagaaagaagcccacttcgttcagaaaacttacaattggtataaccaagggccaggatgactctcataggtgacagtaagttggcttcttacatttaatgaatattttcatgttttgatttgcattttatctttttcctcctctgtgtatttcagtcatagattagatgatgggctggaaaaaagtaagaatttttagaggagagggatgatttgtttgacaggaaagcatgtaaaaacaggtgggagaagttggcttaatccattgtcatgtcctctgagaagagaaaaagcagaaacaaaaggtaggtaaaccccaagactgaatgatcaagagagtgcatacccttatgctgcatctgccacgtgaatgaatgagtaaacaaatacacttaaggaatgtgttctacaagttgatacaaaacttagtatatctaaggcataaggaatttagggcaagttaatcacacactctcaaagtcaagatggccagtatggtttggctgggtgtggcggctcacgcctgtgatcctagcactttgggaggccaaggtgggaggatcacttgaacacaggagttcaa

SEQ ID NO: 57512 - DNA, 1038 bp, Homo sapiens
gtgtgtgtgtgtgtgtgtgtgtgtgtgtgtgtgttcagtctttagtcaatgaaaatagccatattgtaatgtggagtaaatacaaatctcttttttagtaattacattcttgtgactttcttgtaataaaaaaaaattcctaaggatgaagcttacttcattaggtttctgctggggatgaattgttttgaaagcttggtaaaataaatagggtcattgtgagagtggaaaaaatatatatgcttttagcatcacagatgcttcatttattctgggataacagaaagcatgattacataaaaatgcataatatgaatggcatgtatgtttccctataagtggttgcctgtttcagatgtttgtgtttctatgatctccttcctgttggaatattcactttttataagactttacagattttctttcagtaattgctgctttcatttgatgaattacattttgttatattatttattgttaagaatagaattgcctttgaaagtatggtttgctcatagccaattaaaccataaatacaacagacagtgcagttatgcagcagatcttactcttatgacttactgttcaagtgtaaaagtgaattcgctagatccatacaggacaatatttattattatagtcttattttgcataattttcaatacccaggaggtgctacaagttccagtgccttttctgatccttattttctgcttttctccactggctagttatgtgataaggacatggagagatgagaatgaagagtgtagatggaaatttcgtgctgtctcctctccatcttcccctgttcgaaggcatcaatgcagaacattttatcttcttatacctctataaggtatcattcaatacattcaatagctcagtctccagaatcttacagtcttgctacaaagcaatctccaatttcaaatgtttgacacaatgttaaagtaggattattgggatctcagtatgcacaactgcggtgcactatgcttgctttctttttcttttttttttttctgagatggagtc

SEQ ID NO: 57513 - DNA, 1056 bp, Homo sapiens
tcaaatgattagatccatccttcttccacttatttcatgagatatccaacaactgcaggttgttctaacggttcagtactctaggtttgtagtttggtcatttgctcctttattcaacaaacactgagcttctgcaacatgctagatactcacttggccctgagatggtggaaaagcaaaaccagatgaagtcccttctcactttggctaacagtcttgtggagagacaaaaattgattaaatagtcacattaaacagttgaaaatgtaaatgcgacttagagagtatgaactagttcaatgattcaggcaagaatttcctaaggggagtgaagactgaactaaatggcaaggaggaataacagttcataagaggaaaggtagagggaagaacaatctagggaacggacagagaggaaaggtcctatggaataaaagtgtgcaaggcaagtaagagaaactaaaaggtgtggagggagttaaggatggctggaggcgtaggtagaaactagaccatgcaaggcattgttgtccatgcttaggagtttcagttgcatcctatgagcgatagaaagtcattggaaggatttaattggtagattatataatcatgtttatgtcccagaaaacatacttcagttccctgtagggaatggattagagaggaattcatagtgaatgatggaagaaatgttagggctctttacataccctaggttctctgagagataaaaaggactaaggttgtggttgaggagatgagaaaaagtagagaagttcaagagctatttaatggataaaatggataagatttagtgatggcttgggtaggggaggagtgaggctaggcatggggtgaatcatgtcaacacctaagtttttggattgtgcaattggatgaacataggtacttttcatagacatgggaaccagtagaaaataatcagattgaagggtagaggtgaaatgataaatttttgttttgacacatcaaactacagatgatttagggacatttcggtacaaatgtagactagacatcttgatataagagatt

SEQ ID NO: 57514 - DNA, 1049 bp, Homo sapiens
tcccaccagcacaagccccaggctttgtgctcttggcaggtccatttgaagcagacatcccctctttccatgggccagccaccacaactcttgacagacaggcgacccccagggatctgtaagcctcagcgctgaggtgtgcttggtagctgggttgcaagtgcatgtaaagcttgccccactgagacttggcctctggcctctactagtgtgttgtggtgctgccagcctggagaggggtttgccacctccatgccccactcaaagatggtgctgggcattataccccccagtctcaacctttcttgttcccatatacagattcctattggggaacctgtaggagcagagatggggctactgagttgggcctgggcatctaggagtgggagagcaggtagcagagaatcttgtggtggtgggaggtgggaacatgcatgagccaaggtcaatcatcccattgaacttcacttacaaaacacaaatccaaaagaaaaaaaatatttccctacagtgactgcaaagcattagaccccaaggtgaaaagctgttgagagcaggacattgtcataaatccatgcatctggctcttaaatttgtaagacacacccagatatttctgacttttgtagctgagattcctttctttaagtgtatttgtttgcttgtacttctgacaatttgaactctgctaagtatgtatactgcctgtttgttgaatgaattgaagcaagtatttagggaatacacatattatatacacacagacatctatcatacttttagcagtgtctctgattcccctattttgtgaataaaatgtttgcttcataaatatggttttgttttctctgaaaacacagtcaaagtgctgcatacatttgtttggttgttgtggaaacaatcaaagctgaagttaggtctattctcccaacatgtggaaatttcaacaatgtttaatgattcctttctaaggacttgcaagcagacttttctcttcttcatcaacattttacctcttccttcataatttttattttctttatccc

SEQ ID NO: 57515 - DNA, 1047 bp, Homo sapiens
acaaaaattttataaagataaattaatgaaatataccttgacactttaaaataactagcaggaatgatttcactgttcataaatgtctaaagtgtgcttttatttttttcggctgttgtgtattataaaactttgatcatgtagaaggtgtggaagttttacatgagtattgggtgctcattgagttgaaattgagagttcctcttttcactaatcccctctagagtccccactgagcccaaattttctaagccattccaatttctaagctcctccagagaatagtttatcctctatataaactgagtaaaattttagttccagcagaaagtctgttttttttttaaatcctgtaaattatttcttattttgcctacctttagcatgagcatttatggctatacaacacatcaccagccacacttgtttatgagcacttactattgttaaaactcactgtagaattttctaaattaaataggtacacaacacccaaagagtaatataaatgggtattatcaggggaagaccctctcaaaagtctcaagtggtgatatttcttggtggattagctaaatctgccaaccatgacactggatttgtcagcctctgtctgagtggatccatcctcaggaatagacttgaactaaccaaacttagaggagtgctgtataaaatctgaatgccagctcattcatctaccatgagaaatcgaattgcttgcaagtctagaacacttgtgttggcacaaataatacatttcctctctataggcacacgtacaaagagcaaatcatcatctgaaatttgccagcatcaggacaaggggagacttgctcccaggctcttttctgagccattatatattgatgtttaagtttattttcacgggatgatgtatatcttcctttgtctaagttcttgtggacagggtctgcaaggggattcatggctttaaattccattagatcagtgacctgaatctttcaaatgaacgacagattcaaatctctgagttcctccatcatattcccacctgggtgctca

SEQ ID NO: 57516 - DNA, 1002 bp, Homo sapiens
ttatttctgagaagcaatatgatttttccattcagcaactaatatagagtatttgaatgtaaccacagaaactcttgagccaaattttgtcctctgctttttaaaggaaactccctgcaaagacattaaataattgtcagcacccaatgggtttaggtggtacaaatgtttatattagtctaggattatcagtgtgatcatttaatttaacatatcccctggggtatgtttctattaagtacatttggataaactgtctttagataatctcccaagtacagaagggtgtgtacccaaccgcatgattatactgggattctgagactagtagaaatattttggttttggatagttatgttggtagccagagcctactaatgccttttctactgggtaaggatattttaaaaatcatactcaagtggcataagcttgtttaggaatcataattaaattaaccttgagtctaaaaggaccacacatgaagattattatgctggcctcctattagtctttcctggtgactcttatgaataagcctgtagtctatacaaggtgtgttaagtaaatagattaggtgtagcattaatgttttgggtcagtggcatgtttgataatagatttttcctggaaaattttccagttttttggccttccaatatcggactgtcaaccaaatagaatgcttcctttataaaaaagacatgtgtacacttaggtacacatgcacatttttatgtatatgtgtgtgcatatgcgtgtgtgcatatgtgtgtgtgtgtgtgtgtatttaagtagaatttatgttttggatacatttcctaatcacacatttctccaaatgcataatgcccaacaaaataatggtatttaaatctagcttctatgattgtgtctttgacacaatgcctagctcacagtaggttcttaataaatattttattgaaaccatctattctttaatttgtaaagaattcaaaacttaagagcaaatactttgaa

SEQ ID NO: 57517 - DNA, 1048 bp, Homo sapiens
ctgtgctgagttcagatttcattctggaaaaggtggagagccatgaatgaaatttgatgggaaattggttaaaggatcaaatttgaattttaaacaaattattctggcaacaatatgcaagatagattaacagctggggaggttggagacactggaacatcagttaagaagctattataatcccacagtggctgtggaaatggaaaacaggggatctgagaaacatatagtggcataattaataggattcaaagtaggttccaaaacctagatgactggaaaaatagtgggtgccattaaacaagactgggaacatgcaatcagaagtagactttagaaatacaagggaaaatatatgagcttaattttgtgcgagtgaatttgatgttaaatttaatgtactacctgtccagcagattgctggaaggacacatgtagagctcaggagagacagtgaggctatcctgtaaatttaggatgcattagagtttttcactgatgccatgagtttggataaaaactatcagacagctatgttccttgggtgtggaacaggaagaggaagcagattctgaaaagtaatctcctaagaaagtcagagaattagaactgagggaatgcttatctttaacacccagaaagtagagagtttcaaggagttggtagtcaaccacaccaaatgctatagatggtagaggagagtatgagcttactacctaggctggtgggtattgtgactggaagttactagtaacctccgaatagcatgtttcaaagaataacctctgaatcaccagtttcaaaatggcagaggccagttgcagtaggtttaagagggaaattgtgaaaaataggaagaaatttatctgcattctcataattcatattttataattttattgtttttctggttcccatgatcatttaataaaaagtcattgttttaaaactatgaatttttatataaatgtggccaggtttttttttcaaatagcttaaattttcatcacttacttcatagttcagtgctaaagtcttttattcagta

SEQ ID NO: 57518 - DNA, 1034 bp, Homo sapiens
attccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacagtaagttgttgattagccaggctttggcaaaatgttctcttaaatcttttcatccttctcatttacttttaaaaatatctttaatgttcattcaaaatggtatggttgtaactatcatatgacacacacatttaaattgtgctgacataactggagagcaattacttccttctggctgttattcggcattacagctgtccactctgcattagctcaccaatgacagacacatcaatgtggctgtaattttgttggggacagatagtggacatgtggagggggaagggggagcattttaacataggggatatttacaatatgtaaaaacattttattttaaagaatattttactcgtataagatcttagagtgcttaagatagttatatactcatttaatcttcacatgagctgttatataagacaaaactgtcgcctccattttgtgtatgtggaaatttaagctccaagaggttttgttggttgaacaaggtcgcgtggcttgtgtgtggtaggactggcactaggacattggattactgacactggcctacttttcttcccacacacatatgtattagaattgatctaatttttgttcctagaatcagtgacacgtgaattcagcttcaagtaacagaataactggttgtcagtggcttaaccaagtaaaagtttgtgttctcacataatgagaaagcagaggttagcattggtcactggagctggtcagcagcttaattgtatcagcataggagctctggcattctactggtccctccttcatggtctcaagatggtagctgttattgtggtatcaattccacatggaaggcaagagtaagggaaagggctggtatctttcccttttattaggagagcaaaaaattt

SEQ ID NO: 57519 - DNA, 1026 bp, Homo sapiens
tatttagttaaacatgaaggtcaatttagaatcattttacttatagatgaacactaacctacatttgaaaatgatttataatctatgcatatttttaaagtcaacataaccattattattataaaataagttagcttgcatagttatttttaaatgaatgattactgccgtgttttagacatgggatatgtaggaagacaaatgagtgaaaacctcctctttcaaagtttattcattctatacatgtaattattagctgactctcagaaatggatttttacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttggtaggtgtgggcttttcttcatatcttaaagaatctgacatgactgtaggctaaattttcttttctttttctgttcaagtaatgtttccgtcgtagaatttcatcatgtaaggaggaccagtgcttgtgtacatttactatttttcctgaattaatttataaattaatttatgacatatggaatacctactatgttctaggcacagtgttttgtgctagggacacaactctgaataagatagactaatcagtagtaaaagataaagatatgttggtcaaagagaagcaggtaaagagtgattgggtctcaacctgagatattctatccttttttttgtgagacttagccattattggaaattggccatattatagtctttgtggactaagagtgatgaaatacctgtctgttggtatgttcagttctggcttatgtctcaggaaagacattaaaatagatttttaacttgtgctcactttttgaaatttctaccccctaaatttattgtattagattcctaatatcatataattctactaaaatcaactga

SEQ ID NO: 57520 - DNA, 1015 bp, Homo sapiens
tgtgtatttcctcaatagaagggtaatagtggaaaatgtgttcccaggatgcaacttggctttcaagacaaattattttgactatggattggtagcaattgaaatcataaaagattttaaaataaagtattaggctaagaaaacaatttagaactttcaaaatattaaacctagcaacttcattcctaggtatttacccaaaagaaatgaaaacatttgtctacacaaaggcttatatgcaaatcttcatacagcatcattcacaatagccaaaaagtggaaacaattcaaatgtccatcagctgataaatggataaataaaatgtggtatatccatgcaatggaattctgtttggcaataaaaaggaacaaaatattgacaaatgctacagcagatgaacctcaaaaacattatgctcatagtgaaagaagtcagacaccaaggaccacatactggatgattcagtttatatgaagtgttcagaaaaggcaaatctgtagaatcagaaagcagattagtggtgggctaaggccagggttgtgagtggggaatgactgtaaatgagcaccagggttcttttgggggtgatggaaatattctaaaattagattgtggtgatgtttgcataactctaagtatactaaaaatcattgaattgcgcatttaaatgagtgacccttatgatatgtaaattatgcctcaataaagctgttagtaataatttaagtactgtgctaggcacttcaggggatacaagtatgaatataagccaagcaccaccatgctatttgcagaaaacacacaaaagagagtcaaattttattgaactaaaaaaactgagatgcagtatatattaaaacattttttttcatttttaggagcaattgaaatacttgccacccaattaaaccatgctggaagatacacttgtgtcgctaggaatgcggctggctctgcacatcgacacgtgacccttcatgttcatggtatggaaggctatttactcattcaaag

SEQ ID NO: 57521 - DNA, 1066 bp, Homo sapiens
caccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacagatttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataaccttttgaagaacctaaaattcgtttccttgcagctaaaacagggattaaatttaaagtcgtacacgtaaacagacacacaatcatgagaccccttgagagagaggtagtattactcacattgtataggtcaggatcctaggacagaggtaacttatgtaact

SEQ ID NO: 57522 - DNA, 1036 bp, Homo sapiens
tcaaatatacatttcttgagtagtttcattttctctgagcacagaaaacatgctctcagttacctacaggtagattattgacactggattttctagcttcctttattattttaaaaatctgcttaaaaaatgtattgatattttccttagatccttcctttaagataagcatgtttggaaaaggtcttttaaattactaattttgtttccttcccacaatgaaaatgtgaaccatcaccattgcagagctaagtcagctcagcccaaggctttaccccactttcatacggaatgtatcggtgtaaaatcttacccaccaacataaggcttcgctcatgtcctagcacctccctgaaacctttccagatcaaattccaatcacatctagaattatagtaaacaattgtactacgttttactaaaatatctcttcatctgtctcacacccccaacagactatgatttccctaaggacaaccaacacctatatgttagtctattgccaacatacagcccagttgtttcaccaatgttatatgtttaaaacatgctcacgccgggtgcagtggctcacccctgcaatcccagcactttgggaggctgaggtgggcagatcacctgaggtcaggagtttgagaccagcctgaccaacatggtgaaactccctctctactaaaaatacaaaaaattagccgggtgtggtggcaggcgcctgtaattccagttactcgggaggctaaggcaggagaatcacttgaacctgagaggcagaggttgcagtgagctgagatcacgccaccgcacaccagcttgggcaacaagagcaaaactcagtctcaaaaaaaaaaaaagaaaagaaaaaaaagaaaacatgttcagtgaaccacatggttgtaggctggattctgctgtctactactcatttggtaggtactgcatttaattctcacaaaatgtcttaaagttaaatataatcatccacatttacaaataagaagatgaagacccacaaatgaagaatgtgtgacccatccaa

SEQ ID NO: 57523 - DNA, 1881 bp, Homo sapiens
tggtttttttttggtgttttttttttgtttgtttgtttgttttttttttgagacagggccttggtctgcctggttttttgggtgttttttaaggcaggatctcaccggtctccctggagtactgttagcttgatcatggctcactgcagcctcaacctcacccgggctcaagtgatcctctagcctcagcctcctgagtaactgggactgtaggcatgttccaccatgcccagctaattgttttataattttgtagaaacagggtctcgctgtgttgcccaggctggtctcgaactcctgagctcaagtgatcctcccaccttagcctcccaaagtgctgctttttttgttgtttaaccatttaccctttttcggtttgttaaatgttcctcattgtttgaaaaaaagaattgaaatcaaatgaacaagtctacatcttattcattcattcatttagtaattagtttgtatcattataaatgctttctcattttttcacttgcttttcttttatcttaatgtttttcttagatactagtagtagtcaaccaaagcctttcagacgagtaagacttcagacaacattgagacaaggtgtccgtggtcgtcagtttaacagacagagaggtgaatttctgacataactggattacatgatagaatgtggaatagtaataaatggaacaagttttctaatccttaagcctccaatttatttttttaatgttccaaagttttattaaataattacatgttgagcaggtgatatttaccaatctgtaaacttcatgtagacagatttgtataccttagatatataataaatatgtgcttatattttatatttattgatttcttccttaaatccaaattaagatttggaaaatatgaagtgttatagtgttatattcatttgttgtatctctacctattgccattatattgttaatttttttatacaacacgataaagctttgtgattatgttttagctagtaaaagtgtaaaattttaatatttccatgttttccaatataacttttagattgtacttgtgtcacaaaaagagggattaatctgcttgtaataatttccattgaagttgtagaatacccaacagttttatatccacaatgcctagatattttttataatgaactagggtaagtgaatacactagttttgaattcttaaaagatatattcaatttgattcttttttcttttacaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaa

SEQ ID NO: 57524 - DNA, 1049 bp, Homo sapiens
aataaaaaataaaagtttgagagatggatttttgcttgatggaataattaaatcgtggactttagtaaagttgtatatctccaataattaatatttttctttcacatccctgacttgttgataattttatgtttttttcagtcattcattaatattcagaattgtctttaggtttaggaatgtatgaaacacccctgttcctagctcatgaagaagagtcaggtggccgaagtgttcccactactccactacaagtagcagccccaggtagggatcaaaggcagatagtaggttctgttttattggtaaaatgaaaacctatgaagtatcttctggctaaaaatgtgataaaccacaaagttttaaagttctttttcttgtgttgtctttttaaagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaagggtaaaagtttattttgttgtttttgcttgctttagtctcaacagacttgtacatttgttttcctttagccaagaaacaatctgcaaagttgtgttttgtttttttttgtttttttttttgagacagagtctcgctctgtcgcccatgctggagtgcagtggcgtgatctcggctcagtgcagcctccgcctcctgggttcaagcaattttctgcctcagcctcccaagtagctgggattacaggcacccgccaccatgcctggctaatttttgtagtcattttgtactgaaattttcacatgacttaaactggagcagattcatgttattcttgtactgtctccctcatttgtgtcttgaatggaagagagaaagatggatgtagccactgagccaggaattttacatacccatagcctatctcatctgggctagagcccgtggtttggttactggtatactatttagtagtgtgactgttgtgaactttttatag

SEQ ID NO: 57525 - DNA, 1635 bp, Homo sapiens
cttgctaacacttccaactaaggaaataggaattaaatttgtttacatacaagatggtatcatagatctgttttaagtattggttaataattggtctgttggttaatagaatgatttttattggttaatattatagactataattaaaaatttgtcattgacaaaagtgatttcttggcaggttttcctgggaaaatgtcctaattacctgtctgctaactattttgttggcagcgtaataagctgtatctgttgatatttggtgtttgtttcattgcctcatttcttaaagcaaatgtaattcctttatcttgacacgcagagaattcagatgacccgaaggcagtctgtaggacgtggccttcagttgactccaggaataggtggcatggtaagtacttacccattatgtaaaagtaattcatttcttgagcagatatttatatagtccatatgtgtggtgttttgtttgttaactctgttttctttgttttagcaacagcatttttttgatgatgaagacagaacagttccaagtactccaactcttgtggtgccacatcgtactgatggatttgctgaagcaattcagtaagttaatgaaagagaaacatactttataactaatcaaacttttagtctttctctgttagtttgtttatcatttggttaactcattgtttgttgagtccctctctactatgtactaataagtacttggggtaggtcagttgaggatgtattgttggggaaaattatacagaggtgaatgacatacagttacttctaccaagaattttgaagttaaagacaatataagaatgtttaagaacatggcctctagagttagaatgcctgtgtttgaaacctaactctactgtttactagcggtagcaagttccttaggttctctgttcatgagcaccttcattttaaaaatgggaataacaatagaataatttctgttgcataagttataagaattaagtgaatcagttaatttgtgttaacatgtttaagatgttacctgacacatgataaattgctttatagttgttgattaagtgttggtaattacaatgatcataatttatagtattcttgtgaaagctaagcaaatgagcaactaactgtaatgtaaacaatgtagaaggataatagaggaataagcagtaggctttgttactacaaatgaagaagtaatttatttcaacaactaatgagaaagaatatgagatgatttaacgcggatgatattgaattcagtcttgggaaagaatagctagcatttattgagcattttcatgcattagtttatttaacctcataacttatgagagtagacattattaatgttgtcatcttatagtatactgaagcacagacatgttaacaaatttgccagaggtcagacagcaaggaagttgcagtttttagtttcaaaccagttagtctggctgtagaggctatgctaagtgttgtgctataccactcctcttaaacggttgaaaggctctccgtgtgaaagtatacacatttattcgtggctaaggtattagttgcttaacaggatgtatttgaagatcagaatttaaaaatttctacaaacttggggaaaggttgattgttctgtag

SEQ ID NO: 57526 - DNA, 3476 bp, Homo sapiens
ttttgtttcctcttggagccccatagttcatttttgtcatttttttatatataaagtgtattttatatatataaggtcaaattgtttgttttattttggggtttaatcctatattgacagcttcttattttagattaataaacattttttaaatagctcctgatatagtgtaattttatcattttcttcaactccacctgtttaaatttagaattaaactggaccacttgatattttgctgacacctgaggtctatattatctttgagcaatctcatgcaaacagttagaattcagaattgatcattattgcactaattccagtaagtatcacagttgtggtatttggtgctgctgtactaatcccatacaactctcaggacaattcctatcttctgattaatgagtcacttaaatttctaagtgtggtatctagacatgcagagcatgtgggccatattctaaacttttatttatgcctggggaactttctactaggattatgaagaggatgaggaagatgatgatgatgatgaagatgacacagggatgggagatgagggtgaagatagtaatgaaggaactggtagtgccgatggcaatgatggttatgaagctgatgatgctgaggtaactggctagaattttaaccattcatagttctttctatgagctttctttcacttgctgttttccaaggatatagaaaggcttatgaaattcactaaaacctttggttgttttgttcatttgttttgttttttgttgttatggttacttatttgtttttgttgtggtttggtttggttaattattctgtccggtttttttaacatatttattttatttgagcattatgttaccacgttttgtttttagggtggtgatgggactgatccaggtacagaaacagaagaaagtatgggtggaggtgaaggtaatcacagagctgctgattctcaaaacagtggtgagatttttattagccttttttgaattgaatatctctggtattttctaaactagaattgcacttaattctaatatataaatttatttattgaattggtaaaaagagattggcccctgttctagctttgtgactgttgtgctctcataaaaagtctactatatttatgattgttaggtgctgtcattatactcttttctgcctcattgggctgctgtaagatgcaaacattttgtaacccttacggtattataaatgctatatgctgccattaagaggaaaaattaaattagggactacttgtaacagcagttcacaaccagaggaggtcagtctaatcaagctgcatgcttcaagatttggggctattggagctttgcagtatggtctgcttttccaatgaataaaagatttttggatcaatatagcatatattttgttaaatcttggataagtcctggaggtccactgaaaagttgtgggcattaaaagagtatggaagtcgtagaaaataattttattttgaaatgtgtattaaataattagtgattatctggtaatagataactaacaactgatactaagctgaaatcattagtgttgacatagtaaaaccttagctgtttagactaatgggaaaatactgtatctgggtttctgtagaggcctgggtatttaaaagggcaagatatattctcattttaactaaagaacagacaaaacttttaaattttttaagagaaaaatacattaatgaatattaagccatataataggtaatactattcttacttttaaagggagatgagaaattgatatactttgaacaaaaatttacatttataaacaatttgtaggttaagaaacattttttgtgtatcacgtagttgaaatatagagggaggaatttttgctcctctaggtctccctccctccctcccttccttccttccttctttttcctatttatttttatttttatttttgcaaccaagcaaaaataggcctagtgccctgaacaaaattaatggatggatttgagtacatttcaagcaactacacttgtattgaattgtttaattcttgtagtaaacttaataaggtttaggtatcaatgaagaatctgaatcgcagaagtaaagtgacttgaggtgtcgcatagcttactaagtagctaagtagcttaagtattagagcaaggatctgaatctagacctcagacttttaaactatgaaattctgtgacatcctgttcaacttttcatagttgaagatggcttcttttgttgctacagtgtatgtagaagaatacccagacatttgagagacatttgttaaaattcaaaattcaggaaaaccaaaagattaaaatgtagttgtaaggcttctcctctgtctttatcctttttgattgttacactgattctctaatggtctaacctttaggtaatttgtctactttattaaaattaatccagatttattaaatgttaattttagttttattttattttattaaatgtttactttaattttagtgtttttaatgtttatcataggtcgagctaagagctttatgttcattatctgaaatctttagaaaaaccattttagaaacaccagacttggaggttacatttgctctattaaccaaccaaaaaatagactcaaagaggttaagggacttgcccaaagccacacagcgaataagtacacatcccattgtctctgggtgtaaaacccacatttgcttccatcacacctcactactttacttctgaaaatattcgtacggtgaacattcctgttggcaagatttatacttctagggattgtccaagtttttttgtggtaaatttagcagttcaaaagtaaatttctcttttcctacaggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcaggtattaaaagtactggtcattatgaaaaatgaacttgaaaaaaatcttggcttttctccctttccattatgtatttctctctctctcttggtttttttaaattagcaatcccatgaactttttggtattttggcatatttttataaaattctttgaactaaaactaatctctgagggatgtttagaaaggcaagtgttactaaaagttgtgcatacattgaaatggttatagtcatagcaaataaaattgttatttctcaagtgagaaaagaaaaagattttcttgggttttaattaaagtacattttcgcagctcaccattatctgatttgaaggtttctttctctacagtgcacgtatttataaaagataaaggaatttctgttgtacttaacagaagaatattttttctcatttcttggtaatcac

SEQ ID NO: 57527 - DNA, 1050 bp, Homo sapiens
cttctttcttcaaaaatacttgaaatgccatttttaaaattaaatgtagctggctgaggtagctcacacctgtaatctgagtactctgagaggccaaggtgggagatcacttgaagtcaggagttcgagaccagcctggccaacatggtgaaaccctgtctctaataaaaatacaaaaaattagccagacttcgtggggtggtgcctatagtcccagctactcaggaggctgaggcaggagagtcgcttgaacccagtggggcggaggtttcagtgagctgagatagcaccattgcactccagccagggtgacaagagcgagactgtctcaaaaaaaaaaaattaaattaaatgctgctagtccataagtactcattattctttactttgacctataataatacctcacatatagttttaggtatgtttatagggctcttaattcttttttaacttttttatttttaaagggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggtaagtttgatttgaaatcatctagtgtttttaaactattggatgaaagtgctcaaatccttgggatactaatgcattggctgtaaattctggttcccagtcagcttaaatagattatatttatttatattatatattatatatttaatatattatatattatatatttatatatattatatataaatatatatattatatatttatatatattatatatataaatatatattatatatttatatatattatatatataaatatataatatatatttatatatataatatatatgttatatatttatatatatttatatatataatatatatgttatatatttatatatatttatatatataatatatatgttatatat

SEQ ID NO: 57528 - DNA, 1680 bp, Homo sapiens
acggaagtcctgaggactaaaagacacctaagataagactatatactgatttacatacagtgtacattttttcttattcaaggagtcctgagttttatagaaggtcccatgtaaactttgtagataacaacatagtaatacaatctcagtgaaccagatatattgtaaaaattggctggctttattaagcaaagcttgggttggtataaaaacattgactcagagcataagttgctctttgtttacccatagcttagcagaaacaaattatgttgatggacattgatctaggagttgattgattgtattttagtaatctgtacaattaaatgtttactgtgttctcctttagttaagtgaccatattgggtaaactatctttatctaaattgagttattatcatgctctaattcaagatttatataatttcaaagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggtgcgtaaagttctttctgtgtattttaacttttaccagtagagttaaggtactcttttcagctacagcctaaagaaaattaaccttttggggccaaaatatattatctggaaaacacttttattgaactttctacaaagattccactgacaacccaggtattattaccaacagtgttttatattcttgcatatctttaattgcatttgtttctatttcaataaaaaagctcagtcataaaaacataagttgaatttcatctcgaagtttctaagtctcatggacataaactgttacctgctatctttttctaagattagccaaaattatattcctttttgtggttaagattaaattgtaatgaagcaggtttcaaatcaaacattaaggctactaaattaattgtattagcatgtattaatgttcataaaccttactttgtgtatactgaggaggaatgtgattataatttttaaataaaatttttttatttttctatagtttcataaaatatagatttgaagggttttttcaaatgagagaactaacaaaaacaggtaacccttcatctactacactgatatggttaatatattagtgtattatgatacaggaagaagttatggcagaagaaagtactgatggagaggtagagactcaggtatacaaccaggattctcaagattccattggagaagtaagtaaaaacatacctaaagtaccacaccgttgcttttcgtgaatgaaattagctttgacaaattgaaacattatttggtctttttttttttagcttgttcttattatatgtaatgaaatactactagaattaatcattgcagagtctgctttcttttactcctatgagtatagtgtactgccttctaaacttatattaaagaaatgtttttgttcatatatagcacagatttccagattttttagagttgtgagccaagatttttccctattttaattacatgaaatacaagagtgctggttgcatcttgagttaatttatagtgccccatttgctggttctctcttactcccctgtattatttcccttacagaattaaagtaatccataaaagga

SEQ ID NO: 57529 - DNA, 1050 bp, Homo sapiens
agtaggtgttcagtaaaactttgctacctgcatatttccttagattcttatcttgacaaatgttagaattcagtaaattattcaagtatttctgtgctgtgaaagtagagaatgttttatttcagctacatccaataaactaaatatattactaatcaaatttactatctgttatatcaattaaaaactaaatgatgcttaatgaaaaattctaattttactttgagcttaatttcattaattttattcaacagtaatttaaatgaatagatgcaaaatcagttacagatatttatttaattcaggcaacattttattgcatgctaccatatcaattacatagggaatataaaaatgcataatacattacctttacctacaatgtatttgtctaccaagtgccaaatctgtgtgaaaggtgacatgtaccacagaataggaaggataatttcagctttgataaaagtagaaggcttatattcagcattataattatttttcagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacaggtaaaattaattttaaaatgaagtcagagtagacctatgcatttataagatcttgagtgtatcttgagtatatatatcttgagtattctttgtacaaatgaagttagaatagacctacgcaattataatatcttggatataatacgtatcacaagtattctttgtgcatacatgctttctaccaggaattagaatgaatgaatatattactaacattttatttcatgtttactactgaatatgactattttaaatcagttgtttgtcattaaga

SEQ ID NO: 57530 - DNA, 3686 bp, Homo sapiens
tatatttttaaagcattgtttaagaaaaatacagcaaagactttgtggcttgcaaagcataacattctatccggcccttttacagaaaaaatttgacaatactcagtgcagtaggaagagggtaggttttgctcttaaagcaagtctgaattaaaatctgggtaccatcacttgattttagtttgtaaaattgcgcatgttacttgaccattggtagctctgtttttctcatctctaaaatgtgcatgtaaacctatgtaataagatcttgccgaagggctgtaaattcgtaaggtcttacctttgaagtatatgggtattttttaggattttcaaaaaaaaaagttattaaagcagtataacataaagttacattggacttcaaactttgaaaaatgtctcatatatttaatctttcttctttcctccattttttaaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggtattttgaagaaacttatcttacaaaaaaaaactaggatgaatgttatgaaatcttatttctttgtaattttgaatattactagcttttagataccgaaatcgtgtaagcatatatgatatctttatttaagattagttctttaatatgtctgaaaatgcattataaactcacaaattttggtaaatactagatagttcagtcttcacctttcaaatactctccattttcaaagctatgttcttataactcattgctaattagaattgtgtatattaaaaaatgatgactaatctggttttgtatagttttaaataaattgtttatgttaaccacctatcaaaaaaattcagaaatctttgttatatttatattttgaatctaaatattgtttttaattcctgaaggtaaggaatttgtatgttgagaattatgtatttatttcatgttggattagaaaataaatataaagaaaaaaaattcacaattaatacccctttgttttagccactattagtacattagtatcccttttcatacatgtaagcgacgtttttccaaagaaataatattatatgcttatattcttttgtatacttttttcacttgattcattatcatgaaaatacagttaagtgttgaaaattcaactataatgcatcattttgattagctgtttagtattcagttatgtggaaaaccataactagttccccatttttggagattacagttgtttcatagaaaattctgttttgaataccttcagggataaaatttctttgcaaagctgtgattattttcttagacaaacttgcagaaatggaattactgaatataaatatgtgagtgtattattactgtttgttgtcttaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaaggtatgagtgtgagaacagtctgttcctaattctttcctgttatacacctaaagaaatatgtgttaactactgacactttgtcttaccatgtgggaatggatacattttattctttttactttgaatggctcatgtatgtaagtagtacccaatcatcttcaagtgtgcatttagttggtctgaccaccatttttatacttatacttccatttaatcttttaaaaagcaaattaataagttatactttaagttgctaccacatacagtttatattgaaatgattgaattccatggtgaatactttgttttcctttaaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtaaatatctgtttaaagtttgaacttggtagtgaaagttgattatgtgttgcaggcctaaaactaaatggaatagaaataaaaggtatctacttatgaagggtgtttgtgtgtgtatgtgtgctttaaatattaggaataattagttggacacaaagagcaatcctaattttcaagtgatgaggatatccttgatatgatgaaatttttctcaattgttggctggcagtagataatggaatactgctatccttctgctttcatggataacaattctatcttgtgacagagatcctttgagcccagaccgtgctgtctagaaaccttatgtagactgcataaagatctttaccagcccagggatttttttgtgcctcgtttggtggaggacccctctagcttttcagggagagtatcatgtcaaatttatgaagaacctagttcttcaaggctcagggctttattcagccttgcctatcagtctgctgagtagttaaataaaatgtcaaatcagttggattttgttacaggcatttttttaaaatgatctctaagacagtgtcctaacaacttacttgattttaaaagttcttgaattatttttaaacagtgctgtagattatatgaaataaaaattttgcaattcatagtaatgaattgcatgatacattgaaatataaacgggcttctgttaactaggatctttagctttttgagattttagttaggaaaaagtaaatttttatgttggagtaagtatattttatattctagtaataagttaaagcatgaatgtacttagaactttgctcattgagatgtatgatgtatcataactaatgtagatgttatagtagtagaatctgatgtgaccatgtgccaattaagtgcataaatgctgttttaaatgtttgattataatattaatataatcgcctggttacttctttaggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtgattagctaattctgcttaagtaacaaattgtttttctttgtacattttacttgaaagtgcttggtgatataggagcctttgtcagtgaattttggctaaaattcaatatatgcggagagaattaacaataatgacaatttttttgtggcatttttagtggactcttgtgggctaggaacaacaatcaagagctttctctttataggtccctgaacagcagagacagatcacattgaaaacaactccagcttctggtgaaagaggaatgtgagttttagttatttcatagtctgttatttttcttttaaagctcagggaatatctagtgatctttctg

SEQ ID NO: 57531 - DNA, 1020 bp, Homo sapiens
tatgacttgggagagtttcttaacctcttggagctttagttttcccttatcacctttcgtgtgataaaaatttaacaaatgtgaagcacattacctggcatctacagaaggtttgtgtgtttaacttgtaatgcattgtctatattttttttcttgtaaatgtcacttcaatgaaattaggtacttaatattgaaagttttgattcttcagatccctttatttggcttcattgtaactaatatgaaatgtttattcacaaatatgaaaaaataatgaacatttaatgacattttatttttttttcctcttgtattgtgggtagacttcttagccaaacaagccaaagcttagtttgatcttagtatcttgtagttccatgcttgattactttacatgcaggacacctaatataaacataatcagatattctgccattttattatagcacatttgtttcataaaacctaaaaaaatcaagtatgcatttttgttattctagcatctagtaagtcaacagaaagatccagatacagaagaatatcggaagctcctttctgaaaaggaagttcatactaagcgtattcaacaattgacagaagaaattggtagacttaaagctgaaattgcaaggtatatggaaagaagccttaaatcatatataatataaaagaagtttattttacttatttacatgactccccaagtgcctgcctcctggttttagaaagaatggaaagtgctagagcacctatatctgacttccatctactttgtagagtcaagcagtgatttaatattatgcctttgtatataaaatatatatgagactatcctcataattatttctctatattttattttttaaagagctactcagaagtctaaagctaaatttacagctatcaaaaacttacaaggaggttttttttttcttttggttagcttatatttgtgactctataagggaagtgggttttattactttggcttttgtgttcctttttgtggagaacagtgtt

SEQ ID NO: 57532 - DNA, 1449 bp, Homo sapiens
aaaattataatagtaatgtaatgtctgtctaagcatgaacagtgtagcatggcaaccatgaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcacagaaaagtaaacgtgaactttcaaaaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtttgttgcttagttatcaagagtggaagcatgttgtttttaataataaatgaatttttacatttgttgttaaatattggcatgattttcaggtgaggaaactggagttagatattttacccttacaagaagcaaatgctgagctgagtgagaaaagcggtatgttgcaggcagagaagaagctcttagaagaggatgtcaaacgttggaaagcacgtaaccaggtaaatgcagttaaaactcttccaaaacatggaaacacgtgtttttaataataggggaaacttaggggaataaaaatatttgaggaactagtgaaaattactgtgtttattagtgaaagtctattatgttattaatacatgtaaatacgtgacagatgttaaacttataacccaatttataaaaaattttggttatattatatatatttctaaaaagcagttattttccataattttaaagttttagcctttcattttatctctaaaatatttttatacatgaaaatagaaatctgaggccagacacggtggctcatgcctgtaatcccagcactttcggaagccaagatgggaggattgcttgagcccagaagtttgagaccagcctgggcaatgtagtgagactccaactctacaaaaaattaaaaattagctgggcgtggtggtacatgcctgtagtcccatctacttgggaggctgaggtcagaggattacttgag

SEQ ID NO: 57533 - DNA, 2502 bp, Homo sapiens
gggtgtcatgttaatagctattcatttgcttactattctttattgcctatatatatgtgacgtgtatattgctattttaaaatgtaatacagggaagaaatgcttcaaagtaaatttcattaaaatcaatggatctataatttagtacttaatatagctgagttatgtttagcttcttatatcaaaaagtttgtccaaattgctggtcttctaagcttcatttctgacagttttataatattaagtaactaaagcattaacttttaattattttcttattttgctacatttagattgtctttacttttattatttaaaaagtccaatgtgtatctttggacaagtgctaactagttttatggatttttaatctttggtatcaattgggtaataatttcttataggctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggtattattgtaaatctgaatagaatgttctgttgaattgaaagagttgtttttttctttattttataatgttttgagatggagcctcgctctgtcacccatgctggagtgcaatggcgtgatattggggtcactgcaatctccacctgctgggttcaagcaattctcctgcctcagcctcccaagtagtcgggattacaggcgttagccaccgcgcctggccaagttgttttttttaaatatgcattggaaaatctgttattctgatagactcttggcttgcaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcaggtaaatcatgttcttactgcttcatttctgtggtataacaactatgaaatgaaactacaaatatataaattagagaaggagattatacacgattttgatataaagttcattcttttatttgtcaaagaactcataacttttaacatttacacatattaaacaagtgactttaaagttgaatctgatagtaagaactagagcagttttctcttgaaaaactaaatgcctttcagatcattttagagataaacattctaaagccagtgtctataaaagaaaatagaaatacatctcccattattatttattattaatgaaaacgtgtaatagttattaaagtcaatgatttttgtcatcttaccaaattacctacgttttgtaatgttggctttttaaaattcacataaaattttaatatctgtatttttgtagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattggacagggaaaagtaaataatgaattttatgggatttatgtgttcagcaaaagctaaaggttccagaattatatcctgtttaattcaaatgtatctcaccatggaaataatagagcctccagttcaatagagttaatac

SEQ ID NO: 57534 - DNA, 1691 bp, Homo sapiens
ttttttaacatgtcataatcagattttttttcttttttctggttagaaaattaatgtggtagattggaagataccgtgttcattttgaaggctgtagcaatagtctagggcttcaattttaaaagatccttttgtggttgacatcattgtaaataaatcaaaatgtgtgaggaaaatacctttcgattgtagaatagatggatttggcaagtggatatgaggattgagggagaaatgagagattggaaatttcatttcaaaagagaaaaatggccagtagccaagatgaatggtaaatgcttgtagatttatatggtgtttttgcttgttgttgaatcttctaatcacctttgatggattctttttttaatatacaacaaacattaattttattacttctcaaattagttttgatttggagaaaataattgtatgactttaaatgtgtgtaatttttatatcctactgtttgtaatatggtaaaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacaggtaaataggttaaccgtattaattttttttttaacttgtaaggatttgaattctttcaactaagtcattagttgccatttagttcatctcaacagaaatttattgaacacataggcaaaattttagttttatgttttactcttttctgtacctctatatacatttcccgttgaaatttttagactactttacagaaataggtatcactggttctttttaaaagcccctacctgagacttgacttatgcaaatgttagggaatggatatggagttgcaaaactgattatatcagggtgtaaacattttaaatttagcagcagttttttgggctaattggatcttaaaaaatgagacttcaatttagtaacactacaatacagtattttccaagtaagtttgcaattaattttggttttaatcttgttctttctgcttagttatctgaattgaagaaaacactttctagtgttcagaatgaagtacaagaagctcttcagagagcaagcacagctttaagtaatgagcagcaagccagacgtgactgtcaggaacaagtaagtatagccaattattgagaaatgagcttcgatcctagagaatgattcttgaagtatatttatgcattataagaactggtggaccttacaaaaattcaagataatttccacttttgtggaacttagacaagacaaattgaaaagtatagatggaaggctaaaaataaatacatagggcaatattcattaacaaagcaatcttgacaatgggaaaataaaaacaggactaggagactaaaatttgtacttggctctcatttgcaaaaattattttactattgtccttcactagatctgattataaaattacagatacagttgattagaggcaacctttgctaacaaaacaagaacctcttgataacattgttaatgcattaccaagtttgcgcagatatctatatactatttataaaatgttaaaaaagtatcattattttgagtgtatgtatgtatgtgcacacagtattgaagctttttataatttttttatga

SEQ ID NO: 57535 - DNA, 2813 bp, Homo sapiens
gagctttcaaaacactctccctggtccccttgagactcagactcttggggttgaggggagggagaaactttaaatagatcaatcatcacttttaaacaggtactttgaaaccggcttggattctaaaagttacataatttaatagtagtcaggtatgaatgattacagcagtcatgcaattctgctttcttcttctcacatattaaatttttcttgctgttattttttaaactgtggattgttagagcaaggaaccataagtatttgtaattgaaagattttttcattgatgatccccaataatttttgcttcgtattttagcacatgaaactgttttgtatttccttatacaatgaggagatatagtccctaagagcattaaaaaaaagtagtgatgtatgaatcattttaattttataatcttaatacacttgacaccatgtttttcagcattttttatttcatttctacttatgtttaggtaagagcagaaaatttgaagaaggaaaaggaaatgcttaaattgtctgaagttcgtctttctcagcaaagagagtctttgttagctgaacaaagggggcaaaacttactgctaactaatctgcaaacaattcaggtaaccaaataaaaagcctatgtagaaaaaatgtataaaagttaaatttagattttttttatcctctcaatttccttaattagaaaatttatccatcacttttgtcatccattatgatcattgaattttgcagtttattaagacatttaaatattttaaataaaatattgaaagagaattgattgaaaccatacattggtaagtcctcaggtatatttacagtgtcctgtgcagttttactatttataagattaattctttggtttttattttctttaaaactttgggaaatctgaatgacgattataatacattccatctctttcctgtataatagatgttttaatataaaaaataccagaatactttcttgataaatactgtagattttagctgcttcatgtagaaatgggttgtaatattgtaattctttcttgccttcaatttttatttttttgtattgcctttttcttaagcataaccaaaaatcttttctttgctttagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgtgagtccatcagagttctgaatttctgtagggtgtttatgttcagtaattaatctggtgtgtggacagtctgccatccaagatgaagcatgattttgaaaaactttgttactaagtttttcttgcctcactctatacccagtaatttttttattgggtgccatatattgtgagttttaccatgttgggtgctgagtatttttgtattcctttaaatcttcttgagctttattctgagatgcagtaaagttaatttaaaatgatttgattcttttgacttttgccttttatgatgtattaggtgggcccagagcagtgtgcattctggaactgaggccaatactttcatgagtattagtgccagtgtccattgcaattgtggggtttttttagtctggctgcagaacaggcattattcttgactttctttgagtaacaggtattcttcactcttaattcctttggacaattcttcccctgtctggggtaagctccttatatatttgcagcgatcgctactctgatgaatatttaaggaggaccctctgtagagctccagggtactctgtgtgtgcaactctcctgtcttatattctgtcttacaaatttgagctactttggtctccctggactctcagatctgtgttctcaattcagagagtctcctgggctctgcctcatttcctctttcctgtgtcatagcctggaaacttttaaatcagtaaactaaggcaatctaaggttcacctctttggttttctgtctcaggatctcggttgtttcatgtgttttgtctggttttttttggctgtttcaggtgtgacggtaaatctgttttctgttactctcttggccgagctccaaaggtctataaaaagatagtttgaacctttagttacttaggaacctaaagaatgttataagattaatgtattttataggttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtaaataaaataagtagaccaatataattgtaaataaacaagtacttcttgggattataatatatcctgtcagtaaatagcctaattctttgtgaatgctagtaaaatgaaacaaacacaaaaaaaaacccaactttttctttatatagtggtactcaattttgggcctaaactagtaaatttgctgtcttaaaagattcagaatagttcagcttggcatttgatcaaggtatgtacccagctttctaattcttgaaactatttattgatactttaaaaattattctttctgaagagggttatttgattttttaacccgggccccttggaaataaggttgcttaccaaatctgcaagaataagtttctcttaaagaatgagttgatttgtgatctcctttaaagcagtattcccaatatttgctcgttggtagcctcaggtaa

SEQ ID NO: 57536 - DNA, 1097 bp, Homo sapiens
gtgttatcaatattgcattgtcattactttaaatataattgattttttaaaaataagattaaaaagttacttagcatgaaatactttgcttacttagaacttgaaccactacatttggaattgggaaaaaagaatgaaggttttaccttattacacaagccacttcttcataaatcataaaattaacccctttcccatttagaaaaaaaaaagtgcagcttgctgccagcgctcatttaattttacataagcatgctgtttgaggttgaggcaaatctgacagattttcagtgtgaaaataaaatataaaaactgttcctggagttatttctaagcagaattcaacttaacagaaatatgtatgatgttacattaggattagagacaatattctcagggcatttggggaaatgggttaagctattgtgaaatttcttcaagggattaagctaggatatcatttcagttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtgagtccaatatcccttgtccaacttgcattataagttgcatttgacatttctttagtttttactttgaattttactcactgataggacttaggtatttaagaagtttggaggttacaccaagtaattaatacatagtttgcaaatagccagtgtgcgttagtggggtgattgtttctattaagatagaagagggaaaggaatttgtttttctgctgggctaagatatactcgcaagtcttgcatttcaaaataaatttgtaggtcagtgtttggttctaacaaagacgtttttttttttggttttttttttcttgagacagagtctcactctgtcgcccaggctggagtgcagtggcacgatcttggctcactgcaagctccgcctcccgggtttacgccattctcctgcctcaacctcctgagtagctgggacta

SEQ ID NO: 57537 - DNA, 3175 bp, Homo sapiens
atttgtgggttttatttgatcactgttttacaaaactggagccatgttttgggaattgtaatttggctactttgtaataagtaatagccttcaatacatacttaaaagtaattttattctattaaaatttgattgtttagattttaatatccaaggatgctttatttttaaagataatttgaggcagtacaagttgaaggttttataagtaatgttttaatttgaaaactttcattctaaacttgtccagaattgtaactaatactattttataacatattaaaactttgtttttagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaagtaagtagtcacatacctcagcttgttgagcaaacatttatgaaaacctcagctaggctcagtgtctcatgcctgtaatcccaacgttttgggaggcctaaatggggtatcatttgagcccaggaggtcgagaccagcctggacgacatagtgagaccatgtctcaaaaaaaagtaaaaaattagctgggtgtggtggcacatgtctatagtcccagctactcaggagacaggctgaggtgggaggatcacttgagtccaggagtttgaggctgcagtgaagcatgatcatgcaccacactctaagtgggacgacagggtaagaccctgttgcccgcaaaaaaaatctatgtgttcctaacagtgctagatacttgggatatagtgatatagggaggaaagaattgagcaacaataccaaacaaaaaatttctactccaagacctcaggttatgggtaagacagatgtaataaatagataataaaataggcaagtagacaatttgcattcactgtgattagtgcctatctgtgggatcatagcggtagaggacttgtcctagatttcagggagcagaccggcttcatggagaacctggagaacctatgtaagaattagtcagaggttttttcaaaatacatgtataatgtcttctagaagaggaagaatggctaagaaagcaagaagactagagtttggagtgagtggaactgatttaatttttacaaacaaatttttcagattgcattggtaagtataagtacctgagtcctgtgtggtggggatttaaaaagtagttcataaaatactcagcatgaaaaaaaataatgagagagacaaaaatggtatgatgaatggtaggcaaagatgcttggttaattacagtagaaattacaatcagttaactctcagttcagtcctgtgaattaggccgactttttctacagaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatggtaggtttttataaagttattttaaggaataatttagaaatgtatattaagggattaattttgcaacataagcaatagccactctaatgatggtagcttcaaatttgactaccatatataattgcttataacatcccatcaactgtaaaacataccattattttatgtattgctaaaaagaaatgctttctattgttgaaaaaggtgcatttcagaatcaatgaattacagtatttattttggttatgttttaatgaccaaaacagatatgttttaataaaacataaatatggattatgttttaacccataaatactgaattatctctaataaccatcaaaaaatcttaatacattgtttagtagattccttatttaaaaactcctataatcttattgtttcatttcaataagtttagcttgtttatttgataatagtgtatttgcaaagaagcattagattaaagctgatttatgaaagccaacaaagcattttattagtctttactttcctgaagcttcaagcttagatgatgtttctcttgcatcaactccaaaacgtccaagtacatcacagactgtttccactcctgctccagtacctgttattgaatcaacagaggctatagaggctaaggctgcccttaaacaggtaaagatcacacctttgtcctgggttaggtttttagagaacacagtgttaccttctcataatctccaatatttagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacggtaagttttcttttgtttcaaattaattaagtctaaatgttatactttacaattcaaatcatttaaattcaagagctaatttgcaatagtgttgctttttttgtgaactgtgttccagaatgagaacctctggtagttcatttttttcatattgattaatgattctctaggcagtgctaagggtttagcttgtttgataagttgaagccaggcgcagcagctcacgcctgtaatcccagcactttgggaagccgaggcaggtgggtcatttgagggcaggaattcaagaccagcctggccaccatggtgaaaccccatctctactaaaaatacaaaaattagctgagcggcagtgttgcatgcttgtaatcccagctactcaggaggctaaggcaggagaatcacttgagcccaggaggcagtggttgcggtgagccaagattggggccactgcactccagtctgggcaagagagtgagattctgtctcaaaaaaataaaataaaataaaaataagttgaagttcatgtgaggaatgttggtagtttaccttcctaagattaaaggacttgtttcggtaggacttaattcttttaaaaatgcaccagatgatgagagaaatgagagcaaattttattccaccttttctattctaggtagaagag

SEQ ID NO: 57538 - DNA, 4535 bp, Homo sapiens
atacagtatgtattacagttaattttatgcagttatggtttaataaagcatatttatatttgcttatatttctcttgattgcagatagggttgtgtagtgtttgtgtgcataagttttgataaattttttaagtttgtatcatggatttgtgcatattttaatggtagtaaatgataaaatacactaatatctacatattagtacatattatgcacttacagtagctttttcttagtttgttcccatttctgggctgcctggattggtctgtggtctctgagtttttcaaattgtaagtttttgggaaaaaattccaatatatttattgaagaaaatatgagtggaagtgaatctgcatggttccaatctgtgttattcaagggccagctgtgcatactttgtattaaaggtttatattcctagaaatatatttttgatatttggttcccctgagtgttaattagttattattttttaattctcttcaccattctagaggatgttaaacgtctgaatgaaaaacttaaagaaagcaatacaacaaagggtgaacttcagttaaaattggatgaacttcaagcttctgatgtttctgttaaggcaagtaccagatgattcctaatgcataaactatagctttttattaaaactcacctaaattaaatttcaaatataggcaataaagtaattaaaagctgcattttgttttgtttttaatgtcagaaaattaagcattaggacaattctagttcatctgttttgcttgtttgaaatttaagtttgttacagttcttaatgttttctagttaagaatctatgcaaatacttaatttctgttttgaaataaaattctgcttgtgtcccttagctacagacaaaatcttttgaataatcatatatcatctttaactgtacgtgttattttcttggatttctttagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtaagttagtaaaattgtgtttttcttcatgttgagtataacttacatttgtatgtcagtttattaaatatgtattcagtagtgtgtacctgattagttgtaagatgagtggttaaatgtgaataatgcattacatttggcgtaaaaaatcaaccaattgcgtttacataaagaatttaagattctttgtcaaatctggttagtatctactgtcttacgatatatctttcctaaaatatgtgtttgtttaagaagtggtggtaagtttttgtgagctaaatctaaacattgttctgtgagcagttactcttagttttcttaaatatgcatattttaattgctttttcaggtggggagggggagttacttagcttttccttagcagcataaacctcatgtcagagtaatttcagttaatatgacatcctttccccctgctctattttttgtttttaggtttctagactggaagaacaaatgaatggcttaaaaacatcaaatgaacatcttcaaaagcatgtggaggatctgttgaccaaattaaaagaggtatatatgaccattaaaatgtcttttttacaaaatactaaagcacttacgaagctgttatttcacaaaatgatgtcattttttaatctgtccttggccccataaaacagtgagagtcctccttccatatgctgtagctaggctaaaatagaatcagaaatagcaattatatgttatattgaaaatactatctaaaaaatgagtatgggttaattttattgtttaattattttactttgaatttaaaatattagtaatattttatccttaatttatctttgtcatgaagactgatttgaatttgagtgttttagatttagctcttactttacaaaaatggaatttttcatcttgtcatttgataagcattctaaatttagttcaaagtagactgctataattgggctatttttttcaggccaaggaacaacaggccagtatggaagagaaattccacaatgaattaaatgcccacataaaactttctaatttgtacaaggtaaatatcccaccacacatgttagtatctaaatgttgcattgttgactgttaggtaactttttaagattaacttttagagtgccgctgatgactcagaagcaaagagcaatgaactaacccgggcagtagaggaactacacaaacttttgaaagaagctggtgaaggtaagtgttttcagttatgggaacattatttttgttattgtactctttttttttttttacccttgttttgtatagatgattggatttaggtgttagactttatttgggacagaattaggtacagaagaaagaactttggattaggaaattcagaattatatcttaagcaaatgtaagtttatatatttttgaaaatacagacagcagggggttttgtttgttttttatctaataatcttgtataatttgctgatttctaatgagaaagttttcttttttgaaacatttactctgataatgtttgaatactcttactttataaataagacatcctctttatttgcattttgtaaagtcttttatttcctcaaatttttgcttttttcaatgtattatatttatggtcttttccaataatttcctttacttaggattaaagatcaaaatcgaaatcaaagatatacctagaaccactttttaccctttgggtttccttattttctttgtgggtaagagacatcaaaaggagaaacaccaggcgaagacaattccaaaattataagtagagcaagaactttcaatagatactgtcagctgaagcctctctagaaatttaatattatctgctgaggggagaagtgactgatctgttgcattttgtaaactaaaattttaactgtatgtttgaatatttggtctttaaaattgttttttagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggtatggctaatagatgcttgttagtgagttgaaatactacagctttcctacataaaagtcatttaatttcactaatagtatttatctgtcatgctgtgatgtaggaaactccatcgagttatattaatagaatttgttttaaaattaatactcttacctgtatctttacagaatcgggcatataaataccatttgatcacacacagtcttgtaaattcccaggttattgcatgattttttagaattagatgtgttacatgactttttgatgtcatgtatttaaaatttttataggaattactatataatgtacagtacatgtcacttaccttgaaaaattattaatggcttttagtttggaattttacaaattatactagatgtgtatttgttggcacaggagccatattgtctgaagaagagcttgccgccatgtctcctactgcagcagctgtagctaagatagtgaaacctgggatgaaactaactgaggtaagaatggtattaaatgttgttaaattctttttcttcagcaaatgtatacaaatctcttcaaaatttaattctcccaaaacttatttttaaaatcatcttataattagtggatcattctaggaaaggctttctttggttcctagtgctgtgtaactaacatagtaaacattgccattttgtgttagtgttaaagaatgtttattatgaaactagatcaactaaatatttgcgttgttatggttagatttgaaacaaccctttgtctactttcagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggttggttccattcctaaaatttagccgtggtaacaatacaaatgagaaatgatttactaggtatttttttttcttaaggtgattgagtcagaaaaatctaaatacgattttcaataaacacattttgaaacttattaaacactgctgatctcaaaacgtcatacctttatttagcaatttttatgtatttcaatttttatataaaattgtgaaagcattttaacctttttttaatgcatttactatgttttccttaggattctcaactagagaataatagccaaatctcctaaaactgctcttcaaattaaaataatctctgtgtaataaaactctcctatttgccataatcattctttatcagacagttgtaatagcctgcctagaaata

SEQ ID NO: 57539 - DNA, 1033 bp, Homo sapiens
ttttaaaaattatattttttctagttagcctatgtttagaagagaaactgcatgtaagggaaaagagcccattttgagtggcaattgagagattgataagtgcgttatcaagcataatgttttttctttaaaggctctatttagagtgataaatgataggaattgcaaatattcattattgtgatttgctgtatatacatgttatatagtttaaatgctttttctctcttgatcctgtctttttaactccattttcttactgctaagtacagttcactgtttcttatgatatatgttgacttagaagatggcactgaaaaataaaggaattactaattgcatgtgactttccccataaatgttggctaggattattatacatttgatttggagacaggatagcatatttaaaattttggtctagaacacagtaaattttgaatgcattcatgaatttggaatgtgatgtacaatgcagtctttctgggcttctgttttttcatttattaaaatatgtaaggttggcagttgcataaaaacactcattgcaagttttaagcaaatgtgtatgtattcataaaattccttttatccagacaatcaactgaaggcactaactgagaaaaacaaagaacttgaaattgctcaggatcgcaatattgccattcaggtaagagatatttcttagaataagctcattgtagacattttacttgaagggacattctattctgattgtttatcagttattagtcaatgggaagatgtaactgatgtcctattaggggaagctaccaacaaaaatatgtaaatataaattccttaattggatctatgttttattgatagattggacatctcttttattcaacagaaattatctattgaatgctgactgtagtccaggtattatatcaaatgtgatacagttgggaatttgggtgaatccacattggtagtcatttccttagggtagttttataagaatgacagtttgaatatgatcacagggattgctgacaaatttgttaat

SEQ ID NO: 57540 - DNA, 1056 bp, Homo sapiens
atttgcaccataaatattgaatgtcttacatgttcctgatactatgctgaacatgatattcaatcccttcccttggaaagtttacacatttacttttacatatatttagtagttttatgctttcaggtaatatcttgactactataaaagaagtcttttaaaacaaaggagtttttttttgtctaaacaattttttctcgtgtaataaatactttatttattaagcagtttactgatgtctggagaaaatactaagataaatgaggttacctgccttgaagacattgatttgtaaagccccttttaggccttatttttattttttattttttgtcatgtaagtcgtttggaaatgctttaagtccttttcagtgctcagtctatttatctttactcagattctcttatgtggagcacaattctaatactgtatcttaagttttaaaatcaaggttattagaaataaataacagtattcacaatgtatgtacatgtgtttgattttgttttttgttttttgcttgtctgctgtagaacaacagtattttgaaatagaaaagaggttgtcccacagtcaggagagacttgtgaatgaaacccgagagtgtcaaagcttgcggcttgagctagagaaactcagtaagtatttaattcatctttgtaagtattctcggagtatcgaaatcttcagagactcctttatatactttggaaacatttgcttactaaacatgaaaatattgattaagcatcattggtttttattatggtgatattttgatttttcacttagtggtaaagattttgtgagaacacagaatttaatggtcaggaggtctggattcttattctgattttgctattaaaattgcttttgccacatgtaaatcttaacagtatctgattattgtttataaaatggttagacccacatgtctgtctacctagacagctttgtaaatcaaatgagataagagttcttgaaatctttttaaaaaggtgaaagcattatgcaactaaagaagtagagagtggcttgtttttatgttgaagaat

SEQ ID NO: 57541 - DNA, 1154 bp, Homo sapiens
gaagtgcgcgcgcagccgttggaagctacgaaccctgggaacccgagctcagaggctatccctgatcctcttgcgcacccaattttccggcttccagctccacccacttcaggccttgtagggctctgggaaatgtagtgtttttctcattcttttccgggagcccaatgctgcaccgccctctcagcttccgtttttctccccgctcccctggctctcctatctcggccccgtaaccgctgtccgcacggtggcgccacatacgtactcgtcaccccttggccctccctgaagagctggtgaccttaccgtcaaagccccgggatgccatggatcgtcctcgttggcggcttctggacactgagccactagagggcatcggtcccggtagggccggacggcaggctccgggataccgccacgctctctatggcgcccagaagggggcggggtggcgaccgcagtcgctttggctgaggctctgcggggaagggagggggggcttttacgtcatcaatctgcgccacctgactcccaagtccctggctttggagtgggaagtgaggtgtgggaagtaggtcgctttctgatgaattcagtggcagtgaattgagaccggagggaatctggcccctagaggctggtacttgggcccgaaacccccatctccggcggagagaccgtccgaggtaattgtctgccacgagtgcacattctgaaaacaggtaagtcagcctaagtgtagtgtgtgtgtgtgtgtgtgtgtgtgtgtgctctcttttcaagagaaaaaggaagggacagtgttggaaccatatggacagtcactccggcacacacttctgacgaacttaccttgtgtgaaacggcgtacctaaatggtttttggtggtggggaggtggcactgagtgattcagtacccgggaatttaaggacccgggttaattcttcaggaggagaattaaaagaaaccggtagcactttgagtgtagcctatgttttaaatttttcgttgcagaaacggttacctaacattatattgtttttaaaattgaaaactgttgtaactgaagtttttaaacacattgttaatttctacagtaacagaacttgtatggttccagatcataattctgtagttttaaagctcaat

SEQ ID NO: 57542 - DNA, 1015 bp, Homo sapiens
ctgaacaagctcattgaaacaataaggaaacagcctccagtaggacatttcagacttgaatccattctctgggctttagttttaaaatgcaaaaccgttttgtgactgacagtttactggtatcagatataccaccccagcatatctctggtagccttaactttgtggtactgaataagattcacatttttaacagaatccaaatgatgatgattcctaaattgcagtgttcaaaatactgtaactgtgttcctgcagtctctgtttgttttatagctcttttggatatcatctcttttacattttcatcctcactgattatgaactccttgatttaatcattcattatattgcctagctcttttattcaatatctttggttttaagctatagaaatgcaaatcaaaggagcataagccaatagagggaatgaatatactgacttccatccacagaccagagggaaaacagagtaagagctacccgtagtaatgatttaattgaaggactggttacgattcctcattatgagcgtggtgttgaaaaacatggattctagagccagagtgtctgaatttaagtccctcctttgccacttacccagctttgtcactttggcaagttatttaatcaacttttctcatttcagtttcttcatctataaaatgaggattataataatggtacccacttcctggggttttatgaattattaatgttacatggaaagtacttacaataatgcgttgtacaaagtagaagctatatgttgttattgtattgctatttatctacttaaataactcttactgtagtatgtattgctcaaggacagagattgtgttgctcatctttgtgttatcccacttagcatagtttctaagcaaatagtatagttctttcatatatgcttatcaagtaaatgaatttgactctacctcctaatgaactattcagaaattcatgtttacgattttagcaatgagaacaccaagacttagcaatagagtatcaa

SEQ ID NO: 57543 - DNA, 1027 bp, Homo sapiens
tgggtgacatgcttgatttctttagttaaaatcacttatcatttctcattctaattaaagtctctgttctatagtttatataaattctagttgccccaaattaattttttgtgtccagttaatctctaatgatagtgaattaaatttttttatttaaacccaatttttctgtaatttcctaaaaggaattcaaaaatgttagtaattagctccagtctttaatttgaagaaaagaaaaattaatggtggcacacacctgtagtcccagttacttgggaagctgaggtgagagaatcacttgagcccaggtgttcaaggccagcttgagcaacatagtgagaccccttctccaataaataaagaatcatggaattttaaagctaaatgagagttggggacattataattgcctatttcaacactcatctttttttttcattttacattcaattagtgtgtatttttctctctttcagctaatgtttgctgtggaaaagtctataaatagaaagagattgtggaatttcacagaggaggaagtctcagaacgagtgacacttcacatttgtgcttctacaaaaaagtatcttttgttcagtttatggtttaaaagtacaaagtaccaaaataatattcttgcaaggtttttttgctatttatttaaatcatcatttaaaaaataggcatagttttgtaagatttttctgtaaataacatggaattagagccaccaataataataatagcaataatggttgttaatcatgtcccaaggtgataaaaagcttgagatctgtaatatgaaagactcaggattctgaattttttaccagctatctgccctgtacatccaagcacagcagattccctacagagataaatgcctaactgatggcttaggcaaagtaatgtttttattatgttaaagttttcacctccagtttctatagataaggatgtacaattcaaagcacaggtgcacagagctggatggtataggacatcggagaaattcttatgtctttgg

SEQ ID NO: 57544 - DNA, 1041 bp, Homo sapiens
tgttgaagctagaggatcaaaggacctttcagaattctaaacatggaaatttctgattctttttctgcctaccattgggaggagaagtattgccaaggatgtattgaagagtactgaacttaacacatgctttattttgtgtttagttcaacctatagtcttttgatcaagggtttagccatatatgttagatatgagtttgtatgcgttatttaggttgtatatttaataatgttttgttgatccatgtattttatctagactacatcatagttatttttctcccttctccactgctagagttcagcaagaccagcagattggaagtatcaaagtggattatcatcctcatggctttctttagagtgtacagttcacattaatattcacatcccactttctgctacttctgtcagctatactctggagaaaaatacaaaggtaccagggtaaaatgaattttcttcagtgattgctgagtgaacaatctgcttttattctgcttacatgtgtcattcattttacaatcctcaaaaattacattctgcttacaatgttgttatgtgagtaacttattaccgcagccaaattagaaatttttagaaatttttagaagtggaacaatgtcataatactagtatattcagtttaataataactaataatttagttgttagactaaatatactagtacttattatgtgctgattaagtattattatgtgctttgtcattaaactaaatataacagtattcattaattaacatgtaaaatgtaattaatgtaagaagctatactgtttggacttttagctttctcttagtacttaggtttttttgtcttcctttttccagttcttttttgtatttctataccattcttttatttttatcttatttttcttcatttttcccattgaagatgtcaaatagagctttttttttttattttttagacttatttgatgcttttttctcacttttttttttaaggtagtgggcattaaattttatttaactgatcatgtacttaataacctc

SEQ ID NO: 57545 - DNA, 1050 bp, Homo sapiens
ctattaacaaaaacctaaaattttaccattttttaatcttatattttgtaattattaattcgattttaactgataatggcctattgtgcagtccaaatgtaccatataattggtgtgaagattttcatatgtagagtatctattttgtgcctttttaaaaatgatggctatacaagtttagtaagtgttccactgttatacatattagtatctaatttggaacactgcaattatttttttagatgtgaaattttattcatttatctgtttttaactatttagataaatttatcattaaactataaatttgttaataagtgtgctaaataagtggaaataaaacattgaatgatgtatcagttatttagtgggcatgattgtactggaaagcaaattattttttttgttagttaaatattgtaaatctaaagtattttatttcttactgtgttttttgtgtgtttttccctgtaggcagtaaagagggatatattgaacacagttgctgatcgttgtgaaatgctatttgaggatctgcttttgaatgaaattccagaaaaaaaagttatgagtataaaataagtacttttttgcgtatcttcaactgatatagtaataagatatcaagatatagcagatacgtcatcttttatagctacctatctatattttcaagcagtatatcatcttttattattggatgaaaatttttcagttgctactcagatttttttttttttttttagacagagtctcactgtgttgcccaggctggggtgcagtggcacagtcatggctcacctgcagcctcagcctcttgggctcaagcagtcctcctacctcagcctccctagtaggtgggcctgcaggcacatgccatgatgccttgctaatttttggtattgtttttttagagacagggttttgccatgttgcccaggctagtttcaaactcctgaactcaagtgatccactgtctttggcttcccgaagtgctgggattacaggtgtgagccaccatgcttggctctagaaaaacgttttagaaca

SEQ ID NO: 57546 - DNA, 1037 bp, Homo sapiens
taaatatcatgtctttagattttttttaaagctagttctgtttgacacttcgaaatattaactgagacattttaaaatacatgtttaatttctacatgtctagacatacagtgagtatttcctgggaaattgtaccaaaatttaagatactaaggtatttttcaagcttagcaagtagatcttaataaaacaagttcaggattaagtaggtaaaattacaaagctttaaggtatttctttcaatataaaagttttctcaaaactcattatcttacttggtaaagcatcatgtcagaacagaaggttttaaaacactaatttattaaacattttctccatattatttgccttttttttttcatatacctttcatgtaattgggatactaagccaaaatgggcagttccagaaattagatgacttttatagagcatagatttgctttactatccaggttttgtaacacatttttttttccctagccatcactttcacatttgactttatactttggaagactgtttgggttttttgctttctttttgtttctagtgagttcagtgtatgaaaacatgtctataaataaatatgtaagttccttttctgatttcttagttattctttgcatagttaattctcccttcaggaatagggtgtttgattcagagtgtgcttgagattatagtgagtcaagtaagtatttgattggggaacttcaaatctatagtaaactgcctcaagttagttgcaaaccaccctttagtttttcagcaataccagatcgtgatgtagagcaataagcttgtttcagtggggaaaataaaatttctaaattgcccaatgcctgatgttaaaataaagaagagctactttctaatcccatgaaaactaatatttttaaagatacaactctagcatagttccatgaaaactaatatttctaaagatataactgtagcagatggaaagtatctgctttttgaaagtagactggtaaaaatgtttactgctttccaaaatttattttccttggttag

SEQ ID NO: 57547 - DNA, 1285 bp, Homo sapiens
acacaggtggctttatattataatgattgagaactactgcctactggagctgccgttttcttttaacctacgtagcataagacagctggtatgccaatataaatatttatataagccctttaaagtgtttgttattttttctcttagatacgtctcagtgcacatgtgtgcaagagagatactttgtccaacatttgaaatctagtttttcaactaattgctgtatttttctctaagatgttgctgccttttagtatatacatatgtatgtctatgtatgattgtgtgtttgtgtattgttttttaggcccatcagttacccacatttcagagcctaggattagtttggcctttcttttgctcattccattttcatttgttctgtgtttgttttacttttaggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttg

SEQ ID NO: 57548 - DNA, 1745 bp, Homo sapiens
ttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaataatgtggaatttttaaataaggatataattgtaaaattggataatagctgctggctggcagaagggtgattggaattagagtggtctgaggttcttttattcagaaaactggttaagatactgtttaaccttaaaattgactatgttataataaatatgtgtagtcaagagttcaagggtaactgccacaacaatagataggggatcggccaggcacggtggctcacacttataatcagcacttttggaggctgaggcaggcagatcacttggggtcaggagttccagaccagcctggccaacatggtgaaatcccgttctaccaaaatacacaaaaatcagctgcgtgtgatggcatgcgc

SEQ ID NO: 57549 - DNA, 2470 bp, Homo sapiens
gcgcctggcccctaaacttcttaaaagaatcaggggtcaaatggaaacagagaagttggcagcaaattgagcaaaagaatcaaactgttttttattttgtgaagtttgacattggttgtatctctgtcttcatcgccttcacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataatgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatatcttctttggggttacctctctgaatattatgtaaacaatccaaagaaatgattgtatt

SEQ ID NO: 57550 - DNA, 1030 bp, Homo sapiens
ttgagtggaagaagttgttttaaatattctagtcagttctttcctgctcccaggaaagcccggattatgttttaagataagcaaaatgtcttaaaagtaagctgttttactttgaatttttccctaaatgttgattagtgtactagatccattttaatttggaaagtgaagtgctacttatttgaacttcttaaaaatgctaattttaacatctaaagagttaactaagaaaagcttagtaacatgatgtaccaagttgaatatgctgttatccttatttagaatagaaaattggtatttctacgttttatccattctaaggcaggttaaaaaattgtatttccatgactacctatatatttcttgaatttattattgtaaagttgattcatagtcaaacaattaaatgtttaaattaagattaagacactagagaatgatttatttgctgtcctttaattgcagcaaatccttgctgttcccacccatgtcaaaaccgaggtgtatgtatgagtgtgggatttgaccagtataagtgcgattgtacccggacaggattctatggagaaaactgctcaacacgtaagtttgtcctttggttgcctcattaggagtggggctggatacagttatcattgtatagatttgtgtcttataatgagtcccattaatttctccctccctttcttcgtcttcttgcagcggaatttttgacaagaataaaattatttctgaaacccactccaaacacagtgcactacatacttacccacttcaagggattttggaacgttgtgaataacattcccttccttcgaaatgcaattatgagttatgtgttgacatgtaagtacaagtgtctttctaaggtttttagccttctcaaagaaaaatatgctttataatactgtaagcctaatctaaaaacatatttccaagcttatcaaaaagactttaagatagcttttaagtttgccttccatcttaatcgccaaaaatattgacatttagtcccatccagtttatacag

SEQ ID NO: 57551 - DNA, 1012 bp, Homo sapiens
aaacaggtagggttcccagcccaaatgacatttaaactggtacctaaaggagaagtatcttggtcatgagagcaagaagtcctaggcagagaaaacagcgtgttccaaagcaaaaagaccagaatgcttgtgaggagctagaaccgacccaatattactagagaatagataacggaggtgggggctggaagggcagatgagactaggatgataagccctggtaagacaaagacttaggactgagattttttcattaatgcaatggaaagaatttgatggcatttaagtagtaagtcacacaactgaattttcatttttcaaaatgttgtgactgtagtatgttaaatatattggagaggaatgtggaaaataggtttttcttttttttcaaagaacaggagggacttcagcctgttgaaatggcaatgaaaatgccagtaaagagggaggagttagatactaagaaaagaaagaatgtgagcttaaggctcatatcatcagtgaatgaggagagtccaggaagttggtaaatgtctgaagcaaggagaggattgttaggtagaatctaacagcaagagttttggctgagcagtggttttcatgacaggtgaggagagcaatggcaatttcttcaaaactagcttcgatcagatgtttacattttaaattttatctcagacttcagtttaacccatctaatcatccctttattaatatttttctgaagttattcttattttgctttttacagttcttttcattttcaccattttaaatgagaatttactgaaagaaaggcccctgcgaaagagaagcctcattagaagctgtatttagacactattacccaccatactcttaagaaaaggcgtgcgttttacaaccaaagaggccacgctgtgtgttggaaaagccattcttaattccactaaattctgtgtcagtagcttgtcaggcatgcaaaagacagagctaatttgactttcaaaaatacagctattatctgttagat

SEQ ID NO: 57552 - DNA, 1030 bp, Homo sapiens
agcaatttttatttcctaccatggaaaaaacattttaatcagaacaataatgcacgatattcaattataataacaaatataagttattggttaaaaaaatctgatgcaataaaatattgataagtaaacaggtcaagttaattaatagaagaacagaaaacgattaaattctgtaataaggtgacatcaattttacaaaatgaatagatctatgactatcagaaaaagaaaattgctaaaagaaaacatctttgatgtaatttatcatgaagacataactgaatgctgaaaaggaagtgcaggaatgtacttcaatagataaggttagacttttcctaacggattcaacacatcccttgatattcttgaatacattgttgagttcactttatgctgccagtcaactcttgaatattcatattgttataataatacatcagcacagaaaggcaaagtttaatctgatagtagctgtggttttgtctgagacacagtcagtgaaggaaagtcagcccctgatgagtaatggagtagagataattgactacctgtatagtgaaaagtggttatttggagatgatcctcaatcctaatttagacacgtatagtcagaagttgattaactgcaatattctaaagccaacattttaatccatagagaaataattaaatactactctgtgccaggcacaaccatttgtaagaaaatggtcaatagctttctttagcattagggtatctaatgaacaattaagcaattaggtaattacttaaagaattcctagggtcattctaagatgctaaacattaatatttctgaatgagaaagagatacattcatttcaacaactacttttaaatctgcttcctatatgcattatttacattattaacacatccaaacaaaccaaataataaggtcatttcaggtgagtgattacattaattaaaaataagttgacagaaacaaaaggtcaaatttgtatcatgaaaaattaatgaattaatttatcaagagaacaaaatgtat

SEQ ID NO: 57553 - DNA, 1034 bp, Homo sapiens
acagttaaaatatataccaagaagtcattaaacattttcaaaggtaagcataaaaattacttaaacaaataatgaaattgttgaatatttacttttccaaatcacatcaagacaatctgttgataagacaaagctgattttattcttaccactgcacgtgagtgtattaccataacagagactttaatagtagggcagagaggagaagggaaaattgaaacattaattgaagttttatgttttttaagtggatttattaatgtgggcaatgtaagacttcattaggattagataaggaccctggatatgatagtttaggattactggacagagcaaaagaaggattaagtgaagttatttgaaacttaccttcctaggcaagaatttcctggaatgataaagttatgtcgtttaagatgttaatgtagacagtaggttgtttgcatggaggctgtttgtgtctcacaactctgtggttttgttggaaatggagaaaagcccaaaaagttaaataaattgtccaaggtcttgtatctgttggataagagaactagaaaccgggtattttcacaagtaaaatttcaaaatatttcatattttgattttttgctgaaaaaatccattgaagtcatttactttttaatgaaaacatggtaatataaaaaccaccatttaaagaagtagccagtttaaacaatattgattatacagattgctttgagcaatactcaggtgaatatttgccttcataaaatgggcagatattgtaaaacttctgtaacttatattgtaatcgcttatgtatctgatagtattacccaaggctatatgtttgttgagagtaaatatagtatcttgtttattattatagtttcaggatgtagcacaaagacatgtgcataacatatgctcaataaatacaataatgacacaataagagcttccaccagatggcacccagtgtctgtagttcagattaacttatctgcttattttcagctatggtcaattgagtcaattgagtctcatgattc

SEQ ID NO: 57554 - DNA, 1059 bp, Homo sapiens
gacactaagcttattccttggattcattttgacttcactttaaagacaactgaaatattttctcattgtttccaaggggataaactagggtctactttggacaacaaggcgatttatttaagttccctgcatatataaattctatatatatatagagagagtatattatatgtatgcaggcattatacatttgtataggtattataggtacaaattcaactatagtaagagtcggtttctgattatactctaagaaaatgtttttaaggaggagaagaatatcacagatggctttgttatattttgtatgtaaaagtaatataaagcttttataagtgcacaaaatggaattttgaaagaaactggacacagaaaaattaagtggaagctttattaaaacctaaaatcatgaaaatctctaagctcttatttctatgctcattcttcagatttatatcaccttctctgtatcaaaaactgctattataaaattagtttatttttattctattttttattgtagagtactagttaaatatacaaatacatatatatatatatatgatgataatattagggtaatgtgctttttaccattttattttctaaaaaggaagaaaaagataataaagttaagtctgaaacagtacagattataaggtattagcatagtgttttcctgccccagatacacacacacacacactcacacacacacatgcacacacgcatcacttcaacatcaaggagaaaacttcttatgggcagagaagcttgagtctgttttccaaaccccaaattcaagtgcctacagcatcacatgctaagagccaggtggcactggcatggtgagaggggcttgcgccagaggagaagacctctggaattatgaaactcagggttcatagagaatgtgcaggcacatatatccatccttgcctctgaaaatgaatagccgttgtcttttactctgaaatgtgaacatattttctcttggggtgggggaaagggctctaacttggaatgtaggcagtgggcactgggtaagataaaatattt

SEQ ID NO: 57555 - DNA, 1056 bp, Homo sapiens
ggttttggggtggaagtaagcttatcaaagaatagaaggtgattgccttggtactgtgggcaatgtggttcacttagtcctgggtgctgcagcagacacttccatcaatgcccaaggatcttttggactggaatctgagcagatggtgcctgagagctcagctctcttgtttccccttccctgatcaacttctccttcttccatctttctcaactctcttttcttggaacctccgtaagttagaatacagaaataactgctgcagtgttgtcaggttgaaacacgttccccattgattggtggtctcttgcactggacacagttgtatagcttctttttgcctgtggacccaatatcagctgcatcctcctaatctcacttttgagtttattttggaaacaaagattggaagaagattttgctctttgttttcatttccattatttagctgatatttttcactcatttttttttactcataattgattccttatctaaggattaaaaagtaatttcctcagctctactcatagtcttgtatcattgtaatggttttactactgattttttttaaaggcagagatagatgaataaaaataaggatttttacaaactgtgcaaccatgggtaaattacttgacgttgagtcaagagggatcaatgttctcacctgaatcacaggagtagtaatagcacctgactcactgggttgttgtggggatggaatgaagggcattatgtaaagcaattagcaccttgctagaagtagtaagtgctcaatagaaggtagctattattataattgctttatattagattccgtttcagtaggtcaggggtggaggctgagaaccagtaccttgggtgatcctgaagcaacccatttctgctctaggcattattccctatcttttttaatattaataaagtaaaaaagattcatagactcaaatatgatagtggttatgcttttcacatccagtgattaggaaacacataatggcaaagttgccctgaatgtattaatgctttgaaataaatttgtatcttttagtt

SEQ ID NO: 57556 - DNA, 2152 bp, Homo sapiens
tttgaggacagaaaactttgtatgagatgcgatacacatatcaaattacaaattatgcttgttaactaaaaacgttgatgttggcaattaactttattatttttaatatgacacacagactatttgctcttattcattctaaggcacagcactgttttatcatactgttaaataataattatactacctaatacattacaaaaagagattgtaattgttttaattgctgtattttttatttaaggacgttttaaaaaaagttgtataatgtagaagtctaattcattgactcttctgaagtggcacagtggaaaaatattgcattgtagtactctaaaatcttgcttttagaaatgtcttctgaacaccagcagaactggcatcatctgagagtttgttagaaatacagaacctcaggcattttactaaatcagtctgcattttaacagggtctctaagtcattggtatatacattgagaagcaatgctataaagcatatgtctttgatctgtattgaggacttactgtatactagctgtgggactttggtcaagcttgataacatctataagctctggctttttcatttgctaaagaataaaacaagtactgtgttcaagctatataattgtaatgaagatctattgaactagtatgtaaaaacatttttttttaggtcatataaataaagtttgttgacaccaaggatacataatcctttagtgacattatgttaaagtcacttaaactgttatgttaaactcatttattcacatttgcagaaactaatgtaagatttttcttatgctcatgtgaataggaaatgggcaaatatgtgtatatatattgttttggaatactcatgaatgagtttgactttatggaatttttaaattattacaattataataattcatttcaccttcagataggaaagaactgcaaaccaaacatgatcctttcttagggcaaagaataactatgtaattgtccaggaaaagtttgttataagtctcaagttataaaacataatgctttagaagtcttataaacaatgtatttcaagcctttcagcttgagaataccctcttaggcacattttattctaatatagtctaaaactgacttttaaaattttgtaacatactatttttaatttttaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatct

SEQ ID NO: 57557 - DNA, 1102 bp, Homo sapiens
gaataagtaaaatgcagttaaattgtttttaagttcatactgtaaatcagtgtttctgaaagtgaacatcagtggatactctttaaaatacatgttacctggcccctccccagatattctgatataggggaaggattctttaataagttccccaagtgattctaatgcaactggtctgtgtaccacagtttgagaaacactttgagaagacactactaggcaaataaaattttggaccattaacttaaagacgagaatacatggtaggtatattttccttattaattttaaagtttacaaagcaaagattgatttcaaccaagctgtttcatgttatacattctaaataatatgagatgtgagctaataagttttttgtgtatattaccttattgattgaaacatgtgacccaacttttagcattaaatgtaaaaattattgcagaagactgctaaatcttctcttttccattataggtttttctgttcatgcatctcagggtgtattctaagatgggaaactgtttttaaagttttagattaatacagggtcctgtggttctcaaaattgcttggttaacaagaatacctagatatgatgttattaatcatatcaaatgtttttctgttaaaaatattaaaataactataaaatgtgctaaatatgtgatacatcagattttaagttagataaatgttactagggactaggacccttagataaatattaaatgtataaattttgcattaaaattgatctgtgaacagaattttttgtgtgtgcaaattagtaagtaaaagaaccactgttgtttgatttttaattacactatatccccagatttttttgagagcatagttagagaacaacagcttgtcagcttaacattagaataattattccttagttcacattttttggacacaaggtggcagcatataaatacctgatgttagtggaacaccaactctgttgtgtttgccttcattttcttaaggaaagtagttattgaccttctagttgcttatttctctaagctgttcttttattaatattccagaagcaatattgagatagatttatttcttatatacatgcaat

SEQ ID NO: 57558 - DNA, 1033 bp, Homo sapiens
ccccctttcgataaaaaataatctgaaggaaagattgtgcttgatcacaaaataaagctggtctcattagactttgcctgattatttgcacaggtgaagtagcaaatgttaatttagcttgtagatgtttagttgtttttataaatgacattttcataagtaatgttagattggacttttaaaggcctctattatttgctaagtcaggggcaggaggcccttgcccaagaaactccctccacatgttttattgtgttaatttttattctcagtgggaatggaatctcattatttctaaaatcattttcttatgagaatggatataccatttctattttgagttggatgcaaagaataaaatatcaaaattagcagaaatgtagttagtgtggattgatgttttattttcagattgagaatatcagaaggaagcataattatctgcctttcattatggaattgttaaagactttagcagaacaccagcagttaataccactagtagaaaaggtaagtattttattggtagatacttaaattaagtttagagtctccaaaaacataaaatgtattttttattttttgcttgaatagaggtaaaatttttggaagcttgtacgtttttattcttttgcttttgcctcttgttttctactctgtaagaattagttcaattgagactgtaaaacaaaaataaagaattaccccactgctttaggcttccagattcttagtgtcaagacctcaggttatgctgtattaaaataaaatttaaaacacttcctttaagcaaaagtagatttttaatgctgataattgaaataatattttcctatttagcaaaaatttgagttgatataacagaatttaaaagtagaatggacattgttgggtttaaaaaaaaaatagcctgtactacgaaataggttttcttatttctaatttagtatccattccactgagggaaaactagcataagttagtgaagaattctgatttctatgatttttttcataagtaacaataaaatatt

SEQ ID NO: 57559 - DNA, 1039 bp, Homo sapiens
atttatttatggaattgaaacaacataattatactaaaaagagttttactgctctaaatttattaaaatatttgtaaaaaaatattttgggccaaacttttgcattttaaagttgattgttcttatttttatttgtgttaactgttttaaaatttctttctaggtgcatgcaatcaagatgattggatcagtgcagtaaggcctgtcatagaaaaaaggatacaaaagtaaatgctcagctaatctcattggcataatattctgttttttaagtattttttaaacttgtattttattgttattttagcagtgtgcattgaacatctacttttttttttctttttaatttttcgtagagacgggttttcaccatgttgcccaggctggtctcagactcctgagctcaagccatccgcctgcctcgacctcccaaagtggtaggattacaggcgtgagccactgtgcccagccaaacatctacttttgattgggttaatgcatttaagaagtctatttcagaaaatctctaaatttcatgtagtagtatgtcatcttgtctttagagaagttaaacatgcagatttccattaagttagataattttttattttcttttttttattttttgagacagagtctcactgggtcgcccaggctggagtgcagtggcacaatctcggctcactgcaacctctgcctcccgagttcaagcgattctcgtgtctcagcttcccgagtagctgggattatgggcacatgccaccacacccggctaatttttgtattttcagtagaggtggggtttcaccatgttctccaggcttgtctcaaactcctgacctcaagtgatctgcccaccttggcctcccgaagtgctgggattacaggcatgagccactgcacccggctaggtattttgtactgttggataattgacagttattttgtagagttttatttttgagggtttatttttaatattaagctctttattttggggtaattgtatattcaatttcagataattatatatatattc

SEQ ID NO: 57560 - DNA, 1445 bp, Homo sapiens
aaatatgtggacattgtataccctgtttgggaatttaaatgagggtggaaactaatgtgagttgggttcagaatttctctacaatcacacaggtgaattgaagcttatgctcggttataaaatactaattgaatttgaataggtagaaatgagtctaggaggaaatgaataggagagggggacaagctctgttggcttaatcagctatgttttccatcaggatgattgatcttgttaccctaactggattggtttttggtaatattatgagttcattgagttcatttggtttcctagaattttcaactccagaagtgcagcaaatttctgaaaatagattaggatagaaattaaacatatttattctgtttatgctgagacttcataaaatataatttgaaaactgttcatgttttggggccattgtcaccagttaaaaaccattttttatttttttaaacacattgatatcttcacttttatattttataggtaattaataatgcttgtgctactcaagccatagtgagtgtgttactgaactgtacccaccaggatgtccatttaggcgagacattatcagagtttaaagaattttcacaaagttttgatgcagctgtgagtacaatcttcttattcctaaaatgtcatatttgtgaaagtttgtatattaataggctactttaaaaaattattttagatgaaaggcttggcactgagcaattcagatgtgattcgacaagtacacaacagtttcgccaggtaaagagactttatgttaaataaatactgtttctttctttgcttctttgagtttcactatttttttatttactgtagacagcaaatgtttgaatttgatacgaagacatcagcaaaagaagaagatgcttttcactttgtcagttatgttcctgttaatgggagactgtatgaattagatggattaagagaaggaccgattgatttaggtaatgcagttcctgttcctgatatttcacttttgacaggggaaaatctgttgggtatttaccctcattcagtgctgcttaaattttcaaggtaaaagtgactatgaggtaacataatataatgaaggccttaagctcttcagtgtgttatattaatatataggaaggacatcttgactaccatagttcagttgatgcctttgagtttttcccaagtaaaattattttttaacctataggttacataatttatattttattttccatttaacatttaaaaactacccttagtgaacgtaaatagttactcttgtcatttttaacccattcgtaagggatagcaagcatttcttaacatccgtattaaagtattttcatttggaattggataatttattgttttgcaatcaagaaaatatttttcttaaaatttctctatttaaatagtgcgttaatgtgttatcctttctgcaa

SEQ ID NO: 57561 - DNA, 1045 bp, Homo sapiens
cttaatttttcttcttctgtaatggctttgactcgttttagtattaaggttattctggcttcatgaaatgagttggaattttctcttatttttagtgccttgaacaatttgtgtaaaattaaggtgatatacttcttcaaatttttgtagaattgacctgtatatccatgtaggcctggtattttctttgcgagaatattttaaaatactgcttcatttcagtagttaagggactattgtggctctttattttttcttgagttggttctggtaagatgtatttttttaaaagatttcttcatttcagcttaaattttcaaaatcatttcatacggttgttattaatattcttttattcttttaaatcttattttatttttagttatatttctaattcctagatttctcacttgcatgtttgtgtgatagtggttttatgtattatattaacctaccactctttattatttcatacttttattagggtaggaacctggctgatcttatttctccttttagccgccttcagtccttcctgtaaattgacttaaactgaatctttctgaaccactgttttgattattttatttctatattcaaaatgtcttactctttgggtaaactcctaattactcaaggccagtgacttaacaaggtaaagaataaccccactatgactataaccacactagtacaaatgaccaatatgctcattgtctcttgaacaacaagcacatcaaacatcttaatttgttcttttgttcacactgttctcactttttaaagtgaatttccttctctattctctagttcctaccaagctttcaaacccctattaaaatttcacatttgtgaaaaaactttctctgatactccagtataaaatgattttttcctttactattttgtttttctggtgttcatcccttttttctgtgtatctttctttatagagtcttcatgagcaggacatttatactttttttcagtatcactttctcttgggaaagctactgttacattctcaacctttttccttgactat

SEQ ID NO: 57562 - DNA, 1010 bp, Homo sapiens
gtcacatagacctggttggccacccatgtggctggaccttagtctccagccccacaggaggttgagctgataatcttgacccaatacccccaccctaagtcacattattagactatcagtgtggcccaaagctctcaggtaaacaaagactcttaggcattcaaggacttagaactcatctcccaggaaccaagggcaaagcccagacctctctttgggcaaggttaatttctttactatagtcataaaagtgggacttcaccttgtcagagagaaagcctctctgagtaagtgacagttcagctgaaatctaaaggttaagtaggtattaactaggggagagaggttcaggatcattccagattaattacagctttatagcaaaagtgagtaagactagtaaaaggtacaggaagaagaccaatgtagctgaactgtgcagagcaaaggggagatgtcctgagatatgaagcagaacaggaaatatgttagccaggatattaggtacagttaggcataggcataaaaaaaacaatagtttataagaaataggtggtttttttttttttttttttttttttaatattcaagagctgtcaaggctccaggctcttttgttttgctcctttgtgtatgttttctattccaaaggttatttcatggtccaagatgatttctggggcttcagccattctttctcaattccgtattcagacaggaggaaggggaaagcacactcctttcccttttatagaatttgcctgtgtcacatgtatgcttgtctctggccaaaactcagtcatttgagttagcagtagaggacactaagaaagttgtcttcattccaggtggtcatgagcctagataaaatttatgtactctagcctacagatgcagacagaggtcagatcttacagggtattttaggctgtgattgagacttttgtctttatctttagagtaatagaaagttactgaagtgttctaagaagagtgtcatgaacagattt

SEQ ID NO: 57563 - DNA, 1569 bp, Homo sapiens
atcctatcattttggaaggctgaggtgggaggatcacttgagcccaggagtttgagaccagcctgggcgatatagggcgaccctgtctctaaaaaaaataaaaagttagccagacttggtagcacacgcctgtagtcttagctattctggaggctgaggtgggaggattgcctgagcccaggaggttgaggctgcagtaagctatggtcatgccactgtactccagcctggtcagcagagcaagacctgtctcaaaaacaaaacaaaaaatccaaatagtccatttgtataatatttttgtgcttatatatcattatacatatagtaactataattttaaatccacagttgtttgtaaattttaagatctacgtagtagagaaaagctaggggacagatgagtttaaaagtctgtgaggtgatttttctcctttttaaaaatgtttttattttttcaatgtatataagcatatatgccattataaaaatttaaacattataaagtggatgctgtagaaaataaaagtgtcttgtaatctctgctttagacataaccactgaaaacaatttatatttttacagatttttttcccatgtatgtttgtgtatatttgtgttaggttattcttgcattgctataaagaaatacctgagactgggtaatttataaagaaaaggtttaattgacctacagttctgcaggctttataggaagcctggtgctggcatctgctcggcttcttgggaggcctcaggaagcttttactcatggtggtaggcaaagtaggaacagacatctcacatggctgagctggagcaagagagaaagagagagtggggcacacatttttaaatgatcagattttgagcaacagctcacttaacaccaaggggatggcctaagccattcataagggatccacccccatgatccaaacacctcccaccaggccccaccttcagcattggggattacatttcaacatgaggtttgggcagggacaaatttagagactgtatcagtaaattaattaattgtgtttcttccacactaaactgtaaacctgggagttagggattttgtttttatattcagtccttggtacgtggtaggtatccaataaatgcagaccgaaccgttcatctctaagaatattactattaaacagtgctagaatttactaacactaagatactaatgatgtctgatttatagagacctagctacttttaaggtataagaaagtactctataaagaaagaaaaaaatgatagtagagtatgaatttataatttctggagtcccttgatattttttagttctgtgttacatttgtattattccagttgtgtttatgaaagtctcagattagtgattccccatatcattgttttggtactttattttgctaacgttcatattaaactgacaggtcaataattccccattaatatctgtcagtctttttagtatatgcctcctataagcctatgctaggagagttataatatatattacatcaatatgtaatagttgattttaggtttcaagggcttacagtaataatt

SEQ ID NO: 57564 - DNA, 1033 bp, Homo sapiens
gaggatttttcatgaatccaataatatatgaaggttacttcctatatttaatatagataatatatgctatcaaccgtttatctataaacatgttacatgaactttatatattttggagttcagccagcttctggttttactatattcttattttttaagtgaggtaatatcaggtagaaatgaatagtctacagatttgagaataaacctttcactacaattttattttaactgatataattttaagttgtattagcatcttctaaggcaacagtctagtaactatgaatggcaatagtgatcttttaaaaatttcccatatttacttcatttgtattatatttgttagataactgactaaaattttatagattaacaatgtattatgaaagaagcagggtttgatgtcattaatttgtattttattttgtaggccagttcatgggttaatttttcttttcaagtggcagccaggagaagaaccagcaggctctgtggttcaggactcccgacttgacacgatattttttgctaagcaggtatggtccttggatactctgaaaagtctcaagagcaaccctttttataaacaagactctagtttactactgtttgctactagtgtagtagtcctcaaactcttacactcttaaaaattattgacatctccaattacagtcttaaaaattattgacatctcaaaagagcttttgtttctgggattatctatcaatgtttgccatattagacattaaaactgaaacattttaataatatttacgccaggcatggtggcttataactgtaatcccagcactttgggaggccgaggcaggaggatcccttgagcccaggaatttgttttttctttttctgagatagagtcttgctctgtcgcccaggccagagtgcaatggtgcgaggctcattgcaacctccacctcccaggttcaagccgttctcctgcctcagcctcccaagaagctaggattacaggcacataccaccacaccaggctatttttgtattttta

SEQ ID NO: 57565 - DNA, 1223 bp, Homo sapiens
aggggaggaggagacgtgactctgaagtagttgaaaatatacagttggaattcaggataaggatcagaactaaagatgtgatttgaaagttactgttaagtattagttatttactttcccagaaaaaaaagtatagagtaagaaaaaataataataatataaggctaaagacagagctggagaaatggaacagttgagtgaaaagagtggatagaggtgccagagattgagagagagagaaggaacagtcatagagtggtaattcaatgaaaataaactcttgaaactctttaaattataaatatactcccactgtaaataattgggatatattaaagagagtaatgagatttggctgtgagctttattagttttaccattttgttttgtcatgtgttgcatttcctttagttaatattttatttcatgttgaaggaaaaaatgaattatcctgtttactgaagaaaataatttattatttcaggttgccgaggagcccaagtagaagaaatatggagtttagagcctgagaattttgaaaaattaaagtaagtataattttagttgtgttaatatgtatatatatatactttaacaaacttaaaggatattcagatttgtttgtttattttacttggattactctaggttgaatacgttatgtcctttaagtctcttcaatcctgtgagatagatattattattatttttttataactaagaacctgaggctgataggtaacttgcaagggagtcaaacctaaggctctgtaattccatatccacaaagtactggttagttgatttttttttttttttttttttacaaaattcacttatatatcaatagtgttagaacatggaacacattttaacataaaaagcaagaacaatagctcagtgtactaaagcatatttgatagataatatatatttatagtaatccagaacttgcctacacactatcacattacctctgggaaagttatatttaaagttccaaatgttgatgccagaaacaacttttctccttcccccatctttctgaccagaatcacctcttttaacttctccttacccctgactaccatgccctcaaacattgaccctgtatcttcaaatggagggctagaggaattttcactggtgggagtcttggagtctggaatggggtcagggaatcttttaaaagggaaaatagggacttaggaatatgctaactg

SEQ ID NO: 57566 - DNA, 1015 bp, Homo sapiens
ggagcacagccagaaggaaaagcataaacagtagtgatgttaaagtatatgggttagccaacagctagcaaagtgactagaacataatatagcagactggaggaatatttatttggatctgaaactgaaaagataaactgaggacagattgtatgccatgttgtatagtttgaattgccctgtagtgactggggatttacctatcaaatatattttaatgctgaaatgacattattttcataattaaggtttattgtgcttttaagtgtgcagggcaggttggaataaagtgagagaagctagacatctcttaaaatggttggagtccgagatgattggctaaactagtgggttaggaaggaggagttagattcaataagtttgctatatttaaatcaacagttgcatgtggtaatgtctgctcttcattcctttgggagcagaaatacatccataacacgctaaattaaaaaaggagttctcagggctgccaaccttacagtagaggttgagtggtagtatattactcctacataagagaaaaaaaatcaaaaggactgcttactaaaagttggggaaaaaaagaggcaaaaataactccctggtttctagcctgggtggctggtgaaacactcttacaagtgaagagcaggcttgatggacaagaaaatggattcagatttggacagacactgagtttgacatgtctgcagatttagtcatatattttacgttcaaaaccttaacaatatgttaaagttaactttcagaaatgttgtactaggtaagtttgtttttactccttcaatttcatatgtgcagaaaacttggagatcatgcatgaaagaatgatatataaattcatcttctgtacatgcacatatgaaaaatcagcagctattaataaattggcttcattagcagaagaacctgcaaacaattaaatggtggtagtttatgtcaccatcagatgcttcaaagagaaaatcagtttattccaattatttccatcatt

SEQ ID NO: 57567 - DNA, 1605 bp, Homo sapiens
ccgcctccgccccagaggggcgaggatcccggatgttgcctcctcggcgctgtgaatcaccgccctttcttctcaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggtgagaaccaaggggaccgtcctgggcctggggtcacgggaggaggcccaagctgggcatggagtggttccctgcggccaccgccgccccgcgtctggagaggtgacttcaggaacctggagtccgggtgggggaaatgtagatgttctgccctctcctcagctcgagacagtcgcgtttccacagtaatttgtagagccacaccacgagggcaaggatcgtgtcagtcttgtgcctgctgcatcctcaggacctggcacccaaatcctgtaattgacttgagggccctcgctccccaagctcttaagcacgtattgccctttgcactgccccttctctgcggcgcgcaccttatcccgggctggtgaggtcaagtgcattgctcaggccattagtcctgcagaagccaccctagggtgcgccttctcaagggtgaggtgtctgcggctcaagccgcccaggaactcgagattctggttattcaaagcagaacgccttgaatgtgtgaatagctcttcgggacgtccacacacgctgactgcgtgggcctgaaaggccacttcactggttccgctctctgctcatttctggcttccggtgaagtgagttttcttgagctagtgttctagactagaggccacatgctttcctcacagtttctctctggctgtatttagtgcctttcgtcctaaataatcaacacattttactttttatccttccctatttatcttgttcttagtctcttctttggacagtacgtttttatctatttcccaagtgttattgactctacgatgttaaaacttttacgcgggattaacaattaaacgttgatgtagatattgcctgttgtacacagcttaatatttggaatgtcatttatcaagcatatgttgttcatcttctatatctcaggcacagtggtaaggattgggaaattttcttttttttgtttgagacagagtctcgctctgtcgcccaggctggagtgcagtggcgcgatcttggcccactgcaacctccatctctcggggtcaagcgaatctcctacttcagcctcccgagtagctgggattacaggcacgcgccaccatgcccggctaatttttttttttttagtagagacagggtttcaccatgctggccaggctggtctcagctcctgacctcgtgatccacccgcctcggcctccca

SEQ ID NO: 57568 - DNA, 1221 bp, Homo sapiens
aatctctgaaggagcacactgtatctcaaaaatgtgacgccttagttgcttctgattatcacaccactgtggctatgatttgtttgtttgctgtgaagggcttttagtttctttagattataaaaataggaatacaaaacaaaaacactttaaaaactgaagatattactggtagtcatttcaaagtattcagatatggtttttttctttcattttctgcctttcctgatttttcttcaggacatttatattgattttgtactaagggaaaaactatggaacttaaaagatgtttttaaattaaaagagttaataacatttcagtaaacctacattttgttttccttttgtaattttattgtgcccatctagttgtaataacattttgcctttttgttaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggtaagcataagatcttcattgggaagaagggtgggtaagggatattcaataaatagcaaatttttatttaacataagacaagtgtgtaatattttctagaaatagccttttattctcaaaatatacattaattcaaatatatttaatgccttcctgggattacacccctaccacaggcgatccagacattaataatcaagaatcaaatgacaggtttata

SEQ ID NO: 57569 - DNA, 1069 bp, Homo sapiens
agtgtaaaagaagctaccctgtccacttctacttatttctgctgtttttgtaaatatatatattttattcaacagcaaaaagagacaagtgaatataattaatataatataatacattacaatacaatacaatattaattgagatagatctgtactctcgtgagttgttctgagattatggacctgaaactttctaatgctggtgtctttaaaaagaaaagaaagaaaagcctctgtaacaaaatactcaggatacaggtttttttactctaaagtctcatatttaaatagtaatgatggaataagaaaattaattcaccccatttgcttaattgttatatcatggaaagcagcatcccagtgtaagggcattaactcttgtgtatccagttatgttgatcatataatgcattttgaggaaacatgttctgtttttttacttggtaatcctgcatgctttttcaattctttatcttgttaaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtgagtgaattatatgttacagcatgtgattaaacatgagtaatttagtgtaggtgctaaaaggataaacttggggtagctatatatttatacttttaaaaagaaattatttaaaatatatcttgaaattgatgtctgtttaaaacacctaccatgatgtccaacatgatgtaggtggcatttgtgttagtttcactccagaaaatctactgccttgctaattaaaaaaaaaatcatctatgcatttccttcataaaatatacttcacatcctttttctagtaaaaaacaagttagcttatttgataagccttttacttagacatttttcattctgaaagtactttgaaccccaaatgaaagcct

SEQ ID NO: 57570 - DNA, 1285 bp, Homo sapiens
atcaaagtcatcagccaaaagttgatcatcccagagatatgtccttatatatactcatacacactgccccagcatttgatatgttgataaaaatatctggcacccttaataacctgacaggtttcataagtacaaagtgcctaggctgctcaataatgtacactgcagcccatagaacaagtaaagtaattgaagagagaagtagaaatttcaggcagattcttatacaattttattgtcccttcttctaaaactcccatattctagccttaaaagattgacccccgcaaaaaaatgactttgtatttaaaaagctctggtagagaaatgttaaagtgttttaattttggaggtattttgcatttccttacatttatgtttttaatatgtattttggtctttttctacagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgctttttttt

SEQ ID NO: 57571 - DNA, 1051 bp, Homo sapiens
agtagaaaaatagaatgggaacatgtataatcttgtaattcataggaatcctcaagcacaattaacctgtgttgctatatatatctacatatatagagaaaaaacaaaaactttacctcattatgaataaaatgtactgaagtgataagttttttatttcctgagttacttttaggattactgttaaattaatatttgggaaaatactgcttttaaaaacaatcctgcaagaataaacaaactttatttcctaggtagtatgtaaatagttccaggatatagttgtaattagtaaaacaaaaactaatcttataatcccaccctttattagttgaaagttcttggaaattccatttattaatacttatattatttagtaatctatcttatgagagtgttagtgaggcaagatgctagtgaatggaatttagtgttaccctttgacacctcctttgctttatctaacttactgtgtgactgtagacaaccagtttaacctaagtgatttgattatttttatccttaaaaagtaacatatctgtgcttggatcatagaagaatcagtgatttaatatttgtataaaaattgaaactgggaagagggcttgcaatacaagttagaattctttttttttttggttaaaaacattcttgttaataagatacgtatttcaaaagataaaatgttttagaaaaatagctcactcaataggcctaacagtgttttaaaacattcctgttcagagtagaaaaatttagaagaaaaattttcacagctaaagtattacccaaaaagtcactattctctactgaagagggagaaaaaatatactccaagatcttcttggacagacctagaaaaacaagcttatactctgaggaaatgctgttaacaaacttttttttttgagacaggctatccctctgtcacccaggctggagtggcatgatcacagctcactgcagccttgacctcccaagttcaagtgatcttcccaagtagccaggaacactggtgtgcactgcactaccacgcctgcttttttttttt

SEQ ID NO: 57572 - DNA, 1048 bp, Homo sapiens
acttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaa

SEQ ID NO: 57573 - DNA, 2154 bp, Homo sapiens
gaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttctttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaacaagtgtctgtctatctct

SEQ ID NO: 57574 - DNA, 1130 bp, Homo sapiens
actctttcccttcagtaaacaaatgtaagaaataactaaatattactgtttatctgctttagtttatttaaagctttagtaatcaggaagaaaggttttagaatcagattgtttggatttgaatcccagtctgtcatgtaccatcattgtgattttgtgcaagttcctgtgcctcattttcctccaaaacagggctaaaaataatacctaccttaaagggtaaagattttaagatttaatttgtgaaagagctttgtggtgccaggctcataaaagtacccagagttcaaatgtctcgttattatgtgaaatgatcttagttctgatactagagtaaagcctaattcttcttttgtttgtccaacaggttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcttcttcccacttgccaattcttgagaaaaagggatggtattaaaaaaatgaaaggttggagttgtatcaagataagaatgtattttattaggaatttagatatgaattttacaaccaagagctagaaggtaagcatttggaattctttatttcctattcaggagttaactctttatctcacatagtttttaagtggtaaggactgatatttgatttctctttaaaatttaaggcttttgctgatacacttgtgaactaggcaggaatatcttatacgatattgtgaaaagccttcacactttgtacttgtagagtaatagaagtatattaaatttttagcatggaatgaaatttatcttagagaaactaaattactcatttaatgacttaatagttcattaagtcattaatgacttaatagttcatttgtcattaaaactatacctatgggcagaaattaaaaggagaagatt

SEQ ID NO: 57575 - DNA, 1001 bp, Homo sapiens
gtcgtaggcgaggacggctgttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggtaagtccggcatggctgtggcccaggggtggcagggcagagttgggcgcccccaggcgacctctttcttaacccctccccccgtttcccctggggatgggataaaacgggtgttcggggaaaagaaagtttctctctagagcagaagttgcacttttagggtaaggaaagaaggggcggagctctagagcagttcatcacttaaaatttttgagaagcccaaaggaaaggtaccgtgggagtttctgacttttacagttaatttttatcagtaggtatgtgtaccagcgaagtgtgggactggtgcgcaagggatacctgaacataggtgcacaaaggagcacaccgtctggtgccgtagacgcctctttttgttctttattttttttttctcttttccaggctgctatgtaactatctccgctggtctttgcaactcctggtttatttcatctcctttcattgttggggtgggggtgattcctgtagaagagaaaagggaatcaaccctgaagttaggaccggaaagaaatttggtgaatttggaagagtcataaaagtctgtgttagagaggtcttcaggagttggtgaaatgagtgagctttacagatctaagaaatagatggtgcgtgtgatttttcggaagtgtattttaaagggaaatgtttgggaatgttggtccatgtgaagttttatcagtttaagtcattcaggaaa

SEQ ID NO: 57576 - DNA, 1058 bp, Homo sapiens
agccaagaaaattattaaaagtaacatgtttaatacattttcaggatttttattaggttcttttagcctagtcattttgttcaaatgtgatttaaaatatattgtatcaagatatattggaataaaattcagacattacatgttaatatcaagttgtaagaaaattattaaaagtaactaacatgtttaataaattttcaggatttttattaggttcttttagcctagtcattttttacaaatgtgatttaaaatacgttttttcaagatatgttggaataaaattcagacattacatgttaatatttattaagttgtgtatcattgttattcatttcatatctcatttaaaattttggttttagactgaaaatattcctgtggttagaagacctgatcgaaaagatctacttggatatctcaatggtgaagcgtgtgagtactttttaaattgttcccagtcttaaacagacattgtttcttttttcccctatgaaataatgattagagggaagagaatttgtatttccaccaaaaaattaacctaccttcatttttgtccatgtgctcacctttttcttatacagtggatgcactgtctttgcccttatggccagtcaccccttccttgtgtgtggattccatctcctttcacagtctcaaagactttgtcttcgtaaattgttgtttctctgacatcatcagttttctactttcttctggatcattcccttttagaatacctacagtaagatttcatgtttaaaaaatgtttttgatcccacattcctactgtctactgcttcatttatctcctccctgatactgtaaaatattctgcaagagttcgtgtggtatcattgcttcttttttacctttgtttctttcttgaagccactctagtctggccttcatccttaccatcccactaaaatcactccttgtaaggtcaaaactgatttaaggattgctacatcctttggtctcttgtaccatacttgacctctcaacagcatttgatactgttgaccactcatttttgaaagcctttcttcatt

SEQ ID NO: 57577 - DNA, 1052 bp, Homo sapiens
tgttcacctctcagtttattttggttacttctgtacctgacctctaattcttgaagtttccaagacttgatctttttttttatcttttcttttaacctgtattctctaggtgatctctttcagttttatggctcagatatcatatatatgctgatgaaatttcaagtgtttttttcagcattgatttctttcagggcaccagatttataaatttactgtcaacatgtttccttgaatgttgaataggcatctgaaatttaacactgaaaatggaatgcctgattccctctttcccttctgccctcacacagaacaaaaacaagtctgttgttttctcagtgttcccactttagtaaggggtagtgagacgctcttcctgcagttgcttaggccagaactttggtgacatctttgtcacatctcacatccattctatcaacaagttgtttttttctctttttaaaagtatgacaacttcttaccattctacctgccctatttcatccttgctttttagattattgtatagcttcctcacaggtccccactctttatttcctatagtgtagtcttagcaatagagtgtcctgcttttgaaaaagtatataaacttgattgtgtcactcacctgtggcttcccatcactcttagaataaaactcatacttgttaccctggcagtcatcttgcctctgcctaaatctctgtgactccatcttctaccattcttcctttgctcataacagtcagtctttttggtcttttagctatgctaatcttagcacctttgcactttctctttctatcttgagttgtctttctctacattatcacatggctcacttgcttactatttcatttagatctgtgctcaagtgtttttccaaatgttgttccatcagagaagacttctctgaccactcttatcgaaaatatagtattcctttcctccttctgtggtttttatatagtgccatcctgatttatttttcaccagatctcatacattgacctgaaattatatatctgtttatgtacatagtgtctgtcttt

SEQ ID NO: 57578 - DNA, 1030 bp, Homo sapiens
tttatgtgtttacttacacctttttaggtgtctgtgttatgacattggagcatatactttgaagcaactaatttcagtcagatcatctcagtaatttgtaagctaaattgttaaaaatagtttgtcctcttagagactttctagtatagattaatcttttaaataacatgtttttgcagagctgctttaaaactgaattttttacctagagaaaatcaccatatagaagtatataaaaaacctaaagcatttcacttgtaataatatccaatatatatgttgaaatagtaatccttacgtgaatctttttatgtcttcagcaacatcggcaagtatagacagaagcgctcccttagaaataggtcttcagcgatctactcaaggtatgtcttgttgcatatttatattgaactttcagaagcccattccaaaactacacatttatttacttctctttcttttatagtcaaacgagctgcagatgaagttttagcagaagcaaagaaaccacgaattgaggtaaagaaactgtattttaaacaattttatttatattgttattgaaattgggattctttagtaacaaggattctttgattgcagtaacctgaggagctttttttctggaaaaatttttgtggtagaaagaacaattgattaataagtagctcaagctatagttttagctctctcacatgcaagctatgtgagggacaaatcattttattttctttgcttttatattcttatggatgaacctattggctcaagggtcagaattctttttcctttctgttcttttttttttttttttttgaggcagaatctttctctgtcacccaggctggagtccagtggtatgatcatagcttattgtagcctcgacctccggggtttaagtgatccccccacctcagcctcccgagtagttgggactgcaggtgcctgccaccatgcccagttaatttttgattttttttttaatagagacagggttttccgtgttggccaggctacagaattctttctt

SEQ ID NO: 57579 - DNA, 1085 bp, Homo sapiens
ttagttggaagcttctaacgttctaatgaccatcctttgaaaacctttaaggttttccttagagcattttgattagtgctaatggattcaggacctgtagcaacagatgaaaaaaaaatggagataccaaaatgaaattgttgactctggtgaaggcttgtcataacatttggttattaactttctcaaaaagatgaatttatttgttgtgtctttctgaagaaagtcagctatgatatgggaagagcacttaatcataaagaaaaaagtagctaagcaagtttttcctaagcttttcgatgattccagtcttaagattcaacatatatttattgttattatctttacgtagccaaaagtagtcttgaagttggcctaaagacactgatacctagaattgtagaggtaggaaatttggtaaggaaaagttacatgtagcgttttttcttcctaaaagttcaataaaaattttaaatgcattaaccagtggttatttccaggatgaagagtgtgtgcgccttgataaagagagattggctgcccgtttggagggtcacaaagaagggattgtacagactgaacagattaggtaagaattctttttaagtagaaagtaggtagtttagatatatgtaaaagtataaggaaaaggaatattaaaatgctctccacatttacatttacctcttggattcattttatgcctctttgctcttaagttcgtaagaacatgtgtggggattggaagtcattgtgtttatcatgctttttgaaaagtcttcttgtttctattaccatgttggtctttctttttaaaaattgcgttataagctgagaaattcattttatgttacctcttattgattacttacaccagaagtcagcaagctttttctggaaagtgccacatgttaaatatttttagctttgaaggtaatatggtctcttgaaactactgaacttttgtggtgtggggaaagcagccatagacaatacatgaatggatgggcatagtttcttcactttttaaaaatgttttcatttttctggattccagctactcaaactctacttgaagttgtttg

SEQ ID NO: 57580 - DNA, 1115 bp, Homo sapiens
ctgcactatggcatacaagtttgaaaccttgaaataaatttcaaggaaaacctaggctttgaactttctgtaggatggattttttacctccttccaaagtggcatctgtgtgtgtgtttaatttccatagatacagaaaatataaagaaaagcacctatattaatgagtcctgcttttttgtggggaagagatgaaaaaccatgaagaattttgttgtattgatacttctaagaaattactaatttgctcttagagtaatatctcgacatgaattctttataaaaattttatataattgcagaatagcaagtcagtcttacagataagaaaaccttaattattgccatgtaagtgtttttaccagaaatttataaatgtaacaaaatatatttatgatacactccaggaatgcctgctgtgaaaatttaaaaaagaaattgcttttaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaaggtaattaaaatattttactcattcattggagtgagagagagagagagagagtgcgtttaatctgtggttatagaattggttaaactttgcttttaggtggaagtttcaagttttatctctttgaaagctcagtaataatgtagatttccagatggccatttttaccattccattcttgaatatggttgttagacatcagagatgctgatgaaaaagtaggaatcaaaatgcaagctccttcacagatcatttgcaaatcaaagaatggcccagttttcctgttgagtcatttttgcttaaacctaataaatggaataatattgatggcaagttctctggttattaatgccatcattatttttttttctcacatggtagagaacttatggaaatctgtagcaaacatttattgagtatattttacacactatattctgttgtgtgggtata

SEQ ID NO: 57581 - DNA, 1050 bp, Homo sapiens
ctattgcccaggctggagtgcagtggcatgatcttggctcactgcaaactccgcctcccgtgttcacaccatattcctgcctcagcctcccgagtagctgggactacaggcacctgccaccacgcccagccaattttttgtatttttagtagagacggggtttcacctgtgttagccagggtggtctccatctcctgacctcgtgatctgcctgccttggcctcccgaatgtagcagtttaagtaaaatgaaaatgatgaaatgaataccatgggatttacaataatcagtctctggatcaatatcttagtagtggttggtttttacatatgtgtataataatgataccttatgacatatgtagtagggaagaatcgatagtaagataacttagtcttaaattatcaactaaatttactattgtatatttaaagtgggcttaattaaaatccatttatattttagaatttttccaagaacatttttgcaattcttcaatctgtaaaagccagagaagaagggcgtgcacctgaacagcgacctgccccaaatgcagcacctgtggtaagaatgctttactgctttacagtagatttaatgaagttgccacttatattgcagtgtagtaacgttgaagacatcttcacattttaaaatcagtggattctaaaccttttgctcctttagcatatctgaaagatgtgaaagccctccccaacattaaaagttacttacttcagcagtaattcttaactggagcagtaattcttaatatacctgggtcagagtctgaaaaaggttaattagggaaagccctctatttattttaggtaaactgtggctggcctactcattgttgcttgggacaattgctaaccattgttaataacataaatccctgttaactcccagtttggggttctttttggcattgtatctattacatcttggtgaatgtatttctcttgatcaccagccatgctgtcctttaattgtacctccatttcagctgctctgagagttgactgccttctctttgaagtgccactt

SEQ ID NO: 57582 - DNA, 1203 bp, Homo sapiens
gccactgtactccagcctaggtgacagagtgagaccctgtctcaaaagaaaaaatatatatgtatgtatgtatataaaaataagtatatgccttatgactgaaactttggaacactactttttataactttgggtcttttcatggtattagatgcttttagtggtactatcattgagtattagtagtaagtaatttggggttataaagtattcaatcttaatttttgaacataattgcagagatagtcttaaccagcttctatacaataggcttgctggtctgtatttaatatattaatattttttaacctagagtcctttttaaagtttttatcttcacaagtacgtaatttaattttacatagtagattcaaggctttgtatattattgaaccatcacattcaatgtagattattactttagatttgttataggtcataagatacatgatctataaaatcttaacaataagcctcttttttttcgtagaaacggaaggcttcaaaattgacactatgggaacctaccatggtatgacactgaaatctgtaacggtaagttaatttggctgtagatgttcttttgttccagggattttatgtgagtagcacatgttgaagtaaatctttagtctctcatattttttatttcaaacatttttctttattgatcacttgtgctgattgatctgtgtggtgtattatttgattcatgggtatcctgtttcatttttcttttccttcaaattaagttgaatatatgtaaataaaagctgatttgattaacttgcaagtagggcaatgccacctggtcagtatttaaagcctttaagttatgaggtcagtttgggagagctttttcgcataatatcttttgtttttatttttatttatttatttatttttttgagacagagtctcgctctgtcgcccaggctggagtgcagtggtgcgatctcggctcactgcaacctccgcctcccgggttcacgccattctcctgcctcagcctctgcgagtagctgggactacaggtgcccaccaccatgcccagctaattttcttgtatttttagtagagacggggtttcgctgtggtctggatctcctgacctcgtgatcgcccgcctcagcctcctgaagtgctgggattacaagtgtgagccaccgtgcccagccttgtttttaacaatgtaatgtcttt

SEQ ID NO: 57583 - DNA, 1056 bp, Homo sapiens
tactatgcatgtgtattaaatagagtatacttaagacactaataccaaacttttgtctttgcttgtgaatcatcagatctttacggactctatataacatggaatcattatatatgtgctgtggtttctcagaattaacatataactttatatctacgtgggcttttacgtgttttactcactcatttccaaaagcaaatagcaagtatagagatctgattttaagtttgtttttttctggacttcaaattgggattggatatcagatattttgttaatatacttgtttttaaattgtcatcagatttgtttttgtattattaaattatgtgtagattaatgaattcattcaacaagtacttattgagcatttgtgtcagatcctgttcttgttgctggtcatacagctgtgaataagacagatgagccttgtttagagagagaagtcagagatacttctctcaggaggtaacagttgagcagagagacttggatagcattcctctacgtcaaggcagggatcaagactgaggtccagtagagcaacagcaaggaggccagtgttgctagagtttggagaactaagggaaaagtcatcagggattagatactcccatcttatgcgatctgcctggttcttcctgacttcaatatataattcatggctgaagatttagtttaaattcttatgtgatttggttattgacatcttgggaacagaacttgcctactaatcatttccctaagtgcgacagaacttgcccgctgatcattccctgagtgaattagtcgtagaatgaagttgttacccttggggagccatcaaagtaagttttttgttatttttgtgattgttgtttttacttttctcatccatccctgtacctctgaaatgccatgaaatggttttattatctgagcttctttgcaagtagtaaaatctgtgatgggttttacagtgatgctttgtacagagcagtttttctaaaatttaaggatagcttctttattgatcagtatgagaatgatgtgattctgcggcatcatcagagactg

SEQ ID NO: 57584 - DNA, 1051 bp, Homo sapiens
aggcatccattataatttaagtttttatcttattcaccaccatttaaaaattagagcttgtcacataaacagtctggatttccagcttccttaaaatctatctggcatgactgcgtactgggtctgtagtctcacatggcaacagccacatccacctgagcaggagctacctcctttagataagaggttttctctagattgccacaggcctcattactctgttatcttttatttagccttctttacttatttctgctacatctatagactgttttggccgtctagtttgaaatccctgctctagaggcagcaccagtttgttaaagataagttaatcagttggaaatacaacaaatataaggctttgaagtcagtgctggctttgattttcagttctaccattcattctcctgcttgtgaagttgaggaggttatttaacctttctatcagtgattttgtttttattttataatatatataatagaacttacatcatagtattgttgaagattaaaggagacactgtataaaatgcttagtacaaagaggcttaacaaatggtagctacttgtattattaatttatgattctgtaaacttaattagatgtatgtgtaaatgtaggcaactatatagctttattgtacttataatttattatatttattaatatatgtatttagtattgttaatgatataattttcattcaaagttataaagactagtttatataaatattatgatagtctttttctttcaagtaattggggtgtttttgcaacaactatgtatgtttatcttatagcagagatcttttgcatttgagagaaagtagctgcaaataagttgtttaaagagggtaataactaggttggccttttccatccatctgttaggactcatacttagaaagaaatgtaatttcttttagttttaagttactgattttctggacaggatggtggctcacagctataatcctagaactttgggaggctgaggcaggagggtagcttgaggccaggagtttgagaccagcctgtgcaaagc

SEQ ID NO: 57585 - DNA, 1896 bp, Homo sapiens
ctcagctcagtgcaacatccgtctcctgggttcaggtgattctcctgcctcagcctcccaagtagctgggattacaggcgtgcaccaccatgcctggctaattttttgtatttttagtagagactgtattggccaggctggttgcgaactcctgacctcaagcgatctgcctgcgtcagcctcccaaagtgcttggattacaggcgtgagccaccgtgcccggcctcctttcactgctttttgattgcagtatggaattaattgtagttattgcataaatgtttttatattaaacatatataatattttgtaaacgttttatactgaataatacagatatactctttttctctaattggctagtatttagactgaacacttatttagatgggtaaatattaaatcatttcatgccttccttgtagtaagaggtgttagaatctgatttaaccttaatattttgccagcattattagcattttggtgctaatgtacttcaagaaaaatgaattacagcaacaacatattcatgtcagggaattttaatacatataaagcgaatattatttttatgtggtttagtttatatatcttaactgagatttattgaaaatccattgcacactggttgatacattttgtgtaagcctgtacaattcaactcaatttagctttgcattttgttaaagaataactattagtttacccaaaacatattagaggttttagttaatatctgtaacataacttttaaaattattctgccgatgactatggagttaatgccacaatcacaaaacacttgagatttattttagaaagaaagaaaagttattgttgccacgtatatcagagtaatcttgaaatcaagattactaataatttttagtaataaatttaacatcactttgttttaaaatgctgtaatattgatcgttgtaagaataggaaacacagaaaccagtttggaaatatattttgttaaataacaaaaatttatactatgaaacatagttttggttacatatattctcttatagtttagtatataatgctgtagttatagatgactttcagaattgcacaaagattttagttttctttcagcttaatagagctttttattccactttctatttacctgcatcagtgtaactttaattcaattttaacaaaattattgtcagtgttaaacatattttataacttttaatttcctactactccttgtatttttagattaaccactgttctttaacatacaaatgcttttattttctgtatttctctttattattttgaacaaatattaatctttaatgtcccttttaactttatgacagatgttttaaatcaattggtttatatgaaaaaaacctagtatatttaataacatgctatatttgggtgtttgggtatgtccttgatgggaacttttccattggctattgctggctgaacattagtttgttggatcaatttctcggtctttgtaaattgatttagatttttgagtgactttttaatcttttatataattcctgcattcaaattttttaaattaattgtctcagtatttttgtcttagtattcattgaagtgtctagttagttcatcccctttcccctcccccatcctaccaaacctcatttgatctttaattctaagttttggtttcttttccaggtctttttcttgatggatgtttcttttagtgttgttcttcttgtctttcctgcttctcatgttcctctgtgagtgactgttcccatgttttttttaaatacctgtttttaaactcttacttgcttctggactggacaaatcttgctatttagaaactaagttcttatttgaaatttcagaatggtgctttgcactgaatccattgaagac

SEQ ID NO: 57586 - DNA, 1063 bp, Homo sapiens
tcagtcaacatattttctgtgtaacagatcaaaggagaaataactgctggtgatgaacagcagtgtggaggttttgttgcctatggttgatcagctgcctgaatcctgagttgtctcatagggtggcattatgttagtaatttgctgtagcccagagaaaggctgagaaactaagtaatgttagtataccatgagaaactgattcattttaattaagcttatgagagtagcatttgaaatcaaatgctgatttattaatttgcagtgataaatgtaattaacaagggcactggattctcacctctagcacataacatgttctctgtgtaaagctacattggaaatcacagtgtactgtgcaatgagcatataataaattatatccttcaaatgtttagtggtattaaagtagtctgttatttttaactcttcattaaaaaaaaggacttgttgcaagtccagggtacctttccccttgggcactgcttagataggttttgatttgccattgtgatttctattccttgttgtgtctgactaatcccttgccagatggatatgatgtgttatttctttagatgtatagattactgagtcaactttaggactgtgtttcattccattctatttgatttgttaaaaagtgttggtgagggaactagctcttttgaatttgggatttataatgtagatatccaaaggatctgatttatcacaggagaggtgaggagcgatagactgacctttctgcacgtttgagctgtaaatttaggattagtcacatttagctttgttgatttggaaggggagagaagagcagggatttcctgctgggttttggaaatctttctttctttttaaagagatgaggtctcactacgttgcccaggttggacttgaactctgggctcaagccatcctcctgccttaagtacctgagattgcaggtgtatgccactttcctcagcatggaaatcactttctctacctttcacttattacaggttgatagtcaaattaatgaggctccttaaacctcaccctcccaattagtaatttcagt

SEQ ID NO: 57587 - DNA, 1127 bp, Homo sapiens
ccgtgggttccacatccgtagatttaaccaactgccgatcgaaaatattaaaaacaaaaaacaaaaaaaccaaacccagaacgcctgtgctgaacatgtatagacttttgtgtgagttatttttttcttaaacaatacagcataacaactatttacatagcatttaaattgtattaggtatcataagtaatctagagattacttaaagtatgcaggaggatgtgcatattttatatgcaaacagtatgccattttataaaagggacttgagcatctgtggattttggtgtctgcagagagtcctggagccaattccccacagatacagaggtataattgtactctaaattagaggttttgcttatgacctttgattaaaactttacttttgtaaaaatcaagtttacttgtcttttttttgctcagttattagctttctctctgaagtatataggagtcattctcttccctctcttgcatgaatctgttaggaagaagattgtagttatttttttttcattaaccttttcagaagacaaacagatccctgataagggaataaaattttaaacacatttttaaaacaaattttaaatgttaagcaaatgtgaaacattgggctagttttctttgttcattaatttctaggctcagacaacattttgcattgtatcaggcccaggcagtcagtttttgtggttacttttggggctgtgttggccctccctcatggtggtgtgaccctaggaacataggcccctaaaccgtttccctgatcttttcccagtaataaggcatttattgcaacatagcatcaactccattatgttgtatacacaagaactgttttgcttttttgaggcttggtcatggatactgattatgaacagacaaaaaatcttcagcatgtcctctttaggagaagttgtccttggatccatttgccaaggatttgtttaggtggcatagcagacagaggacattgtcttacagagcattaaagaatcatcataggagcagcaaacaattttattactgtaaaatttggtggtagtgggttttctatcccattttagtatttaatatacatcatctgccttctgggattaatgtctaaatgatacatt

SEQ ID NO: 57588 - DNA, 1638 bp, Homo sapiens
actgcttgtacaatcagtaaatagtttctactgctgttactggtattatttttgtagaatttgctggaaatagcacattaataaaattgcagttgagattatatgtgattatgctgtatacaaagaggtgtgaggagaaatctcaattatttggttgaattagaatttcaccacttatatacttgatcaaaataaataagtattctaagtattgaaagttttggtgttttcatcttcttaagtacctattaacactttgaacataaagattagttatttgtgtaccctttgaccaaaagcaaagctgtcatttaaaattatatttttatgtatataaaaatcacatagtgtcgggatgaagaagacacagttaacaagtggtgagatgtttatatacactatcagcttattttgcttaagaaaacgacttgagtattgttgcggaaaagtcaaaagtaaattaatagaatatttattttaaagtaaggattttcaacagtacaaagacactttactgtttgatccagtcgcctttgagagctcacagtgtctgatatcagattactatcgtttttcaagataatgttaggaatatagaaatttacatagattttataaattttatagattttaaattgaaacttgagataggaagaatttaggtgtctgttatctgtttttcatgagtcattttttaaaaaactttttccagatggaaattactatcttttaaagatcctgcaaaatagtcataatttggacaaatagaacttgagttctctttctatgtacacacctgtgtatgcacacacacacactgtttttaaaacttttgaagcataaatcagcattattctacactgagggaaggattccttttgtcttctgtcaaacatgctgatctgatttggtattatccccttatgtgtgacttttattaagtaattctggtatttctgtagtcatatagaataaattaagtgaaagacaggcttgatccaagagctggggtgtgttacatagatcagctctcagaatcacttgatttagagtagaacacttaggctactgatttgaaatggagataagcacttaaacagttttagtgttttcaagtttcacaaatgttacaattctcttctggtgatttatcccttaataatagaataagaggtaaaaatgattgttattagaattaagaaacattctgactaaattaagattgacagatttacatacttgtatggaataaaaacactattttagttagtaggttggtatttcttgattttaaaattcatgatggagtcaaacaaaattattgtgaaaatacttataacactcagtaaagttttttgttttcctttatttttaaaaacttcataaaagtgcattgtatacattgttcatcctagaattgtgtttgtcaaacgtttgtagttttccccatccctcccaaaaaggtttttaattggtgattcagaatatttgtcatctaccaaattaaaaactgcaggtttgcaaacttggcactccaagaaagaaataggtgccataaaatgattaagtgttggcatgtgtacacctgctgtcaggaaataaacttcccgtatgttgcattttggcagacatgcatct

SEQ ID NO: 57589 - DNA, 1034 bp, Homo sapiens
tattgcacgttgaaggtagccatttagcttaatacttaagcccaacaaaaatattcttgtgatttgaataccaggtgctagactttcattgccccaagtttgccgaatagctcttctagcttctatttgtccaggctctgcagctattagtagtattaaaaaaggacttttctcttggcatttttcaggctcattaataatatatttgaaatggtaagaatttggatgtccagtacctttttcattgtaaatacttccattggcactaagtgtattctccaggcctgtaactccttgtggtgacaggtctgtgttattagagttagttgctgtttgaggcctcagggtttgagggactgtttctttccaaatgttccgaagggagctgtggtttgtctcactttttgttgaccgaaatcctcggaaagtgtatgtcacagggttttctttgaatccagctctgcctggcagccagtcatgatgattgaaaaacaaaaacatagcaaaaagaaacactagagaaagtactccaataagatgagtgcggaacagagaccttttggcattccaggtcatctttgcaaagcagcagtgtcttctcctccactgaagcatgttgtaaatatccagtagtggtatatgagagattggtgaccaaaaatgttttcttctccttaatactattctttggcaatcattttctaattcagtcacattgtctctcttgtagtcattctataaaaatgaagcacaaaagtttacagaactgcctgaaagggactttgggtactaatatgatcagggcaaataggaatgtcttaagctgtgaaaatataacccaggaacgaagcttgtaatttatttccccttggcaacataacatcactgagaacaagattaatttatttaaaaatatacctttgtagcacagtgagcattttaaagagatgaggtgatggattcatttcattgtcttgttacactggtcatttgtacttttgacccaagttaaagatttaaaagttgaatgtatt

SEQ ID NO: 57590 - DNA, 3417 bp, Homo sapiens
actatttttaagcttttatttccaaatgacatatttggtaaataataatgactctccgctccacttcataaggatatcagtagatataagggttatgtatgtaaattcaaaagaaacaaaagttgcttttaaaatttatttgataatctgttctaagtgttacaaagataagttatctgttttctgctgatatgataatacttggaatctggttgaagtccaattatacagattttttttaaagtgtaaatttgatggtgtaagaaggagtaaacaataaggtcagatgtttgaatggatgtttgagttaaaggactgagtaaataaatgatggaaaataatcataatttatgttgcttttataagaacaatatacctgaagatgtctctaaagtattttagtattacagaaaacagcaaattattgcatattgtaatgtagcataaatacatagttttggtcctaatatgattttgtaacagtatgtgatagagatgcatcttaatttagacttcatggtatttgtatgttttagatgttaagctgttgagatattaaatccatatataactataaatctcccattgataaatgaagtgcatgtgtctagcctttaaaaaattccttattaaaagattctcaggtcttataaatttttttgttaaaaagaatataaaattaaaataaccatgcctgctttttattaaatgataaaattattctccagttattgcctgttgtattttaattcttaaaaagagagagcaaaacaagaaagttcagtagtatgcaaaatagttctgcacttttacatttttagaagagaaatagctttggtttatctcttcttttttgatatcttcacattattaatgtgtatttatagcttgtggatgaagttcatggggagaatgttactgtaaaatgctgttcagtacacactcagtttttatcatttggcttttaaaagtgttgatctctttagtctgttggtgatggtttaatagaaaaacttacacttttgttttgagatgtatagcttataaaactgcttaattggtgacttcaatattgagagattaaggtaccaagagggacttgaaatttttacaaccatattttttagtactatttattattagtctttattagaataaaaattcatgggtgagagtgatgttgaggtgtaatagagtctggtaaacttgtttaatcttcattttggaatgcagtacttacatatttttaaaaaatgtttgccttttgtgattattagataattactgagttgtgttgtgaaattgaggaaaaatcaggatctttgatagatttgtagaattttagaaatatctttaagttcttgagccctgagttgctgttctatgattgttgctaaaatagtttatttggtttatctgtgccctgcacacacatatagtggcggtagttcattactgcatattaatatagcctggaagcatagtagctacatttatatttaattttttgaccttgtattgccatttgtggatatttttgtatcaaagtatttccatattatgtttttgaatttcacttctgaaatgataatcagagacaacgttaaatttgatcatttggaatcagtcttttacataaaatgtaagctatttaaaatagttaatttttaaagccactattgatgtccctttgtttaaagttctattcatggtcactataataacacgaggctctattgtggggttatgcataaactcacactaccttatgtgatcttatgttaatgctttccttttagtatcttcttgtagcttggtaatatttaaaatttgttgatactctctttggttgtgttcattatcttcatttagggagatgttggggaagattttgttactaaaagctgttacatattaaggttttgttttaaaaggactttgaaaaaaaaactcttaaggttttccttgctactatttaatgaaatttcactgcattgtgtcttttgatagccatttttaagagagcatttaatttactagataaggattcagtttgacctaatttgatagaatattgctgtgttttttgtaaagggctacagatttttttttaagtttaatttcttaaggaatcctttaaacacatcttcttcttatttgccttttccctctgatgtctattacccagaattactccaagctacatatttagctgcataaagcagtgacagcttgtcttctaaacaatgacaaattttaaaatcagatattaagaaaccttttcatagtttcaagggcagtgagctgtatgaacttgcttatcaggtattagtgcctccagggctataaaaaggtaacacatttaaatgactatcatacacaagatattgacataccttccttggtcaggccatttatgtgaagaggattatgcccactgaaaatacttttggcacgccatcacttcagcaaaaaagatgctatcgaacatgcgcacatcccccaacagtctgcctcctgcgattgcttttcacagtatccaaagtgtccatctgtctgcttgtcttcgagttaccctccttgttcatatgggtcctagtcttctgaaattttccctttctttcattttctctctttcgttaaacaaaagagctgtagttgcccgttctgcttgtagcactgttgactcttcccgacagttgatgcattgaagctttttacatctgctattttcctggctggacaatgcagtgctgtgttctcgtctcagtatccatatttctactaataacactgagctgcaatgtaaagcagccagagctaaaatgtagtgcttcagttgtattggaaaagaataggatttacctctcttctttcgttgttgcctggcagctgcaggaaggattttgagcagttttaatggggttttagtctataatatgaaatccacggttcctcagctgctgcacaggcaggcagcagtttaaatgtgggcttgacagatgctctctctgacagagcagaatttaacgtcactgcttggctgaatcccacgtgattgtttgcattcattttgactaaaaacctaaggtagggagaagcttagagattttgcttttatgtgataaattatatatgttgaatgcaagtgtagtgatgagtgaataatttgaaaatgtgatgattatgaaatggttatgattttattttttccagcttacttccttttttaactttattcttaagtacaggctttctaagtgttttctgtgttagatgttggttttcatgtttcttacatgcttttgtagggtgtaagcagtataagcttttgtgtgtaagttggtgtaatttaaccccttcagtgcattctcttcttgaagttttttttctctgctttcaaattgctcttgattt

SEQ ID NO: 57591 - DNA, 1022 bp, Homo sapiens
ttttatatatttatgtacctcccctgataatttgtcaaatttccttctgttatgtaccactagtgtaaagtctttatgaattcatagttatgaaatttacacttgcaactttctataaagaaaaatgtattatgaaatatcactgtgaatatgattgaaacttgcactaaaaacagacattttaagaatcttaagcatttcagaggcatctatccttgagtatataattgatatacttcaacacttaccatatttccatgtacatcttacattttcagtaattattgagatttgttgtttagtttttaagatactctcatctgctcttaattcaaatgtaacatctcttctttataaatgtgatttttcctgaatattttaaaggcatttaattatttgaaatgtttgttttttaaatacattccaatataacatattttaggtttttccaacaggagggtatatatcatttatttattttgagattgtctagagaaaaaaagattgacttgattttagaacaggcagtgacatttctgagaatattaaaattgtcagcagttaagcaaatcatttaaaaatattacatgcttacagtaactactctgtagtaactaagtttattttatgctaaagatgtttattatgatctcatgacttaatagcataaaagatcaggagagttttcatttttatttttttcttaaactgtaggtcataacatgttcagtggagtaaccaactgagtgagaaaaacagaacaagagacagagagatatgagatttctttggaataattaaagtgtttattatgtaaagaaactttgatcttatatatcaattcttattcttttaaaggagggtgcatctgcccggaagactcagactcctgcagcccagccagtaccaagaccaggtagaaatatagaactttgctttttgttttctttcaaaagatcgtaacagtgcaagtttttagtatgcgtataatgctttgaacaaacttaaattttacttaaaat

SEQ ID NO: 57592 - DNA, 1968 bp, Homo sapiens
tagtgcagatttggatatcctcattcatagtatgtacacaggctaattctaaaattatgtagattatgaatattaaatattttctggaggcacatcaaaagtatggtacatggggcttatattgggatgtttttgcagtgtgatttccctgtgtcttgtattcatactcctcttagatgtggctagtatttcctttttttgtttttgttttttgtttgacagtaggtttgtttgaaatttttgtcattgctgttattaagtaggtgtggaaaagaggagtgctctgtcagccttgttatacttagactagattggatgtagttaagatgacatgactaattttcagtagggatgatcataccagaatccatcgtgagagcataagaagaacaattaaattcaacaaatattatttgaatttctatataataggctcttgtccagaaactaagagaagctaaaggagctttttacaggaaggaagaaaaaagtgaaggaaatagggatggacagatggggttgggcccaaagaatactaaacatgaagtataggaatattgtggaggcagttgaaccacagataagagaattgtttgtttttctttgtaaggtagggatgggaggttatggtatgtcagaaatggtattatataaaaggggaaaagccaccacctgaggattgtaacttagtatctgtgatgtaaaattttttctattttgcattttcataaaagaagttagtatgtaaggaaagggctgggagaggcactgatacctaaacaaaccattttgttcatatgtgtcttgtgataaaattaaagggactggattttactagccaggtatgtggctaggggaagatcatatgtgtaaagtaaggggttctaagtctttcacctcttaatgttctagcttactttttagctaaagtgccctggggattaaaccaatggaaattactctgaatgagtgtctcatcatacctcagatattctaatgctcatccatgtgaactttctgctttctacttccacttaactgcttcacacccatacatccacatttcctacccatcattctaaaataattaaggtttttgctctcattcagcaataagacttgattggaatggatagtagtagtttgaagtctttatttgtcctaattagtgtatttttattttgctgccaaaactgttaaatgcatctgcttatggggtgtagcccagttttgaagggatattgtttaatatctgacatgtacactagtattatttctttaaaatctgaaaaatgtgaatgcccaaaatatatatggccagtgtaagaagggggattatagaagtataactgttatttgttgggtagagtttgcataatttggaaatgagagactgtctcacctattctctctttgagtgagatacctcaagggtggagttctgttttttgagcattcacaaatttttatttctcatttcatcaaatatttatttagtgctgttgtgccaggcaagtctctgggtaaatttaatgttttaaagtgtttacagttaaacactttaaacctataaagctctaaaaatttccaacctctcaaaattcatttagggaatataactaacaagaggcacatgttttccagtggattcataaatacaggcagttgaaagtatcgggggaaccagcccccaatatttaaataggttctttttattttccctaagtgtcagcctgtctgagaaataaaaagagtacaaagagaggaattttacagctgggcctccaggggtaacatcacatattggtaggtctgtgatgtcccctgagccacaaagccagcaagtttttattagggattttaaaaagggaggggtttttattagggattttaaaaggggtatacgaacagggagtaggtcacaaagatcacatgcttcaaagggcaataaagatcacaaggcaaagg

SEQ ID NO: 57593 - DNA, 1059 bp, Homo sapiens
ggctgggcacggtggctcacgcctgtgatcacagcactttgggaggccgaggtgggtggatcatgaggtcaggagatcaagaccatcctggctaacacagtgaaaccccgtctctactaaaaatacaaaaaaaattagccgggcatggtggcaggtgcctgtagtcccagctacatgggaggctgaggcaggagaatggcgtgaacctgggaggcggagcttgcagtgagctgagatgccgccactgcactccagcctgggcgacagagcgagactcctcagaaaataagaaaaaaatagattattttataagctatttggccacttagattgtttgcagttgggatacacttgacattagaaataagttttaatgtttttctaatcagtgatgttgatgccttaactatgagacagattcagatgaatttagtgataactctcatttggggagattgatgtgtatattgggtttgttgtttcaactaacatctacagagcaataactaaaaagtaaattactctagatgaatatacaacacgcccaaccttctaggagctcacatgagagtggtactggtttgtcactagttgcagctgctgagaaatgtgtttagcacttggtgtaaaactcagtttcaatgccttattctaagtacagtgaaaaatatactgtcttttgactctctgcaaacttgaatcacattctgaagataggttcagaaacaaattagacctcaacagttagcctttaaaagctttatctagcttctctcaaattatgtgctgttagtgagaatgtatataatagtgatttttcatagtatataaacaacttgaaatgtattgttttctacaacttgagacctaaaaatgatatacagtatatctagtttgacccactcttattcctaaacaaaaatactgatatataaaagaaacttaaagtctattttagccttttacctctgccatttagttgcagagcaggaaatacaaccagatctcctgatgatcaatttagtagtcttattatttgtactgtggagatacctaaca

SEQ ID NO: 57594 - DNA, 1033 bp, Homo sapiens
tgcttcattacacttggtattgtgttgtttttttgttttttgttttttttggcatttactgtatttttttaaccaattttatgatttgtgaatttggtgttatccaatctcacaaattttagtaattgacaacttttaaaaaaataaatatatctaactggttatacaaaatttacagtaagtttgtggaatgttaaaaaaaagaaattgtcttttcattctccactctcaagaacctttgcagtgttcatctgaatgtattacaaatctaatacttaaacactgttttatagcagaaaatagtgaatagtgaaagaaatcacaaagtaaattttagtgtcattctctttagtcttgtttactacagagaaaccagacaattaaacagaccacattcttaggatagaccatgcctaatgtttcttccaagtttaaaacactcccttcattgtttaacacctcattgcaactgacatctcccctacagtttgagtcagctggaggctttgctatgtaattaatgcataattgaaacctcctccacacaattatggtactggctgtaactcatagctcaagttggatagaaatatccaacttgcaaatagcatagattctatttagttttatgtacaactgaggattctttagttttgtatatcccttcaataagtaaatgaaacaaaaaaaaataataaaaccctttaacatgctaacaaacaaaattgagattgtattatggaagtattttaaaaaatacactttacatctataaacatgatcatgaaagttgtttattggaactgtaaggttatttaaaataaacgattgggtgtaacttcctgattttggccatgttggcagccacatggggccgagttccaaagaggaaagattgtgcgcagaaggagctcagacgctatgtagagggttctccttacatccgccaaatactattcagcacatgtatgtgagaaaactacatgaggcctgggaaaaagtcaccgggaaagaaacaggcagaaaaattacc

SEQ ID NO: 57595 - DNA, 1050 bp, Homo sapiens
atacactccatgatctgtacttgcagagcaggtttatttaaaaacaaacatctttagtttaaaactaattaatgtttaaaaattatttcagaccgggcgtggtggctcatgcctgtaatctcagcactttgggaggccgaggcgggtggatcacaaggtcagcagttcgagaccagcctgaccaacgtggtgaaaccccatctctactaaaaatacaaaaaaattagctgggcgtggtggcggtcacctgtaatctcagcaacttgggaggctgaggcaggagaatcgcttgaaaccagaaggtggaggttgcagtgagccaagattgcaccactgcactctagcctgggcaataagaaaaaactctgtctcaaaaaaaaaaaatatttcaaattatagtttatcttcccattttcatcacgtggaatacattgactttttctcatctctgttttttcaaagatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactggtaagatagtctctatatatatatcttttcacaggtgttgaacccaagagaatgaatgttgttattgccgttgatgacgttgctttttaagagatggggtctcactatgttgcctaggcagaacttgaactcctgggctctgtcagtcctcctgcctcaggctcccaaatagctaggactacaggtgcatgccactgcacctggcagcctatattttttaaatattcgtttgttttctgtatattgttggttgttttttctcatgtgagcaattatcaaattttatcatgggttctaaatagaaactgtctttgaaaagtgtgttgatgtatatttactttggtcatcaataatgttaacattctaataattcctcaataactttatattttggataagtaaacttgattttacttataagaagaa

SEQ ID NO: 57596 - DNA, 1707 bp, Homo sapiens
ttttaatgaaagtaaaatgtcaacgagaattcttttttacctacttgcttgccttgttgaataatgtttcaacaaaaaatgattaggatgtctttaagatataaatgttgtatgaaattcattaagaatataaagttttaatttttgttcaaatttagtcttctgaaatttagataagaatttagagaattttaacaatcatcagtgatttactttcatgaactgttctttctctttcacctgttccttctatactgactcctttttctcagcgtttaagaatactctttccccttccttcttaaacaacaaaacaaaacccttaccgttgacctcaccctttcccctagcttcttctttttccttttatagctgcactttggaaagaattgtctctaccaactcattttctgttcatatcccctgtagtctggctcttgctctgtactaaagctgttttcactgaagtcaccagtgactcaaatattggatactgttaacttaccagaatttgattctgttgactcctttactcctttttaagttactttccaagtacctgttacactttgtctcagattttcttgctacttttcctctggttatcaactggaatggacccttcaatatcatgcagttgaaaactcccatataacttttgacttatcccaaacatacatactaatagcctactgttgactggatgccttaactgataacataaacagtcgattaacaaatattttacatgttagcattgtatactgtattcttatgataaagtaagtagagaaaaagaaaacgttaagaaaatcgtaagaaagagaaaatacatttactgttcattaagtgggagtgggttatcataaaggtcttcatcttcattgtcttcacattgagtaggttgaggaggaggaagggttagtcttgctgtcccaggtggcagaggcggaagaaaatccatgtataaatgaacccactcaattggaacttgtattgttcaaggatcaaatgtatatggttatgtccctatttctcttctcccataattttaaataccctctcaagaagatctcatagctttcaattaccatttatattccctcattctaaaaattatgtctttagctcaatattctggacctatatacctcactcactatgagataacttctctgtgatatctcattggtacatcaaactcaaccttttccaaatggaattgatggttttactctcttccttattcctcaaactatttcttattatctgttagtccttttcagtaatttgcctaagccagaaacttgggagtatattatcttagctcttggttgatctttctgctttcactcttctggcttccagttgttttctccatcagattacactgtacagcattgggggaaaactgagggtatttgggagcatctctgtgggccttgatagaaaattatattatattttgttaatgttgcataattataatgaaatacatcgtttgagagaagattaaatactgatttgcataaaattgccaaataaaatctttacaaatttagaataagtttaagctgatatctggatatattttagatatgttatacttgacgtggctatatttatttgttggttgacatttaaaatttttttttgttgatacataatatttgtacatatttatggtgtacatgtgatattttgtta

SEQ ID NO: 57597 - DNA, 1072 bp, Homo sapiens
aattaggggatgtacactgttttttagacataatgctattgcacacgtaatatagactgtgatacagtgttaacgtaactacgtaacttttataaaaatgcaatgaggtaccaggaaatatgcgtaactcattttattatgatactttattgcggtggtctggaactgaacccacaatatctccaaggtatggttgcactcttatgtttctgtgataacgtaccaaccttatagtctttcttactgtccttcactagactatatgcattttatcttaccttattcctcattttagtgtccagtggctggcgtgtataaaccctgaatgtttttaaagataatattttaaaagatcactttagttataatacggcttcagttggtggaataaagaaatttttttctttttttttattttgagtaaaaatgataacttctctccaccctctctatagttaaagccttccatctgaagtatgatgaagttcgtctggatccaaatgttcagaaatgggatgtaacagtattagaactcagctatcacaaacgtcatttggatagaccagtgttcttacggttttgggaaacattggacaggtaattccgattctaaaatatgcttgtgtgtgttttattgtaatttttctgtctcagttaaattttaagttccatagagttgtcagtcttattccctaattcccttctttcaacattaacttgatgcttatcttcagtacataattaacaattttttattgtataattactttagttggagaatttagcctgatagaagtaacactaaactgagtcagaagacttagactttagtcttggttttgtaatctgtctctaattatctgtgtgacctttttgaaccttattttctatccaaggaactttggattaagagaaccctgtgttttttgcaagtactgaaagatctatgattctggatttatttgtgttacggatggttcacaaaaggaaatggttttttaaaatttattttaattactagtatagtgttcataaagccctttacattaataacagttttgtaatcggcaaa

SEQ ID NO: 57598 - DNA, 1318 bp, Homo sapiens
aaaaattctaaaattcctatagtcattataacctaccataatatttttttcaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcattttt

SEQ ID NO: 57599 - DNA, 1883 bp, Homo sapiens
cttccttcttttctgtatgtatgtgtggtttttgattttttgttgttgttgttgttttgtggccaccctttgcactagaccatcccttttattggtggtattggcctatattcccattgacaaatgcaatttttaattatttatttaatataggagtattttactgtttaatatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaacaaaaattaaagtgattacattgttcttttttggaggggtggggaggaatatttgttgaactaaagtatataaaattttttgagactagcagtatattttataatattacaaatacaacaattatttataaaagctagtcaaattaatggcttagaaagtagctgtaaactttgtgttttgaaattgcttgtttaaatgcaaaattatgagtaagataagtctttttaaattttttatttttaatttttttggaagtttattaaagcccttcatatacacatactttttaaaaaaagattcttaataaagaaattattggtttgtctggttaaagtccatatagaatgctgagaaataatttataaaataagaactatagaaatttgttctcagctgaaaagttggcagctgctctgtttctttaaaaaagtacaacatgaaaatttaattacattagccttaatattacttgactgaatttctactatttattcacttgtgtttgagattcacccagctattctaatgatagaaataaaaagtggagaaatgactaaagttgacttaagttaagaattggagtgggaattttgaaatgccatgtcctatatattctggcatatttgttggcacatttgcaagtatgttgatcccagcattgtttatatctgttggaataataactaaggaaaaattgaaaatgtataatagatgtataaagatttatatttagttagtatataatagataatacttgcaggttttttatgtgttttgggtttctgtgtattattttaggtaatctttataagggcatcttggaagttataaatatgtgccatttactgaaaagtgggaagcatttttatatgagtaaagctaatgaaataaaactagttttattgccaaaattcaaaaagtggggttcatgctatgtcgaatttaagcaaatgatctgtctgaggattttgtttgccattgaattccatttctgtccactttaaatttactaaaagctatttaacctgagtttgattataatgcttcataagtaatgcagttcatgtacatagagtaagtgctgtaagtgattttttaaccaccagttggtgctgtttctcaaagtggttcttaattagagtttaagtttgggtgccatgtgaactcataaaatattctactcattctttttgtttttctttgttttgttttctttgttttatttttcattctgtttgtttttctttgtttgtttttgagatggagtctcactctgtcacccaggctggagtgcagtgctgcgatcttggctcactgcagcctccacctcctgggttcatgcagttctcctgcctca

SEQ ID NO: 57600 - DNA, 1692 bp, Homo sapiens
aaacattcatacgaagaagttagaagctgtattgtgggctggaatgctatctttacatgaaaagattattgggatttgtcaggcatagtatttctctgaggaataaatgaaatataaatttcactttggaaactaatgagttaaaaccatttacagtttctgttaacgagttaaataatgtatagaatcatagttcgtaatggtagcaagttcatgctctgctgaacttactgtttgattatggtcaaattttctatgttattattatagtagaattaagagtgtgtcctggtaaattacattaccttcacagtttgagcattctgattttaacattttgtagtttcaaaacaaactgtactcatataatcagagcattaacagcagcatcatgtcagtggtaccaataattgtgaatcttctgcaacaaaatttctttaatgatgagtttaatgggctatattcaaacctaatttttattcaattcataagtgcccactaaatatgtattttatttctgctgttctgttcctttgattatctgcttttcagtgagcatctgcatagctaaaatagatatagcatgtgttgtaaatgctgttgaatttttttaaggctcaaaggtgctagtatataaataacagcacattgccaaataagcattttttctttcattttctgaagtactttcatatttactcatgtaattatcagcatttatggtgagttggaataatttttcctctttattttcttaaatgaccctagaaaacaatgtaaagtagctctgaagaaggctttgttgttgaatctgtctcataattacttgtggatcctttgacacagaattatttatagtttataattcaccctcatctagagaatgatgatttctattacataagtaatgtaaatagagctgagaccatagtgaagcagaagacatttgggagatacttttgattacatttggatattttattggactatgattattttgccaacaaagtacaagtcaaaacattgggttatacaacatattcactttaataaaatatagtaatggatactcacagaagaactgccttcatggagttcacaatgttaatactctaagtgtaatggccatctatttctctctttttaataatacaaacatttttctttaaaatggaatagtttgaaagtgtttatcgagtcagtgtaaatggggggagatcaagtgaacttccttgtggctcattcagttgttttagcacaattaagcatcactaatgtttttaaagggcttgactatatcacaattttaaaatatttatatttttagataatatatttttattccataatgcactactgaggacaaaaaggaagtgtaagggtcactgatgatgaaataaatttgagatgcattaaagtagtttaaggctaaagcagtttgatgtaggaatttgaggagaagacgacttcagcttaatgggaaaatactaatttggacagcgttatatgcttctggggttgtcatgaatttaagaaaagctaggcaaacctagtgtgatttttctccagtgacatttagttgcttgatttcaggtatagagaattgcagttagatttttaagctattttgatggcagtagaagcaggccagggagttggagatattttcaaggtaataattgtagtactgaa

SEQ ID NO: 57601 - DNA, 2282 bp, Homo sapiens
ggtaaccggtgactggttggcattagctttacaggatccatgctttaaaaactttgattagatatttaaagatgaatatttaaagatgaaaatatatttaaagatgaattaataaaatgttaaaggtatagatcatttcagtgcctttctccaacatccaaattgttaaagaattacatacttgtcccattagcccagatgatgaagacttttactaagacactattgacagccttcccaccctctgagtcttgttttctaagtttgctctcatgtgaggctagttcttgtattctttgctacttttgtcgcttaatgatactgaaagtggttaaaacctttgttggaaaatctgagctatgccctctaaggtttcattaagtgctggggtcacttgccccagttggggggtcacttcccccagttgtatgtgcaattcattactaagagagaatatcctgagcagttcccaatggtgggtggctggctaaaaggaatccctggagattttagtgtggtaggaaagcattttcattcttgaggatttttctttgacttttctatgggctggctgatttcctcagtttgctttgttctgggttttaggggagaattcttgggaggttgtgaattttctttgcctacagtgagatggttagatgctattctgaactttatctagatcttacccaaatccatttccatgttagcaagcatgaagttgtttaccttttcttttttggcgattgatgttgagtttttcgttctcactcactcccttgccagttccttagatgttatgatccagctatgacccagctttacactttcttcacccagaagtgacctcaccttttcatgacagaggaaacagaagccatggacttcttaatgctatatgtcacaaacctgtatgcatgtaagaatcttttatttcctcgtattccagtgttttaaacatcctgtcacccatcagggacttgtccttcatatgtatttctcctacacctttcctactctgtcatgcattttgcactattactgtatctctttcttgtattttcatcttgtcaccctgtatttatttattttccacccacttttaaacttagttacatctttcatggtaaacaggttctagggagatggtttgattatgtatcttaaattccctcccctcaatctctgtttccatctgccaactaccctgtcttgaatagagcagctgctgtgagcctggagcctttgggcaaataagagtgtatacagtcccttgattttaccagaagatgggaaagagagcttgctttgattttcttcctgtaatccagatgaaggtttagagacgggcagctgtgaagccttcagcaaaggtctgaacggaaagaaccttgctttcaaagatacatggatttagaggaaaagcggtgcagttcatatgtatggtactaggaagactagcttcagagtacctgtttggttgctgcatggtgggcacaattccacatctccctgtgaggctgggggaggggaagtaaatagcaaaaaaacaaaaaagacattggaagagattttcctcctgtcatctgtgatgaggagtggcaacttgctggttagtagataatcagcctacagaagagagctgccttctattgctcacaagtttgtttccgctcaagagtatcccacaatttgatttatgctaaatggggagtgagtggacaaagaagaatatctaaggaaacctaaagaaaaatagcatctagagagaacaggaacacagaagaaatggatggtgaaaaagaattgctggtggagatgaatgacaactttaattttgaaaaagcacctgagaaaattcagtcagtataaaataaactttctagcaattaaactacattaaaatgtggtagaaaaagagaggcatggccactattggggactaaatagtggccttggatatcatgtagaagtagttatctttggaaaagtaaaaatccaaagacacggagatttcaaaaatcaaaacacctagaagacgagtctaagatatttaatgtgagtaagtgaagaaccacaaggagaaaaagggaaacgatacaggagggcacaattactaaatactataggaaactttagttcgaaagggctctcactctaataggttccaagcaacatgggtggggttggagtgtggggacacacctaggcagataaatttcattcaaatatttattgttacttcctgcagtgacaagtactgttttagttgctgggaatac

SEQ ID NO: 57602 - DNA, 1138 bp, Homo sapiens
ttgggacaaaattatggaattttttttatttataaggtatatagttattaggctaggcagaaataaaagaaccaaaatgaaaatgtacatttaataacatcttaatttggcatggaaactgaaaaagtagtttgattttctaaagcaaagtaatctttagattattatttattttaatttccagaagtttttattattacaataacagaacacacaaacccaggcagagacgtgtccaacgaaatgatggttacatttcactgttatttgccctttggtccttcatcttctaagcatttattatattttcttttaatgctattagacttttattttgataagaaatatactccaagtgttaataaataaatatattatcatgtagctacccctttgctctaccatgtttctttcaatagaaaaaaaagtgttaaatgtgtctaaatgtgtcttcatagcctatttggccgtagctgtcgcatctgtggttttaaaaatagactttagccagatcttctggaattcttcttgaattatagttcattatgttaaagaaattctgggaaaggagtcctactgatattgtccatagtctccaaaaagtgaggatggtaactcggttgaagacaactagaagagttcttcagcaaatattcagaagcaaattttgtgaacaagataatatctccttcagttcaagctagaagaatgttactcatcgcagctgacccaactatagccactggtccatttcttgctgccagtatggctcccgttatggcaccacttgtaatagagttccagggatcttcttttcctctgacttgagccatactacagtcaatcatgggaaacagacctctctgaatgcaaagctacctcccaattatggaacatggattttaatagctgtcaaactcctttggagtttgtgatttactcctactggagaattgtgaaaacttaattgcttgaaagataccaccaccaatggtgcttgttgtaaaggcccccacatagccttgctggggggcgagcctctctagcatgttcttccagggcacaagcaatctggattatttttaattacagcttcaattagaaaacttcatgagtatttccagaacttataaagttt

SEQ ID NO: 57603 - DNA, 1097 bp, Homo sapiens
agtcccatagaactttttctattaagtgtttgaccaatcacagtttggcttttgggaagttgaaggtatttagaactagacagtgtgggatatttcactgtttctgttgagttgctcttttattcttccacgtcttcacttattttttccaaatattttttagctcacataatacagaattcatgctgctatttctttattttatactgcttttaaacaatcatatttttatattgcacacaacacatgaaatgcatttgtttatttataaaattaggtatagactatttaagcacttataagaaaaataagaggctattatggcctaaatataagtacaaaaataaatagtagttttctaaaaatatctgtcttatatgagatatgagatcaacttacacaacatcattcagctctattctggtatctggagatgggttaatcaggatgtaggagagggtactttgatgatcattcatttcatctagaagataaataaatgccaagtttgttatactgcttatagaaaattacaggaattactagtgaacagcttatattcaaaccatataactgtcaacaagaacttggtatagttttgtccacagcatgattgtgcacataagtttggctattttcaaattgctgtcattgaaaatatctgacacatacttattttttgttccaatagatgataacaataaagtatctaattctgttcagaataatcacagttatagtttaccgtttattacactgaaaaagtatttttctttaataaatgactggataagatgtttacttgattattatgctttatcaattacaaaaaataatcatggttatagataacaatcctagaaaagaatatccacacaggaaattcttgggaaaaataatataattacattatgtttagaaaacatgctagaaatgtgtctaaaaagcttgaagaccctaaatatgtgtttggcttcactacatgacacatctcatgtaactcatcctaatgcttttgcagaatgcaaagaatcctctagaacagaatttaaccatgaattttaagggaagtgtactcctgaatcatttgtttttcc

SEQ ID NO: 57604 - DNA, 1133 bp, Homo sapiens
tgggtgacagagtgagaccctgccccccacaaaaataagcaaataaagaaatgtaaagttaccactaggtttttatttctgacacatttaatatgtaaataatttgtgtgtgttatagatgaaaatcactgcagatgacttatggatcagaacttatgccagactttatcagaagttgtgttcttctactggagatgttcccattggaatctacaggactgagtctcagaaacttactacatctgaggtttggaaataacaaaatattcttgttttgatgtttaatctgatgagtgcaatcattcataagcttataaactgatttataaaaaatgcaagagaaagtgaaaaagaatgctacctgaatacgtagtgttaaatctcagaaccaaattttttttcaactatttgttttactaaactatgtcagtcttccaaaaaatattgttggctaaggggctgttctaagtttatggatgttgggctttagatgacttttgtagatctaggattagctgttttggaagattatcaggaagcaaattaattacaaataaccttgaggttctgacacataagaaaagttctcagggcaagcaacctagatttctaatgtatacccctactgcatatattagcattttgaaggaagcaaagcaaagataatttagtaagtgttaaaattcacatttctcaatctctagattggtgaccactctaaagccaaaagaaaactctgagtataagagtagtgtcagatcttcccaaagtaaacctcagtaaatttaacagcaaacttgatcttgttagtatggaaggagaatctctggtaagttcatgcacccgaaacatatttgcattttgatttgatcacttcatgtggttcatgttgttctaagtaatttttatagccttagtgtaatatcaccttttaggtcagactcttttttgaaataaagattttggatgaattcatcattctatcaatatctataaaattatttaatgtaaattatggtttgtattcttgaatttttttttcttcagacacttcaaagttattacaaattaaaaagaaattttggtcagccattttttttggtctgatacaaaattacctcaactttgaggct

SEQ ID NO: 57605 - DNA, 1051 bp, Homo sapiens
tatatatatatatatatatatatatagttctagttcactctttcttccgaagtttcagaaaatcatgcaatttcctgtatctctatttataacataaacgtgaggcaaaaacaaagagaaagaaaaaactactgctttccatttctatagaacagtttttagaacagtttttcttctatttaacttatacatgagatttccttacaagattttatttaaacagaggatactgtggctaaaaaaatcttaaaactactggtgcataatggtacccaagcatttggctcctattgatataaaatcttcagtttcaacactgctcttcaaataaaccatcccctgcaatttaatctctttaagagatcagaagtatgtgtgtttggtaacagtgtttggagtgggagccctgcctcctgtagtacccagataatatgtctggaaactttagggataataggggtatttattctactttgttgtgtttgctccagctctcatctgacataagcagatggttcctgacgttgctagaggcataatcatgggcaaaattagcccaaagttctgcagaaaagctttaactttctttggattagtttgttcagtcaagcaattatagaagacagtacataaataagcaaaaagaataggtacaataaaatgctgaaatgcttaatttgagattaatgttatcaaataatttaaaactctacgaatatttctttcttcttaatggaaatatttagagattgtctgattacttgaatcagaaaaaatgagatattactgctattcagtttctggcagagacaaaaacgatgatattagtgtgaacaaacacctccacaaacctcttagctatgataaaatgaaaaagttaacttggcattcaggaacaaactcagtggttttagttgttgtagtcttttcatatttttctaaaataggcaataatcagcagattcttaaaatgtccttagtttatcagtttattgacatcaatttggtattttatttcaaacctggaaaaaatgtatactataaggaatgc

SEQ ID NO: 57606 - DNA, 1048 bp, Homo sapiens
caaaccattatcatctaggtggatcattgcaataatcccctcactggtcattgtctcttcttcaatctgttttcaacacaatgaccagagggattttataaaatatgaatcagaccttttgtactagtcttcaaaaatctccaatgattgccaagtcatcccaatgaaaggtcaaagccatagtacagttatttataaagtcctacatgatccctcctcccagctagttacctctgtggccccattttctccccctccctgaattccagctaaactggcttccctgctcttccttagccgcatcaagcattaactgtctcagggaagtgcttgtagctacttctgcctgtaatggtcttctcccagacctctcttgccttcttcaagatttttactcaaatatcatcttttccctagtcacactatttacattttattctacctgctaaaatattagctccctttctgatttatttttctccccacaattatcacctctaaacacaacacaatttgctttttcatgtttattgttggccctctcccactagtggctctatgagacaagatatttttaccttttttgttaactgccataacctttgaatctaaagcctttcctgacgtttcacaggtgctcaataaatattttgtgtattagctaatgagtggggactggatatacacatcagcattagatgtaatattgatgtctagcatttctcaagcaaataacatgcgatgaaaataacaaagtttgtatactgacaattagattaatttagagattccaggttaactattagaggttttgaagaaatcataaagaaaaaaaaaattccaacgaaatgacatcctaaaaaaagatgctgcctgaggggcaatgtgccagcataaaatagcaaggcaataagcaaattatttaagaaaatttatctgaactgtcctagtccgattccatccatttctgttcccttccaagttaccacattgtgttcccctgtcagcttctggaattagatttctaattctcttgaatagcttttag

SEQ ID NO: 57607 - DNA, 1044 bp, Homo sapiens
tttctccatttctcctgtggcaacaaacaaacaagaacaaaaaaaaacctactacaaggctggagatctgagtggaggtaatcacaggaaaagaaaataatagtaatagtaaataataaaaaagtaagttcttaatcttactttttaaaaaatataaggcaatgtgtattaaaaatctatatggaaaggcattttatttgatgtatcccaaaatctacttgactgagaaatgttttcctaggcagactcattaaaaggtcaacaggaacaagtattctattaaacatattttgaggaatctggatgttgacccttgtctggcagtcccatgcttggaaagtgtttaatagttcagcattcattattaaattagatttaaatatatctgccttaattctttaaggctgtctatgctctagtactaatttatttttgtatccttatctcttgattctcttatatatagcatgtactccaaattacatgatcctaaatatactttgtggtttccgccttctacatctttttttaatgctgtttcctctgccttcctagaaggttttgttaaatcaaaaattctatctcttcatgaatatttttaatctccttaattcagtgtgatttcttccttctatgaacttgcatagattttactatgttctgccagagcaggtattattcatttttttctttacttatgaggttgtaatttcattcaatatagagaacatatcttgcttatctttaaaccttccataatgtttttcacacatgcatcttcaacaaatattagttaaataaatgaaataagatgcactaaagattgagatgatttattctttgggtctatgccctggttccaagtagtttatgaaccatatgcatttatctgctctctctcatgagactccattgatacaaggaaaaagaaatttttaataaattataagcttttattgatgaaaaataaatagaagaagtgagaattgaatgaatttctgggagatggaaagtaaacaaagcaatattttctgttggaaatca

SEQ ID NO: 57608 - DNA, 1028 bp, Homo sapiens
acagaacagaggcaatgacatctcagtagcaatgagcaaacatgtcttagtaaatttgtgttgctacgacagaatacctgagactgagtaatttataaagacagatttattttcttggggagtccaaaattcagggccagaatcttgtgagggccttcttgctgtgtcatcccatggcagaaggcagaaggccaagacagtatgtgtaaagggagctaatgaggagggtgaactcatgtttataacaaacccattctccagccataggatgttaatccattctatgaggcagagccctatgaactaataaggccttattaggccccacctcccaacactgttgcattgggcattaagtttccaacacatgaactttagggaacatattcaaatcctagcaacacttaaggctcagatcttgattggtaaacatcatcctccaatataaatatccagggctccttggagtattggttgattccaggaatggggcagggaaaatacaagataagcctgaaaaatgttgtggtggcagaaagtaaggaattgctcagaattatatgggggctggtcaaaagaaacaacatgaaggaagtcctaatgggctaagatggaatcttttgggccacaaaataaataatgatattaggttttagcccataaaataaaataaacatccagtagtccatactaatataaataagtaaataagggataaggcatagctctttcttactgaagaattctaataaatatagaaggaaagagaaaaatatgaagtcaccattaggcaaacactacagtaataattgtgactcctcaatgagtactaatattaggggtgaaagtttgaggagaactagtataattgtgtgcttttgacatgcctccctaaaatagttaataactattaagggaaaatttgtaactttatcatggaggaacctgggagacaccatctaaaccaagggatcaagataaccacaatcaataaagatgttttcatgttgcctttcatatgatgcact

SEQ ID NO: 57609 - DNA, 1052 bp, Homo sapiens
aggaagccagtctttatcagacattgagtcagctggctccttgattttggactttgcagcctccagaattgtgagcaatacatttctgttgtctataatccacccagtctatgctattttgttatagcaactcaaaacaagatagtaactttaagttacaagaaagttgatgaatagtagtccagcatggtttacatgtaccatatgttccttacaggcaaatattcaaatatcagaatgagcccaataattctactaagattcatcaagtgaatacttgttaatcaattttacatgcttttaaatctgaggtttgagggttatagataacttaatggaggattactgtcatttctctttcactagaagtacacaattttaaaggaaagggaaaaaatagaaagtaaaccactatataagtaaaaggatgccaagttataatttttattttattttatttcattatgtttagtgttgtgttgaagataatgggccattctaggggttttaatcctgctttatccctcagtatctaattagacttggacaagttaaatttcctcattagtaaaatgcagatattctgtatcttacaggatttctaaggtgaaatagacaacacacatacaccttttaatagaggttggcagtcagttatcgaaaaaacataagttgtttttcttattatgtgtatcatcttagtaatagtgaagtaatatcattaaggataaaagataaagaacaaaaatgaatttcttaggaaaaatttaaagtgagacttatctgctgacaccagcaagaaatgtaacattaataataaaagaagaaatagaagaggccaggacgtctatcaatatgaaagaataagctcctaataaattgtccttgcatatgacaactattaaaaaatctatagaacaagcatacaaaggccctagtaaacgaactaaagtaggcagattttagaggaaaattaaaacttggaggaagtatcttgcatgttataatttccctgtttttgctgctgtgacctgagggcagctgtggttacc

SEQ ID NO: 57610 - DNA, 1060 bp, Homo sapiens
atatgtatagacatcagagagaaaagcctgaaatcaagaatcctatacccacttctctaggtgtaagaaaattatttcaggaaatataaggattaaaagagtacacattccatctgagaaaaatacacagggaagaataataaaaaaaatggaaagatgacaaaatatgcaattggctgtgaattatgcaatgcattcatttaatcaatatttattgagaaactaaatccatttcagaacttctagggggctaaagatagagaaatgagcaagtagagaaagataatgctttcagatagcttatattacatttgggggtgggcacagatgggagatgaataataaatgtttatcttttctatgttgagtaccgataaaaactatagggaaagatagggaggtaaatttcagatagtttggtgaaagaaggctctaaggagtaacatttgtggtgacacgtgaattatccccccattggatgtggcatgatctaagatatgactatagaggttgagtgaccaagaagtggaggaaggaaagattaatgtgaaaacattaaaacaacaatctgagaagtcagactgtttcagtcagtatccagtcaagaaaacaaaaattactgtctattggaagggggaactggtggcaacattatagaagtactcaaggaacaaaaataagaatatgagaattttccacttctgaactggaggaattaaagtaaaatgatgaagttgtcagtatcatggcgctgccttacaagaatttacaagccacacaatcactgactttggagatccaaggagtcaaaaagcatccctcaatgttgctgcgaccacctgagccaaagtcctcaagtgccgtagtgttgaggctatggaaaatccactactgtgattggagtcagatcctaagaatatcgttctactgcagtctctggcgtgccttctgctgacacactccacaaaagccaggcttccacacacaccagctattggtgctgttacttaaaaggccaaaaaaagataaaacaacaaaaacaataacacaaactgaaaaa

SEQ ID NO: 57611 - DNA, 1049 bp, Homo sapiens
cattttgttaatcaaagaaataagacatatatagaagtaaaatataatggtagcacaaaggacagaatggagcaaatagaattgtattgttttaatttttatactatacataacgttaaattctggaagcaatcattacaaatgcaataaaacaaaataaaacaaaaggattttgtcagtaaatcaataatggagacaaaatggatctttaaacatacttaaaaaaaaaggagtgccctacttaaagtgtagtagaaaaaaacatgaaaacttggcaaagtgcaagaaagactcccggaggaagtctgcttaagacatccttttcctcctccacttccaatatcagcttctacctgttcatgcctcctgaggcaggcaagaaaagtgccaagaaggaagcagttgggatattttttgccattggggaaactggagagcctgagactagaataaagttactagagtgaggactgaatgaatcggaaccagataattgtttaaacttggagatccagtgtaggtggacatcggctggagtgaattttaccaatctgcctgggctccaaagagttaaggatgaactaaagagcttggctgaggcctctccatctactgaaagtgggaaatttgagaacagggtcagaaaggtttcttgctggtgcctcagccaggttttcacagccagtgtactgctggcccccaggagcaaagacgcctctgctttcctgagaattgccaccacttgctcaacaagcagataaaagaaaataatcatctaagagggccaataataaaagaagggaaaaacaaataataatctagataggtctctaattaaatagacttgctcatggaaatagaacacactatggaatggactttgaagatatatgtggaataactaatcaatactatagatgttcataagagagaaaaacaaaagatagaagaaagataataaacaaataataggaaaagaaggtatgctgttttgaggaaagatgtgagtctagagattaaaatattagaaaaaaaccaccatctcagca

SEQ ID NO: 57612 - DNA, 1019 bp, Homo sapiens
cctttactgtttttatgtagcctggatgagggtgataaactatgctcacaaaacctattacttaatttcttagtatatggagacaatagctgctctacaactttcctttgggatgtgcaagtatattccatcagtgcagtttttaaacctttggggccttaaggaaaattaagaaagagtcccaattttatagtcagtgttataatggataattggagattacagtatagcagatttcaaattgcctttctaatacatagatctcttcatagaagaataaactgctttaggaaagtctgtgctcattatcgtcagacaccaatcaagaaagtttcagtggtgacctcttaatgttagggtcagcttcatggacacgtattctgtgcataatatcagggtcagcacaaggttccacaaccagaaggtcctcgtgattagttgaatgttctaatgttaccttcttgaaattgttaatgtcttattaggaggcctcatatttttcattttgcactgggtcctgcaaattatgtactcagtcctgtttaatatgtttgtattatgagggtagggagattagagtctagatgattgaaaaagtcctttctttaaattgtattaaagtgaaaacaattttaataccaatgattgttaacaagggtacgtttcacaaactaatatacttgatggttagtgaatatcattattatagtaagtaaaacttcaaattgtcactttttaattgactgtaggttttgttaatgtgttttatttttactagtacttttcttccatgacatattacttgataaaaaatgttatgtgcaatattcctggtttctacaaacatttgttttacttcttaaacttacaaaattgagagagcacaattaccctaagaaaaataatctctaaaagtcattgctacatctctatataatattcagtattctgttaatggaagcatccttattgctagagaaattctaagtgctgtctttttccccctttaataggaggca

SEQ ID NO: 57613 - DNA, 1012 bp, Homo sapiens
catgtgtgtcacttcactaagactagggaggaagaaggttcaggaagcatagaaagtgagagctgaaggaagaaggacaaggcctggaggcaaggcaaaagagagcttagttaacgtaagagttgttcatttttttcttaaaagtccaaatgaatattcttgttgaaaaattgtacgataattaagtctggttgaggaaataaagcgatatcatagtgtgctagattattcatattatccccagcaaatcagaagcatgcattttaaaattaacaaatgtgttcctttttggagcaaggttatttgggagtttctgtttctcagcatagatgccagatggcagaatccacagattgccaacctctgcatgctgatagttgtcaactttggatgctaacagggtgttagaagtaaccactgcagagtaacttttaattcagtatatattagtgagcattcactttgaattaggtgctgagcatacagttataagcaaaaacttctaagtatctcgtcagtggagcttgaggtttaatcgaactttaagaagctctgtgatgacaaactttactgtgacttaaaactaattctaaatttttatggaatcctgaatgccataattagaattaattgggagaagaaaggataggcatggggaaattagcaggtagatcagagtacctcctttttcagacacgataaggtgatgggaagaagagagtgggtgtttatttcctttccaatacttccttctgtgtcactatacatcactcaccctagggatccaatctggcagtttttgcagtaatatctaattaaaggtcatgccttagaatagaagactgcacatcacagtactttcaatgatgtgaaatactttgttgctatttttgtagattgataaatggatggagttcagtttgggttcaatatttccatttttttacttaaagttttgttttgatttgtttcactgcatcttggttgaaaataaattttaatttgaagtcaa

SEQ ID NO: 57614 - DNA, 1005 bp, Homo sapiens
actttggcatgatgctaatttgtaacattttgatgacaacagtgagataaaatattacagaacattctctgtcaggttgtgcaacttctcacattttgctacataaggacaatgagatctcattgctttttcttagtatttctgaaaggcattctttgataaggaagtttgatttcatttggaacaaaagacgcaccttaaaatagtaaatttctttttaatttaaaagatgtaaataactgaaaagttggcttattgacctacttgatcatggaaattacatgagcttattcacaaacaagtcttcaaaaaattgaagttttttttaatttaccctctttaataatcctatacttttatttttgcatacttatcactttgatgagattagatgctcagtggtaagtaaaatagaataacattgctattaattaataaaccttgtgtacatgatgggccagactattattctattgtcagcccaccattttttttttctacacgagatcttgttgagtcatgaactttgtatgaggagaatatttgcaggggccatgaaaaatgacatcttgactattaattaagactaagctacagtgttcactgagaccattagattcctcaagaaatgatatgatggcatttgctatgatttttaaatcctcattcaaaattatgataaaaatccaaatactatgagaattctagaaaagttgaattttgtaccatccctttatgtcattctaaaacaaggaacgttttattaaaacaaatttctaacttttgcgggtacatggtaggtgtatatatttcaggggtatatgagatattttcgtacaggtacatgatgcataataatcacatcatggaaaatagggtatctataccctcaagcatttattctttttgttctgaacaattcaattatactgtgattataaaatatatgattaaattattattgactatagaccccctcttgtgctgtcaaatactaagtcttat

SEQ ID NO: 57615 - DNA, 1572 bp, Homo sapiens
gacccatccattccatttatttgggcaattgaattatcgactgagtggaatgacaaagagaattcattagtattaattgtttagataaatatgtgtggtccaataatcaaaatataaattaaatatatgtgtagaaaacctttagaggaaacgtttcttttcctctcttcacagtttatttactcactaccagttacttgatgtgtaagtcaagtcccatcctctctttgaagagataatttgtgtaaagtgtttgacacagaacaggattgcatagtatcttaaggttatagctagtttttaattttctgatcttccttttgcctcttcctcactactgagctttcttcctagtctcagtttttgcgcttattatttcatttttataactactcccttgagttgtcattttttaaatatctgcagtttctccaactagactccaagtctcttctacatcgtattgtactcatacttgaaaataataaatgcttggcaaatactgaatgataagcctcttctgcctgtgaatggtccttgttctgagcagaacacatgtgtgctgactctttttcatgggacccacgcctactggaagcaccctctccattcggagttcatctttgcaaaccccacccccaaacaaacaaacaaaatgttttgtttggaaccctgggcaaagtctcctgaatattagactgggtgataaatcatgaatcatatttgtacttgggtaaaatttaacccaaattccatttggaatcttcaagctaattaacttcctcctgagtcccaaggttctttttctagcaaagcttatatatttactattaaaataaaatctgatataaaagttgacaggaattttctcttgacaacattatttctagttactacaatgtttgacaatatacttttctgaaaatatgttcattcatctgtactctttctgtctcatcctcatactctgttgatttaatggtccaggcatgcccctctctgctaatcttttcttctaagcctcttggaatacgtgcacccttacaaataaattttccagcaccttcagttttttcaaggagagttcatccatttgttaatttgaataggaaacaaactgtaacattagaatctttttaataaaagctgctcattttcatactgctccccatatatcacaggtttggaaatgtgttacccctcttcttacaaattatacaccattacatttccccttatttgaggcgtatgttatttattacagcctttgcttttttcttgtcactgtgttttgtcaacctttggtgattcctccacaattatggagggtttgggcgggagcttctattctttttattttattttattttattttatcttaattccagatgctagtatcattgttttcgcattctttgcccaggtaataccctgttccagaccctgcctttatagttcctttagtttggtgacttttatatccaattctgcctggcaccctcttgttaggctggacctgagtatgaccaagattgctctacttctggaaacttacgtggcaacatcccacca

SEQ ID NO: 57616 - DNA, 1111 bp, Homo sapiens
gaagggtgagggttaaaagactatatattgtgtacagtgtgcactgctcaggtgatgggtgtactaaagtctcagaaatcaccactaaaacacttatccacataaccaaaaaccacctgtgccccaaaaactattgaaataaaaataaaaattaaaagcctactacaaaaaataaaaatgaaaacccagtacagtattacaattatttacgtagcatttacattgtactagttattataagtaatctagatttatacttgatgggagggtatgattaagttatgtgcaaacgttatgtcatttatatcagagacttgagcatttgtggattttagtatccccaggggtcctggaaccagccccctctagataccaagggatgactgtttatatgcacatagatagagatatatataaagcacatgactattgtagccaacttctggttgctaagtaattcatatcatatgaataacctcaagctagtgcacagctttttaatttgtctatcaccattattatcactataattatttcaattatagtgaattaatatcattaattcattaatatcaattaattcattaatatcaatataattatttcaattctccatttcaaaaacttacagtagatttgtactatttttttcaaattccctcctcaattaggtattgagctccacctattctttcttggtacagtttcatcctatcttatttaaattactacagcacttgccagcatagctcattattccaggtctgttttatgcaccctatctccaataatcttcaatgcttaactcgagcctcagtcaacctatgcattttcatcatagtcttcttaaacatgattttaccatatcatattcccatttaaaaacctatggtatgccgttaatgctattatttgaaatataaactgctgactcaacattcaaagctctttattaattggcttttcttcctaaaatgctttttgaaatttgatctgtgtatttattcacagaaatcatccctcttttcacaagctgatgtctgctttagtgcctttgcttgtgtcataccatgatctgaggctgtctggtatcatgtcaccccctttttca

SEQ ID NO: 57617 - DNA, 1017 bp, Homo sapiens
aaaacaaactaaggcaatggttttatttgtgtgtgtatgggggtatagattattattgattgattgactgaaatagggtaaaggtagttagtatcccagaaacaaaatgaaaacagtatcccaggaacaaaataaaaacagcacaatggataatatgaaaaagcaagtgaataataaatgaatcatgagcatatatcaatcaaaaagacatcatgtaagatcaaatagttaacttactaagacgttttaaaatgtccattttgaatgctttggacagggtcatccatttatttgctactttagttaatccacaattattactattttttatagctatgtgttttattttttaatatttttctcagtaagactttaagatttcctatttatgcttctatctcctgaagtatttgtactagagtgaaattgatttttttctcaacactgtactgggataatgaaaacactatgcagggatgttatgaaatttacatatcataaagtgaagttacttgatttagggcttaacacttacacctacttattagtatgttttgcctattctaaagatttgcagtggttcacagaaattcatgcaatagcatagagtaaacagaaagtacaacagaatgaaaagataataaggaaaaaaccaagttaggagtatgtaggtacatagtatgacttccacaaatttgtatgtatttactggagatgggttgcgaggttagccagagcaaagataagggcatgatcagttgcataagatgagaaatgaactggtagttcagaagaaacacagctttccttggggctcaaatttaaagaaaatttatcctgtggatctttgattagtgtacagtattcttatccactctcctatcataaaatagcaagtttcataagactcataacattctcactccctggtgctgatataactatagagaattgttctcttaaagtagatctacaggacacacccagtactgtatttcaggtatatcccataggaaa

SEQ ID NO: 57618 - DNA, 1010 bp, Homo sapiens
taaacaaattgtcaatattgagcatagatactgttttactcttgcaattaaataaaatatagaacactgttaatctgtcattcagtgtgatccatatcaagtatggatatctaatataaatgtatttctattgttgtgctccataacatagaaaccaagaaattcaccacacatcataaccatgttttacttcgtcaaccaaactacatcattagtttttgttgcctaaaacaatcactgatagtgacaacttttctgatattatgtgttttgtcactgtagttttcttaattaaacgctcatgtaataaaaacaaaaactttgtgctcttaggagctgtggttcctttgcatgccttgcagccaaccacctccatctctccagcttacagctttgtttatgtgtatttggcttcacaatttgtcccagaaaattcggtattggcggaccctaagacacagggatatttcattgcatacctctcatgtagaagagtgatcacgtacatgcttgcagcagatgaatagaaaactaggctccatggaggccagaaaacaccgtgaaatgatgttggattctctgtagctggtcatataaaagcagaggagtgaattagaaatttctgaccctgactccttaataactaggtacaactagaacaagctgactcatacataaagtcttacatgtagtataatttcagattaaggaggaaccattgcatatacatgaaaaaataaatcattaacgtaaatgaaataaattagttcagtgatattagacttatttgtctctcttgactgggaagtggagatggctttggagtttggaggtaaagagttgagaacctggaaagccctagttgcctgaaagaaagaaaaatatgctcttggatgtgaggcagaagataatcagcaaaagagggagactaaggacagtgagatttctctccacaattttgccttagattgaacgtatttatcttagtcttttctgagaaatagaagcag

SEQ ID NO: 57619 - DNA, 1053 bp, Homo sapiens
aagttgtttgaaaaagcacattagaaacttaaaatctcctgagtctatttacctcctccttgtctgtgttgtcttgagtaggtatctacttggcactggaaattttatgctgtttaaacattttggagttttaagtagacaattggtttaaatatgtaacaggtagttagtgaaaatgacaacctttttaatacaatatactcactttgaacaggtgactctgaccattatgaataatgatgtttgtataacatgatacaaccttttcataactagtatatttttttaactgaaacagaatatatgtctcaaaattaaaattaagtttcaaaactagaatatttattgttagcaaaatattgttcatgtgttttatttatagcattactgctttgcacaaacttctgaaattcctctgtctatttctgtctcaagcacattttgtatttcagcgaatttagtattttctggaatagtcatcccatatatcacatgccacatttctttgttttaaaataatacatgtatactaactaggttctcaactcaattgaaatgtttcattgaagtttagtttagtattgatgtgctattttagttatataaaagatccattattggtccaatccaaaatcccctcctcattcaccactgaccaatacactctatttcttttcttcaccttttcagctcccaataccaactcctgtctctacacactgaggattttatcttgagcatcaattatgggcatcttgtttggtctcatattagtaatttgaaaggagatggatgttttgtagaggatattttggttcaatctcttttttaggcaaaaccacacatattggctaaaaatttaaagaagtaataccaatttctcagtattcttgtaaagtgtttgggtaaactgaagataaagaaaataatttttaagtgaatttgtaatacaaattgacatttagataaactgcattagcctggttaaatggcttagtaagtgtagcatggtgttcctagtgactgaatgtatatttagttcaggacctcagg

SEQ ID NO: 57620 - DNA, 1033 bp, Homo sapiens
ataacaatgatataaatccaacaagagtggagggagggaaataataaagaaaaaaataataaaattgaaaaacctagttaactaacgaatccaagaattgatttttttgaaattactaataaaataggtaaacctcagataagattaagattaaggagaactaaaaagagaacagacagaattaaataatattaagattaaaacaatgagacaattatgaacaaattaatgccaatatatttgaaaatgcatatgagataggcaaatttctagaaaaattagaagttgagaaaactgattaaaagagaaatagaaaatctgaagagtcatacaactactaaagacattcggtcttcaggtaagacttaaaacctgattccaagcaataccctgaacactcatttcacagtacaggcaaaacattgaatgtctatgtggaccattaccaatattccatcaggcagaagcctacctgtacaggatggatgtggaaatgagaatcacaaaaaaagagaatatgtcctatcttcttgttacaaatatttaagttagcttaggatgaatatagaagtgcataatttaattaataaaaaatgtttcaaggaatctcaggagcaataccagggactaggcatacttacagccaaggtctgcaaagtaagtgcacttggaaagactttgaatgacaagaatgctgatgtcagccaaagaccttgtttctccccagattggctcaagctgggccagatccttgctatactaccaaaaaaaaaaaaaaaaaaaaaaaaaaaaaaagagagagaaggaaatgagcctccaaaccattcataattttctctcatcccctgggggcactcattaagtgtaagtaatttagctctgattgacacaaactcatagtgggtttcacagtatgtctgggagtagagagggttacacagtattttctgagaatggagcatcagtgagaaaccacaagctggatccagtggaatgtaacatatccaaatttgtacaggatttatatcacaag

SEQ ID NO: 57621 - DNA, 1029 bp, Homo sapiens
gtgacagtaggtaagaggagaacaagaaccaggtttacaaggaataagacactgagagtttggctgatgaccaaaaggcagtggtcaagctaaatagcataagcttcaaagaagccagcattattttttagaaaggatggagagaaatagtctggaactagtgatgggcaataatatgaagttctcccacctctttgagcagtttgtaagggaaatgatgtgttcaggagtagctacaatttagttaagagaaaaaaggtgaaggtaactctaaagagaagaactttattaatgccagactttttttttttttttaacagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatgattatattattcctgtctattatcttaaagtattatagtagtttcaatgtaatcttattactaaaaggaaataatagctgattacaccttttttataggtaagttgaggaattttcataaaacaaatgttagaaattgaagttctgtctactcactaagaagtgagactaggataaaataatctcacaaattcatatcaatggcatccttatctatatccttgactggctaaagcatccagataagcaagtgagcccttctaggctcacaaaaagaatacacccaccactgtatttactaaaaattcttaccattgaactgatgggggttataatttgaagtggaaggaacatgctattgcttataatagaatcttgttgtgtagttatacaccacagacctgaaaatga

SEQ ID NO: 57622 - DNA, 1733 bp, Homo sapiens
tctttttctcatacactttgcccgtttttccattggctgttcttttttgttatgatttataggagttctttatgtattttgaagaagaattctatttgtttatatacattaacatacatttacatataaagtatttagtaaaaaaaatgcagaatgatacatgcagtttggtagaattgtaaaatgaagacattgttgtccaggattaaatatactcctgtgcatgtgtgtgcacacacacacacacacaggcacccaacatggactggaaaggtttttgcaccaagtggagtggggaagtaatgcctctgtggaaagctgaaagatttcttgatatactgttctatttctttcatttatgtataaatgtatatttgtatatttttttaaaaaaacctgaagtagaaatgaaaaacaaaattctatgttttaaacagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggtaattgaaacttgtatagttttagttcaaaactttagtttgcaattcatctacatgatatctaacactataaaaacatagttaccattttaaaaagctaacgcattagccggtagaataactcataagcactatactaccataatttcattgctaagctctttattttcaaatgctctagaggaggtttataatcaagaagtaaaaatattttaacattttgaataaatttagacatctttggtcgataaatgctgtccagtttacatataggaatattatctgtatttctttttttgaaagttgattttgctatttatttgaacttgagattttaattgaaatgtatgtgatcatgtcaaataaatttactgaaaatgtttacattgtgaaaacagatgtagatataaatagaaaacattggctataatcttaaaattactctgttttatctctttaaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctaggttagtttgtgttaacatgtttaaagaatgatgtaatactacattattagctaaaacttcattttgttgctgtaaatttacctgtgtgtgtgtgttttttttttctttcagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaaggtagtttttcattttattaatgagatattcactggtcaacaaatatgcccctgcaaattaagtttgggtttactcatcactagggcttaaatctctaagttaaattcatttatgtgcaagagtcttaggatgaaaaaatgtttattaacataaatgtagatttaagtaccaatttttatattat

SEQ ID NO: 57623 - DNA, 1722 bp, Homo sapiens
tgttagtccttttccctctcacaatgaaaagtatcaagaggatgagagggaaagagcaccaggtatctattgacccttgacccttggcttacaccttcatcttggctatagacctatgtgagtttagaaataatgcttcatcatcatttcatatctatgaaacatggcattcttagactataaatcataattatgccatctcattgagaaattcaagaacttctagtgggttggaaatctttttctttctacccattaatgttacttgtaaatttttccttatagagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagagtaagtattttcaagtagcatatctcattcttataaaatgaaagcacttgatgttaaatagtgttaagaaactttggattttagagaataatttcagaactaatatgaccattaacttgaattaattcagctgctagaaaggtaagtgacaagagcactgactgtcaaattttttttctctgaacctagtcctactatttctcacaggggttcaccaccaaagacgcaaaataaaatttctcttttgtaatgaatcttaacaaaggaactgaaaatatgagagagaggctccatatgtgaaagaggttaaatgttattctagtagctttttgccaccaccaagcaacttttgaggtgttgcaaccagcattcctgtgacagcttccacatcttcagcaagagagaattatttttagggaggtcatgatattcaagcttacaatatgtgaagtactggcatagacaaaacaatttgatttgaagttaaataggaggaatgtttgtattttgtttattaaacatcaagtgaaagtctgaagcccaacagcaactgtagaaagctccttctgcagggtcttatgctggagttgcactgtactatttaatagtagagaagttaattcatatactttttctgatttaatatcaccatttccaagagttctgcttggaattctgtaacattttttgagtttaatatttatacccttctctaatagggcagtctagttgaattagaagctatggttatttagtaaagtacccaaaatataattttgctttctacactctgagttatgagttacactactggaaatattgtatagtacaatattgtaattactttgaattacaatataagtaattgtaatgattaaaaattagtttattcttgctagtttatataatttgatgttgaggttatacaaaaaaaaacactcattgattaacttaggaggcagatacttgaatatgctttgttttttcacctttagtttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcaggtttgcttcttctttgcagtaaaactatatgatataatttttctgttagaaatttttgatatgtaataaacaatttccaaat

SEQ ID NO: 57624 - DNA, 1108 bp, Homo sapiens
tcctctttctccccagaacctgcagtaggtcaatgtgttcattttcttttcttccaaatggattgaggtgatgaggataatttacataatgtggggcttttcagacatgtgtgtcttacaatttataaatactggttagggttttgttaggctgggctggcagccagccataaggtatgtgtgataaagcacataatacgtgttcactatagtaagcaccactgttctcagaagactcattacatgtcaaagtctaaaagagtcatgatatgactatgcaatttatttttgtctgcactaaccttattttaactgtctttatactgatttgtcttatttacaaaaaaaaagagacaactcattgcatacttgttatatttatgtatttaataggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtaatgtatcatagttctgtggagagtgtaaaagtatttgtgtgtgatagctaagtctttacataaaataacactgcttattgatttttattttaaatatttgttatgcttaatttatatggttggttttgttgatattttctttattaaggaaacaaaatacatctctcgtactgtcttgcttttttgagatagagcatagcctttaattaatataatctaaaaatattatatacttgattaattcaggttcataaggattagagtaaggacagagacgtaggaagtgaataaaatcatttagttaagacttggttttcttattagtgctttgggccattttgctgggtgacttaactactggcaaaatttgttttcttactcattctttttttctttgaactttgtattattcctcatactctttgtcattaatgatgaagaccctaattaccaacctgtctatgctaattgtatttcactattcctagcttatttctcacacacacattttcagaagctgttaccagatcatctttttttaagtt

SEQ ID NO: 57625 - DNA, 2794 bp, Homo sapiens
gttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaag

SEQ ID NO: 57626 - DNA, 1555 bp, Homo sapiens
tatgtaattttcaaatacttgctaaatttggtaatatatttgcctcttctaatttatttactttccatctttaaattctctaatggcatgtaaagttgtattttagttctatagagatgatctaaaaactgagataagttacaatttactttagcctattttgtccatgaatgccctgacccttacaacttttgtctcaaatgcaatatacttctgaactgcaacatttgaaaattttatttgtgtatttatttatttactgtaacagggttgtgcttttaacttgagcctctacagtcctaaagcccataggtttcacaagggcattgataatggtgttagatgacttaatcaacttgttatatacataattcccctagcccgattttggaattgtctactctttctccccagaggaatgatccaatatatagcacttaccattccttagtatttatgtttcaatctattggtcaccttttttatatgtaaaaataacagtttgattatttccatagttgtttcccctattgcacaattttcatgcacagataccaaccactgattgttattaattaataattggaattatagctaatctctgtgtagagcctacccttgcatggtggacggtcccagacagcaacacaaaaagctgccagacatccctgccataagttattccttcccaccagaggaaatagttcattttctagtctccaattccagtgaagtaaattgagaaatctagtattggacagtatagcaaagttactttaaagccaaactgcctgattcgtatcctggctatattaccaataaactaacaagctaattgacctcattgcctcagttttctagtgatcgtaagagtagtatttgctcatttgttcttatggtggtggttgtgagatttaaatggattgttcatgaagtgttcagaatggtgctggacatagaatatgttattatttacagcaatttattatcagaagtaacaagtagagatatggggggtattgccttctaacataactagggagctgggtcctctttgaccacaaatgttgggcatctcagataccacttctcatagcccaaactatactttttcctcttcagcttgtatgacctaaggccacaatgtattctgtgctaaaggaggaggtattttgtttctcccctttagtgttttgctttgttcaaattgttacaattctctaacacattctttttttcatacaatcctcccctttcctaaaagttaatcatgaattcagtggacctgaatctgagaaacataccacattacacttcaaatggcctttatcttgattactgaggatctgtgatagatcaaacatgtctaatctttatcttagactatttcttaggaatctttgtttcatcatacaaaatatctgcaagcccacctatcagcgctttcgacatgcctggaattatcagtattccaaagatgaacacaagaagtgtaggggtgttttatttccagtatcaatttgattggtgtttaacatatggttatcttacaaag

SEQ ID NO: 57627 - DNA, 1613 bp, Homo sapiens
atatatatatatgtatatatatgtgtatatatatatatatttcaatctaatcttcaccacacctgcaaagtaggtgttatgtctacctctcagatgaggaaactgaaactacagtttacatcattgataaatcccatgggccccaaatcccatgttcttaaccactaaacattttatcacttcagtgtagatggtgtttgcctttggggaaaaaaaaagcgactgttttgtactaaaatatccatttcaggcactttattttctttgatttttttaacttcctggtttaaaacatctacagtttctctaaatagaagacagttactttgatttctgtgggttaaaaataatctatggaaaatatgaaggtatttatctttttttgtgtttgttttaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtaagtttctttgttttttgttttaacccaatatattttaataaattttgatgaaagtcacttaaacttaatgcctgaagtcttttcttgaatttcttagttcatctgtgtaagcaaactttccctcaaatgagtgaatgttttatcatacactgtatttcatctaatctatcaccaattgtgtgatacatgataattttatcaagaaaagaaaaatatgccctagatggaagtcttagtagaagatgcttgcatagaactgggacataaaagaatcatatcattattataaagttcaattcaaataagcccacattcagaaagggacaactaagaacttaccactagttagaggaagaagaacaaaatttgagtctctctataatcatttgttaggttaacactgtatttctgtatgaagtatacttcttagtgtaaatatatgaaaaaaatttcccctaaacacgtggataaactatctggtaataaatataagacagaaacagtgatacacagtatgtatagctaaatatggtaagccttgcaatatgattataccaagaagttattagtacaaaaattgttaaacatatggataatcttctatgttttaactaaatactagagagccaaagttgatcatcggtattaattaattccatatttggaatttgcatactagctaaaatttctttttaatgccaaaattagtagttgcagtattttgtggtcatttattgacgtgtgtgaatgcctgggccctcatagccagctgatgtcaaacaaggtggtgctctttttgtttcagctcttatactgtaaacaagcgtccttttcaggacctatttagcattgtacttttttgcatttttgtgctttttgttggtgagttccctgtttaaaatggctttcaagtgtagtaatgaagccctgtctagtgttcttaggagaagactgtgatgtgccgtatacagaaaatatatgcgttaactaa

SEQ ID NO: 57628 - DNA, 1773 bp, Homo sapiens
gacctgtgctttccaaattatcttggatgatttgcagatgttttctacattgataactatcataaaaatttgaatatttaggtttctgttataacttcacgatgtacttaatgggacagttataaataaatttgaacaacatgcctatatttgatagttctttaacttaaatgaaaaaattaaaatgggaatgttgctcgtcagatgattaagacttatcttagtcctgagctttgtctttttgcattgcaacgtatactatatacaataagatatacataaatcatatatgcatagtttaaagaagttatttagcaaataaccatgtcatttagaaagtagaacattgccagttccttaggttatggtctgccattcctcagtcacttccctttgtttcttagagatagcataattctgactttggctttaatttattttcagacaacttatggagaactcatatctttggaagataacagtgatgtcacagggttggctatgtttattctgaatcgcctactttggaatcctgatatagcagctgagtatagacaccccactgttcctcacctgtatagagatggtaagtatctctgcctctcctacattctctccacattatacatgaatggcttattgtcattcttcctgtttctgtttacattttcctttctcaaagaaaccaatctaaataagtctctgcttctagtactctcccttcctccaccctcattccccgttaattcctccatcactatttataattctatctgttgtctctacccatcctctccccccagtaggttgtaagtcctatgggggtcatgtttgttgtaatttggtactgtatatctaacacctacgatggtgcctgcatgtagtaggtgttcattaaatatttgttgagtaagaccaactaaatctcttgatgcctctgtgcctgtttcctcatctatgaattgaaaatattaagtggtgcatacttgtcccatagagatattgggaggattaaatggatttatacacataaagcactaaaaaaggcacatagtgttttatttgtgcttgctaccctacactttttgttttactaacaccttattattattattatcatattttaagatgaaacctacctttcatagattaacttgctgtgcttttttgtactttatttaaggtcatgaagaagctttgtccaagtttacattgaaaaagttattgttgttggtctgttttcttgattatgctaaaatttccagactcattgatcatgatccttgtctcttctgtaaagatgccgaattcaaggtatgcttttcattgtatgctttatattttatatttcccatttacgacttttgcttgctttcatggtatgttttctctttagaaaaaaaattagttttccaaagaataatactcagaggagtaaaataggaatgcctgtctggtgagtcccatcagtaattctaaccatccctcgtttttattggtttacctttcatcagcacattatcattactcttaattttgacttgaaaatggattaaactatgcttctgaagatttaatttttgagaaaatttcttccctaattttgatgtagtatataatcaagttaatgctagtttttatagtgtattattatgagcaacttttagaaagatcttaagttggaaatatgtatgaagtttgcattattaatgtataatatgaaactttttatattattttatttttatatgtacagaatgatttggaggattt

SEQ ID NO: 57629 - DNA, 1120 bp, Homo sapiens
tttttttcccccggctttattgacatataattgacaggtaaaactggcatatatttaaggtatacaacatgatgttgatatatgtatatattattaaatgattataacaatcaagctaattaatgtatctactcacatagttaccttcttgtgtgtatgtgtggtgaaaacatttaagaagtactctcagcaaatttcaagtatacaagtcactgttattaactatagtcgtcatggtgtacattcgatctccagaatttattcatcctgcgtaactgagactttatactcctttgacaacatcgccccagtccctctaccccattctctggcaaccaccattctctgtgcttctataaattcaacttgtttagatttcacatataaatgagatcatacagtatttgtttttctatgcttaggctatttcagtttgcataatatcctccagattgatccatgttatcacaagtgacaggattttcatttttaagactgaatagtacttcattatatataaatatatatatatttatcatatatatttatttgtatatatacgtacacacacatacacataccccacattttctttatccacttattcactaatggacacttagattgattccatatcttggatattgtggataatgctgcaatgaacataagaatgcaggtatctcttccagatactgatgtccccaagagattttgtatttcaaaactaggtatacatgctttagctttgctgccaaaaatcccacatacttgaatatgatcatgtatatttaagactataagtgtattttatttaaattaacttatttcatataagcaagtatttttttcccactgatatactctccttgaagttttatttcttgtctctatttgattatcaatttgaacttatttgcctttgacatgcatttcaggagaacgtcagaaagtcctgaattggctgttgtcctacaatcctttgtggcttcgaattggtctagaggtaagcatatatttcaggtttctaaaataatatttttttattatatactttttgtagaatagactcattttattacaatgtagttttacttataaaagttgaaagtcattaggt

SEQ ID NO: 57630 - DNA, 1312 bp, Homo sapiens
catcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactggtgagtcttgtttataaaatctactgaagtatacctgtaaaggggatacttccttttggtttagtaaatctgctattgataagcttgtattatagtttttacttatttgctgggtacatttccttagcaaatgtgaatacagctt

SEQ ID NO: 57631 - DNA, 1036 bp, Homo sapiens
atttctcctttaaaacagaaacttgtctgtttctcctgaaaaacaaaatttgttttgtcatgtcagcgtttaaatttggcagattctgtctacctgccagggtgtggggtgtagatgttaaagtccaaactctggcattagactgcctgggttctaataggtacctgcgtgactttggcagacttttctggatgttagttacttcatctgtaaaatgtgcataatcataatacctgcttcctagggatgttagcattaaatgagttttacaggatacctgcacttatgcctggaacaataatacctgtttaagaaatctcagtatgatgatgtggaccttagaggaatttgtaaggaagaaggaatttagctgatcatctttacatttctttttaaataaagtcttcataatgcagggtccttgtgtttgaagtagaagtactctacacatctaaaaattagaaatgtacaattaaatcttttgaaaccactcaaacaaaatgatttagagactatctgttctattgctttaatacagttaagattttattatttattttgttgtgaaccctgttatttttagtgactttttttcttataattaagcagatagggtaggagaaatatatttgatttattaaatgtttagtatatagagtgttggttaacaattattaagccctactatattgtaagttgtatataaggtgttttggttattatgtaattactattgtaattatataatgtattgttttgattatagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaaggtaatgttttaaccattctgtgatttactctaagaaattgtttaataataaataaaacttattttgataacaggcttgaagtaatattgcttatttaatattcaatagctacaaacttaattggta

SEQ ID NO: 57632 - DNA, 1820 bp, Homo sapiens
tgattctgctggctagattgtactgattaatagatttttatttttatttttttttggttatgggtgttatgattgtgttgcctgctggttgggcaactttttttttttaggttgctttatgtttatataggcaaattggcactaagtgttagtgtgaatatttgtttttatgatttatatatcattttaaaaatctctgttgtggcctttatagttactgtgaagccactcttgggcctgtctctatatgcttattagaggaatctgacaagtaaaataaaatgagtagtgtgtctgcatctgtgtctctgtttctctgtcttttaaataaccagtaaccataactacacagccctgcactgaatgaccttatttcagtttgcctaaaactgaacaagaggtgatggtttgagatgagtttctcattaggagcagcaacatcccaaccaatatataatgagttgatcaactcaggaaaaattaggactttaaagaaggttgtatttggatattctaagattcagtgccaaatttaaaatgcctagaaatgtattctacaagtagcatttctaaaactttaagtagtgttatagtaaatgctacttgctgttagagtgaataatggataatgtgagaataattttctaaacgacttctagaaactagacagttcttccttatatcctacccttttccacatttctctaatgtggggttttttgtttgtttgtttgttttgagggtagagggaatcccctccttatttcctctaaaattgtttttacttaagataccttttccctataatcttagcatgctttctgctctttctctttggaagtagcattaataagatagatgtaataggattaagatgtgtggaagatgagaaaaagaaggtttttgtagagagagtgcttatgttttgtttactcatgtttcaacttgctgtgtatgatcataaatctatgatcttgagaaaaatcctaaaacaatttaaatttagcctatgcagccaattacataaagagaaattaaggattatattcagaggagaaattaaggattatatttagagcacagaggttatacaaagaatataaccttgtttggtcaaattcttaggtaaagaaaagtaatcaatgcttgcattgctgttggagattctaaaagatgtattgaatgaagaggatgtacacatctcattgttactgcgtatttttttgcttggtattcctgcttgcattaaagctggacaatgtactgtgatgtaattacaaaatttttattccttctaacgattgaactcttcttatccctattgataaaactgtattacaattgatgagtgtggctgccagaaaataatacaaaactgggcatttagctgttccacattgtgtagtaaatgttttgattatggggatttacagtgtatattaaagtagaaatgcttttgcacttgttttcagtctcaaataataatttttgtttttaattaaggatactttaaaagcaatgacagaaaaatctaaaatatcagaattaattattgtgaactgtgtgtaaaatatcttgtgagttttatacatactttggttgtctgatgtttcctaagtataaatgtctttatagaaaatttcagttctctgtgaagagtaggaagtgtactgtatattgaactagttctttgtgttactttgatatttaaaataaatataaagttctttggtcctaatacagcatatctaggttttattgaaccacattttcacaggatgggaatgcagtactctgaaaccaagtaacttgcagcacat

SEQ ID NO: 57633 - DNA, 2104 bp, Homo sapiens
gaagttgggtagcttgctcaatgtttggctagtaagtgttatagtcagaattcaaacccagatctttttaatgtttaagcttcttatttttaccagtttattgtactgtctgcattttgtgatagtatacagtattattgctattatcaagttctggcaagtattcacattggaagtttgctacttgaagtcattgtcttatcaagttgagtacattttacatctaattatattcttgttcattcatataggtgaaaaaccatacaagtgtcaaatttgcaatcagtcttttagaattaagaaaacattaacaaaacacctggttattcattctgatgcccgacctttcaactgtcagcactgtaatgcaacatttaagcggaaagacaagctgaaataccacattgaccatgttcatgaaataaaatctcctgatgatcctctcagtacttctgaggaaaaacttgtatccttgccagttgagtactcatctgatgacaaaatctttcaaacagaaacaaaacaatatatggaccagcccaaagtttatcagtcggaagccaagacgatgttacagaatgtatctgctgaagtatgtgttccagtaactctggttccagttcagatgcctgacactccgagtgacctagtgcgtcatactaccacactcccaccatcttctcatgagattctgtcaccacagccacagtcaactgattatccacgagcagcggatttagcttttctggaaaaatatactcttactcctcaacctgcaaatatagttcacccagttcgacctgaacaaatgctagatcctagagaacaatcttatcttggaacattactgggccttgatagcactactggtgttcaaaatatttctacgaatgagcatcattcatgagtaaatctaaacattccacagatttttggatggttatatgctaatggtagagatgatagcttttaaatttgtggggctgctattttcttgttttctctagtttctcaagtcctcagaacagtttcaaatcaagaaaactatgtgtctctgtttactgaacatgaatatttggacaaaatttctggcataatatttgaagtgcacatttttgtgatttttaaagattatttagtgctaacttttaatggtttcttaaattttttgcaattattagctgctgatattatggaagtattttttttaatcatcagtggaaatttttattcttctttagtctcattcctctccttcttcttcctagcccttcttacaaacaagtttgaggaccatgtagcctttaagaaggaattaagagtacactgataattgcaactgtttcttatcctaagattcaatattacgttatacaaatttttaaaattgaaattaggaatttgaatttacaagaatgccttggatatttctgtgttgtctttccattcatacataattttaggttatcattatcctttggacttttgatatactcaaagccagaaagcttaactaatgtaagattagctattatttgtaggactgaaataataatccagataattggtttttgcctatacttcaattgttatgaataagaaaggcaaacataggtctgggcattaaattatacaaactgaaaatgtgttacaagaaaaatatgagagttttaactagatgtttttcaaggtaagttcaccttttgtactttactatttatttcagaaatgttgacaatacaacatagcatatgtcttcatctcactaagaaaagagcagttgtaactcaatgaaatttaattaaacatgctacttttgatttcatttacttggctgatagaaactctgggaaacagaacctagatattttgtgttcaattgttagaaaaggtgccaaacagattatgaaatttgtgcctaatttaacttaacattgtttaattaaatggaaccactacttatatacagatttacatgcaatccagatctttaattttgccttcacaaaagcctaatgtctgtaattaacctttaatttttatttctgtatgagacaaaagttgaggacttggtgaaaggaaatagcagttacagcaaaacctc

SEQ ID NO: 57634 - DNA, 1015 bp, Homo sapiens
actaatatttcatttttaaatttaggtataaaattttatttattagttcaaatttataatttttttgttaggacatgaactgatgagagcaatttcacctttttgataaatgcgggttttaaaattgccgcagattctttttaatcagcctgagcatctattttttaaatttagttaaggtgtaatttacagaaagtgaaattcattctttttagtgtataattctgcaagtcatgtaatcatcaccacaattaagatatggaatagtttcatcaccacaaaatttctgccatgtccctttctagacaactcttcatttcccctttaggccactcttgatctgtttctaccttataatttttctttttgtatatttggatagctagtaataataaaagttcagtgacttaaagcagttgaaaatctacagacctctttttatagattcgtttgttggatgtaactggaagaggaaaaaccagaggcaagctcaacatattaaaagtatttccatgtttctttggagttctatactttgttaatgtgagaattatatacacagttgtaaatgaagttgcaacttattttcattatgttagttattaatataattattaatattgtcatatttattatagttattaaaattatattgaaaaactcaaatctttttattttcttagatataaagcaacatttcatcaatgtgatgtttgtaagaaaatttttaaaggcaaatcaagtctggaaatgcattttcgaacgcattcaggtaaaatttaatgagtggttcatagatatatatatatagagagagatatatatagtgtaatcagaagtaaaatataggcatttaaactttgttgttcttggttaaatttctttggttttccccattaagatttttacttattatattgaagttcatgccatgactgaacaatattctcatcttctattctctattatgtaagcttcaatacttttaaatattttacaaaacttgagaaaactt

SEQ ID NO: 57635 - DNA, 1076 bp, Homo sapiens
tagctgcatgcaaaactggatatccagtataggaaaaaaatgcagttgttattttctttgaagaatcctgataagtaactgaacattaaagagaatgcttcatttcttcctttgcccagctgaagccgccagctatacagatagtcatattttataaaaagttttactagtagatatttcattctttgactaaccacacattttgcataataaccttattttggcacgtgtatttacttcacctttttttttcagctatgtaagtactgactttcgttttctcaatttcttagagcctttttttggttcagaggaggtggagagatttttcataatacttaacacagtgcttgatgtgaattaagaataaataaatacttgttgaatgagttaataaatgagtaaaatatttagatcccatgaaaaatgaaatattagaggttttaaatgagaatccattaaagatacttaatacaatgtacattttgaggtcatctctcatttctaatgtgtaaaacacattgaaatttacccagagctactgtggctaccaagcaattttgcttatagttacgtttctgaatttcagcatcttaattctattttctttccattgtgctattatgattaattcattagaattctttcttcagtttgtccttccatatactgagacatcttcttgctaatatatagcttctttgagctgtatttactaaacttcttttttacgcattctttgtctttcttatattttgtcagtcagtagaacactgtcttgtctccagttttttatttggtaaaatcatagtgaaattcagtatccaactaatgtcagtgttactatgagaggcctgggcttaattttgtatcaccaaatagaaatatttccaaactataaactctcttaagtcctccattcattcttccaaagttttttattacccgctttcccaaaaactttagtatgcagccatttctactttgttccagtctgatttcaaaccaggaattggccatttcaatttgttaactcattagtttgttcagcattcattctgtttgttagatgctga

SEQ ID NO: 57636 - DNA, 1554 bp, Homo sapiens
acaataaagataattttatcaggataagtatagaagactaaggaaatcaggagaagtgtctcagagcagatagtatttgagctgagactcaaagaatagggaacagtttacaagacagaaggaccagcatgtgcaaaggcattgaggtatgttgtattctggaaattgctcaagtgtgagtggtttcaaggtggtcagggaggcatagtgaaaataacaggagatgaaggtgggcaagaaagtggtggtcagattttgtatgtcttgtatgttctacagaggtgtatactttggacaatctaatttaactagactagactttattcagtaggtgatagggactgttgaaaagaattttacaaaggaaaccatggcctgtaagaattttagaaagatcatggtggcttcagtgtggagaaggaaattggaaaaagggatgaaaaaagagccagggagacaagaaggagcatataacaaaggaccagaatgataatgtagcttagacttggaagatgagtggcgttgggagtgggatgtagaatgagagtaaagcagagagttatgatacattgaatgtagactaagtagactggtgatgagtagaatgaaaagaatatgtagcagaagatccatgtgtcttaagtgtcctctcttaccatctttattattagaagtacagtttatttaaaaaaataacaacacaggagttcgagcgccaccttcccattattctcatatcatccacattcctttcgtagaattttaaaatgccacccagattttggggtatttatctgtcttagattgtgagcctggaggttacgtatcttactcttggctagtattctttgtaacatctcaggtcatttcaaataaatttttagtaagcacttgtttatttgagctaagttgaaaagttggtatctggcttgactttgggcttgtaagaagccaattagccttctttaagcttctaacttggcttctttggggtgggtttatgagagatgcataagctttgagaccttctgctggaaccattagttccacaataagtaatctactaatttgattccattactttgcatcttttatcctttcttccagttatatttttccttaggctaccggctgtcttcctctcagcaaattatcatgcaaataagagtcctttgacctttccccttataccaaaaacctagtggataaacaggcaaaaatagggagatgacagatggggtgagagagaaaatttggataattcatcttttttattgtttccacagagaactaaaatctttcattagattaaattcacaatctcttctagaggtagaacatgttttatacctttaaaaaaaaatgtgactagtccatcgtgcagatattccacttagttcttaatagaaaagggttataacaatggcacaactctctaaggctaagtattttaattacatattctttagactaactcatatgaatatttcaaggtacattttaagatgtagcaatatcagatatataatgaactcatctggtgatatttctctt

SEQ ID NO: 57637 - DNA, 1077 bp, Homo sapiens
tttggacattatagatgcagtgaagttgttaaataacgaaaatgttgccccttttcattcagagctaactgaaaagtcatcaccagaagaaacactaaatgaattaactggaagactatcaaataatcatcagtgcaaattctgtagtagacatttttgttataaaaagtctttagagaatcatttggctaaaacccataggtcccttttattagggaaaaaacatgggttaaaaatgctggagagaagtttctccgcaagaagatcaaaaaggaatcggaagtgccctgttaagtttgatgacaccagcgatgatgaacaggaaagtggtgatgggtcagacaatttgaatcaagaaaattttgataaggaaaagtcagatagaaatgattctgaggaccctggaagtgaatataatgctgaagaagatgagctagaggaggagatgtcagatgagtactctgacattgaagaacaaagtgaaaaggatcataatgatgcagaagaagaacctgaggctggtgattctgtaggaaatgttcatgaggggttaactccagtggtcattcagaacagcaacaaaaaaatattgcagtgtcctaaatgtgataaaacatttgaccgaataggtaagaaaagaaaactggttttctatctctaatcacttacttttcttggatattttaaaggtgataaataaaaactaaacttggaaagtaacttctaaaaagactgtttaagtagggagaataccttggttttcaatagtgtttatcctgttactttaaagttgttgtgattcaggaattaatttaagtatttatattagcctttacttttcttcatctcccagtgacacatcattagatcatgtatttgctatgaaagactccagagtgtcaataattatcatgtagagctttgatttatatgccggtttaattccagtgataaatactatttttaactcattaaaaaagtggattatattagatttaataatgtgtatactgttttccccgtgcatggtaatatatgagttataaatgttgtcacttttccagtatctagcactat

SEQ ID NO: 57638 - DNA, 2906 bp, Homo sapiens
cccatattttctatggtaactaaatcaaatatttgtaagttcctctgctttttgaaattatttttcaaagaagcaacacctgttatacaacagaattgtataaactaaaaagacttttggccttggtacatagtctttatctggcctgcaatggagtcatggttctttctgaatcccactctcacttttttctttttacccttagatattgcatccgtggtatttcaggggtatagagaaataatattggaatttaggagctatttttttaagtgaaaatattactaagtggtatcttttgatgattacctactttaatgtgtcttagaaaagcaccaaaacatagcatgattattttttcagttaattaaaattagttaataacatgttcatttaaaaactattcattgactttttgtaccagtcatatgcagggtacagtaactgaggatatgggaaataaaataactgacatagtccctgctctgaaggaacaaaggaaaaggaattgcaaatttttattaaaataataataataataataataataataataataataataataatgtgttttgcctggaagttattagctgagattctaacacacaaaaagttcaaaaaaaaagaacaaaaactggctgcttaatttaaagcatgctctaagtatgaaccatagtatcatttctaatttcattaactttctcaattattatgctaagtatattatgctgctaagatacccacatttaaggggcagatttagagactcttttagaaactgagtgtctttatcttattatcagataaccaggctgcacagggctctctataatggaatgatgctccttttcaatacttagagccactgtactcagtttaggagtaactgaaggtgtggatgcatgttaatgggaatccaatttttactatttttatatgaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcaataagaaaatcctgtaccttagattagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaattttttgtatgatgtacagtttgtttaatcttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaatttttttaaaaatatgcaaaaataaatattga

SEQ ID NO: 57639 - DNA, 2304 bp, Homo sapiens
tttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtgtgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaatctttttttaactaataattctctatcaaaatgcttcatatcatcatctcaaatttactttttaaaataattgactttgtattttagaagttttagatttacagaaaaattgcaaagatagtacagagagttcccatctacccctgttactaacatcttacgttactatggtacatctgccccaattagtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattc

SEQ ID NO: 57640 - DNA, 1048 bp, Homo sapiens
agaaatggctgattccaggtttgatgcagaaaaattctaagttgaaatgagacatcttattgtgccaaaaacaggaaacttactaaacacttctgagtttatgtcaaaggacacaggaatcaacttgaaagggctaccactggtaacagatggggccattaaaaaaaaacaactttattttgaaaatttcaaacatatgcagaaggaaggagaagcttacaaaaatccccagaaaccatttatgtagccttcaccaattatcaactcatggccaatcttatttcagtcacagcctcacctattctctttctccaccattaaattattttgaaataaatacccaaaagcatatcatttaatctgggaatatttcaagttatagctctaaaagataaggactattttaaaaacataatcatggtgtatttcaaagatggaacaatttgaacatcaagaagaagaattgtggtgggttgaacaacatcaagtatctactaataatgggaatttaaaaaaaagaccctcatgacttgcctttagagattgttaggacactagcttagctcatcactctcaaaattgttaaaaggaaagaaatcaaggatttgtcctgcctgtcccatacattgtattttggaatagtcaaatagttgataaggtaaagctcttctttatagaatgccagcaaataaatatagaaggaatgctctagaaaagcataattctttagcccctaatgaaatagtggatttagccagtcgttatcatggaatgctaaaaccttcaggtcaaaagttgataatgaaatgtataatggatcgcttgacgaatcatacctgaagtcattaatgaatcttagtaccaccaaaaatgagatatttaaacattatgtgcctatacatgttacagtaaaaatgcacatatcaatacccatgtaatattcttgccaaaatcaaaggaagatgaaaaagaaactgagggtaagcttccagaggtagctaccaatttataggaagtgaggacaggatagcatgttaaagggtatgga

SEQ ID NO: 57641 - DNA, 1051 bp, Homo sapiens
tcttattattctgaaactaccacttgccttaaaaaatgagatttatagcttgccatttttagagctagcctttctcaggctagttcttggacatttatttcttctgggtctctctggacttatttatctagcatagttatgatgaaaacagttctgttcatgagtcagaacacttgggttggagtcacattctgtcacttatgatttaccttgtcttgcccaagtcactttgctttgttaatcttttggtttcctaatatgtaaaatagagaaaatgttcaccaaatttgttgtatagtagatatttaaatgaaataaaatacagtacataaagtagctaacacattgaagcaagtcaatcatgggtaagtcttttaactctttagttattacctatacaaattaaaacacatctttttaaagcttgttttgaattataaactgccatgcattttaagatgtcactattataattatacattattatttaatttattcacatattatttcatgcaggtatttttttcttaggctgcaaaatacataagcttggggatttgttgtagactttagataagcaaggtaacacttctggatctcagttgcctcaactgtaaaatggagggtagtacagattgtacctactttcaaaaaatttatgtattacaagcatcttaattttcttatgtctaaaaagttatattttctcattcgtctgcctatatcccttattccttcccctcccaaaccccaggaatttaaatttaccctgcattttgcctttttaatatttgtctgccacctggtgatcaaaatggtaactgcaaggttaacagtctccttggtgcatcaggggagtgattttcatcattctactttctgattcactttctggaaaccattgcagtgaaaagaaagatttattttgcttactgtaacgaaactaaacttatttcttgagatctcctcagacattaagttctatgattttgtgtcttggtccttctacctctgtcacattttgtgtacattttcttacatttttttcttt

SEQ ID NO: 57642 - DNA, 1016 bp, Homo sapiens
atgggacctgttctagttctgtacaatatacaccagtttacaaattacacaatgaaaagggaggaaactcagaaaagcgtaagcttgctcaggtaagtaaggttatttacccttcattcccccacattctcaaattatataattccagtaaattatttaggaacaatttggatccactaattttttatcttatatgaaaacctgcagtattggtcaaggggaggagttagtggaacctgggaaggctacaaggggattgagagtcaaatgtttcagatatcggtctctacatgctttgttagcccatgccctcatagatctcatagtccagtgaaggaaaagacaattgaatgtgtgattcttatagagtgtgaatagcttgatgataaactggaaatcataggattcctttactacaaaaataaaatcaatcttatacatgggtatttggccattaaaatagtctatagaaattaaaatctgaactactataagtctatcctattctaaagttagattattttatttgctataaatagttaaagcttctttttatatgctgatgctacttaaaatattgtttcaagtgactgagtgttcagaatcatagctataagtgttcctggtttttttttcataagtacatttatgaaggctctaactaaacaaaattggtatatacaaaattgtatcttaagtggccttagaaaactagcttcaaaaaagaattcttgagtggactgtagctacaaaattacagaactggaagtggctgcaaagcttcatttataacagttgccaaggtttgcagatgagaaagttgatagctagaatggtcacaacacttgccataagtctcataactgatcagtggcagaaggaggcgaaaagccatctctgatgctcagttagctttcctggatagccaggcaccacagaagtatacatggccataaggtgcttccagggtctttgtctttgagcccattttgtgctgctgtaccagaatacctgag

SEQ ID NO: 57643 - DNA, 1167 bp, Homo sapiens
tactagttcttgataaattttggtttacagatttatttttgatcaaccattcctggcatctcatttttatatattccagggaacccgaggtcatatcaacaatgggtgcatacagtcaaggtaatcataagctttcaaatgttattctttcactctaatataaatggagaaatgttcagcaaaagtatgctgtttatacttatgctgtttatttgaaatatttgaaatgtttgtatattttgtcacattttaaatattcttattttacgtttatagtttgttgatactcattaagataatttttaaatggaaagttttggtccaaagataaatggctcattttgaaaagcaagattttactgccaaatgttgtttttcttatattattttccagaagaagaaattaggtggggtagaaggatttgatggcaattttataatttgtggtaatatagttttgttaatatgatttttaaatatgaaactttctcccccagactgagactttatttgcccgatattaaaacagctgataaacttgtatttctttcttattaagctttaaatatattcaaattactagtcatattgctcaagtctacctaagcttcaaggaagaaatgatttttaagtgatgtattatatcaactaaagaacaaggtggaaagtgtacattttgtttgaaattattaaagtacatagaaacttgaaaacactgaacactgaacatgaaataatttgtataggtctttaagttgtgagtaaagccctttttttaaatatgcaacttactgtaatactttgttttcaggatattttagctaaaagtttttggaaatatgtttctgtttttcttttgcagaaaggaggtgcactgttcaacacagcaatgaccaaagcaacccctgctgtacggacagcatataaatttgtaagtttttttgatatttaacaatcctatttatgaaattataaaacattttcctaggtgatagacatataaattctgaatattttctatttttcttttaaataaacctaaaaaaaaattaggattaatattgaccaaagcaaattcaattgttaaaattataacattgcatgcagagggtagtttcttttatataatctaaaaatggttctcattttattccaaagctatcggca

SEQ ID NO: 57644 - DNA, 1001 bp, Homo sapiens
ttatagtaataacgatcatttatgatatttcttcaatatactatgtaccatactaaacattgtttaatcgttatctttcatcctcacaataatcctgaaggacaatgactattatgcttatttgatgaatgaagaagctgatgctcagccaagttaaggacctcatcccaaatcacatccttcacaaagatagagtaggcctgagctctaaaggtccattggactccaaagcccacttccttctcattgaactgactgcttatggcactgtttgcctattttacagtagaaaagtacagttcaaataatgtagataaaaacatgcgatgacttgtacagagctgaaaattagcttttttaaattcctcatagttctaaataagaccctaacctttctacgatagtttgaaacttttatcatagctagtttctttgtggttcagaggtttaaaagaattgttttctggattgacaaaggttacagaatgctaaactggtgtttgtttcttcttccactttcttacattcattttgggaaaataattaaaacactttccagaatactgtgaataataacaaagtcttaaatatgtgatttccactcagccatttttagtagagaagtaaaaagtatatgaactgatgagagctttttaatacagaaacatatatgaataatctggatgaataaagatctgcagggttttttttgttgttgtttaaaaaatctccttgagaaataaattggtagaataacttggaatgttttattattttacaagggaaatatacttttaaaagtttggtcaagccaaataccacctgaaactcacaccttttaaacagggcaacttatttttacaaaggttattttaggtagttacattttgctgtagttatttcacaagttaagaaaaaaaatttgtcttcatgtttcatcctccagaaaaggtgcaatgctgtgttctgagtagtcagagatgtttttcagaataaaaatt

SEQ ID NO: 57645 - DNA, 1003 bp, Homo sapiens
tagaatcctgaaattcagttgtcatagagttttgatggagtgattgcaattaaatatttatataacatgtgtctagaccactaagggaattagaacactgataatagcataacttgttttaggatttttagattcaatgctggaaatacactgactggtaaataattaaagaattgtaaaaggcatatgacttatctcttagaggacatatacattcctaccagtttactggcagctatattgaagtgtaatctgtgactttgatcaaaacatattctttatattttttggaaagaagcctcctatggagtctattctttatattacatatttgaaacattcattttatatttaattgtatttaaaaaatgaatttgaatagtgaatgttaattttcatttaacagtattacttactgaagtatatttaaagcaacagataatttctttaaattgactcagtgtcgtattaggtggctattggaagataaaaacacttctaaaaaccttagtgacatcaatatcaaaaagaagagccagaagcagttttgctgcttgaaaatatttatcttgtaacctgtcacagtactttaagatcatgtcataagcaaggttgaaaggaaacctgcaaacctgagtgccctccagtataatggactggactaattattaatgattttatatatatattattttgatgtaacagacccgtgattgaaaactagagcgtggcctctggtgttatgtaacatgtatatttgtttttgtccacggttcctggctcatagctcctaaaatccttgtcatctccgaaagcaaaaagatcatgtcataaagattaacaaaatctggttcttgcaattgttgatgatttagagggaataatgtcattgatcttgagaattacatgtattattatttaaatcaattttatctatttataatttatgaaattatggaatccatactatgggataatatctatgaatttttgtaagatttcc

SEQ ID NO: 57646 - DNA, 1059 bp, Homo sapiens
aaatggggactaccagaggtgagggtaggattacaatttaaaataatatagtcaatgtagatttcctggaatatgtgtcacttcagcggtatcctgtggggtggccaaaagtggaaacagagagaaagaagatttagaaaactattgctgtcatctaggtgagaaattgatggcagtgtggaactgttgattgaagatatgatgagatttggtcagaatatgggtttattttataaataaagccaatagatattctgaaggatttgatataaagatgagagaaagcagagtcatggatgattccatgttatctcatctgagaaactggaaggaagtatttgtctcaattaaaattgagattgggaagactgtgggcagaagatgatttcgtcaagaagaacaagagttgagtttcagacatattaagtcaagatatctattggagatgcaagcaggatattgattaggtaagtggatggataaaggaggaggggagaatactggactggaggtatatacattttggagtcatcagcatgtaggtagaatttaaagccatcagcatgtagattagatgagattaccaaaggaaaaagtataaatagaaatgataagaaagtagtataagagggcactagcaacggaggttatgaaagagtggatgaacaattaggtaggacagaaaccagaagagtactttatattagcagccaacaagaataccaaagagggagggatcaacactgtcaaatgctcatgacaggctcattaaaacaaggacctagcattgattactggatttagtaaccatggatatatgatgaccttagcaagagcaattttgctgacgtggtgagacagaaattgtgattgaagcatgagaggagaggacgtagacacaaagtactgacagctcttttgaattttgctgtgaagaatggaatagcacataactagagaagtaagtggggtcaagagaagaaataacatgtttgtatgctgctgggaagatctagttaagaaataaaactatattcagaagagagaaggaaaaattgt

SEQ ID NO: 57647 - DNA, 1994 bp, Homo sapiens
ctctaataaaaatacaaaaattagccaggcaaggtgtcacacgcctgtaatcccagctacactggaggctgaagcaggagaatagcttgaacctgggagacagaggttgcagtgagctgagattgtgccagtgcactccagcctgggcaacagagcaagactccatctcaaagaaacaacaacaacaacaacaacaaaaacaaaaaccctactcttttagcaattttgaaatgtacaatacattagtattaactgtggtcactgtaccatgcagtagatctcaaaaacctatttctcttgtctaactgaaactttgtatcctttgatcaaaatcttcccctcccctggacactccttctttcagtcaacaaagcagaagctaccaactatccttgctttattattattatttaaactgttaatatttaattaaagtattgtgttaaaacatatatatttttaatgtttatacgtcatccagtaataggctgtattttcattgacagttgacttcttaacctcttttggtctcagtttctgcattgtaacatgagttagagtaaaagatcactgagtttgagatacctctcatctctaacattccatgatactttgaaataaacatagcttagatggatgatagtgggttccatttgtatgaatttctcttcaggtaatggatttggaaggaatcccagaaacagttccttaaatccacaactctgacattaccgtctttctttagctagcagctttacaaagacttaagccattattttcaggtctcttacttttatctcatactgatacaatgaaggaaattattttcttctgtacattgcttgttattaaggcccctggaactgaagttttttctgctcatcttaccatacattcaccatggctaaggaccacggcaaaaccaaacctttcccccaaaacctctcctaccattcatatagtaatataaatgtgtatttctcaaacttttctatccaacagagtgccccccatggcagaagagaatgcattttttaaagagtatggggggtggctgtatgagctcactgataagcacattttaggaagcattctgcatttttccaaaacatttatacattgtatattctataccgcaatgtagctatggcaagtggctataatagtttgaatgtcaacccttaggtcaatcatctcatcttttctattcctttagagctctgttcatgtctgagttatagaatttatcccatgttattgtaatttatcttttttatattgacttcatctctctaaagtcttccctgagtgtccctccccctcactaagtctgtactcctttttttctgtgcctatattactttaaacacattttatttattcatgcagtctgattgaatttagtgtgtcaatccaagagcctcatctagaactataaacttacgggctctccatgaatataggcctttttaactgataatctagattactgttaggaaacttatttaatagtgaaggaactcacatatatttaaatagatattcaaaataattctgcttgcccaaattctaactcttatcagggaggaaaatgataaagattcaaattggaaaactcttttttaatgttcccccaaaaccttttctacctttcattgagtaataaaaatgtgtatttctcaaacttttctatccaaaaaagtgccccccatggcagaagagaatacatatttttaaagagtataagggggtggctgtagaagcccactgacaggcacagtttaggaagcattctgcatttttccaaaacatttatacatgttgtacattctatatcacaacatagcagtgtttattttaaagtgaaaacattttaaatactggttgtattaccctcttcttaccttcatattaaaataaaactaaaatttcagttaaatataccacatacatcctttggctttgtgttcttggtcacaccattgagtgtcact

SEQ ID NO: 57648 - DNA, 1052 bp, Homo sapiens
aattctgtccttttattcatagtcactttagtgctaagagggtaaaagtggggaattggtggtaatattattcatgctgcagtgaattcccagcgtgctaaaatccaggttataattcttcccatggatggctgcttggaggtctgaattctcactgaaaggaatttaaaacatttgataagagcaatgaaatgatgcttatttctgaattttcttttcattgtttaacttttcgtttgtgatctatcctaatactaaattagactaaaaaatgtatttacagagtgtaaaatctctaaagacaatacaataaaatgtcctttgtgaagtaattcttagccattggaggttgaggctagcttgctttcttaagaataaaaagagaaaacaattgatactttttcagtattaataggattatgtgataatagccatatgactaaggctccaaatgcttttctgaattcagagttatgtgtgagtataagccttaggatttcatgggaagagatatatttatttcataactaaagttagaagtttggaaattaaagcagaaaatgctctttcctagaccaggtattaaaaagtacaggacagaccccatcatttttatagataaaaactgctaaaagctaattagcactgcaaagggcattggtaactggtgataatttactccagtgatgtaaagaccagaaacacagccaggttgatgcaatgattttatattatattaatatccttatatctaaaactgatttttaaaaaacaattgttttcttacagactatttttgagcattcatttgcccatgtagaaacacttagctgcccttctggtctctgaaaaacaggaacaacttcagatgtactgacaattgaagcccactagagtaggtcaaggaaaaattatttttatgtaatttgtaaaagttgaaataatgtagaaagaggcaaaggagaaatataactatatttcttgccaggcaattttagtttaaaatctgtatgaaattagatagtatactcatgtagaataacattgtccaa

SEQ ID NO: 57649 - DNA, 1040 bp, Homo sapiens
ttttctttctagtgtctaatgtctgaaatagcctttgggttgagttctaagagcttgcatgccaaaaacctccctggttcaaagagtaagtcagtgatattcaaacaagaagttatctgaaacttcctgaaccttaaggtcacaatgataggctcagcttctatcataggaacggagtaatataatataattatttttttaaagaatagccatcagaaaacttggtaaactaaactgtttcctagggtaaacagttttcttccatttccatccttgaggttaaaaaatcatactgatctacatgtaaaagggaaaaaaattacagatcatcccttcaatctcatagttttgattaaatactttttatgaatattccagttcaaaaatagtgtcatgaagatttgataggaaaagatatatctttgctaactctttggcacgattggaactttctgaatcctgaggtaatcctacctccataaagtatttctgtttttgcaactggtagctctggtgtgggttggactgtggagagccgtaatgccatcttgtgaccatggatggatatcgcatcttggtccaccaataaagccttgctactttgttgattcattcatccattcacttgttcattaaacacttagtgaccatctattaatatttgccaagctgtgagtgtgtaatgtaatgaataagatttagtttatgccattgcaagattcacagatagcaagaaatacacacatacttacatgtgcacacatgcacacacacagcacagtgtaatactgcaatactataagtattacagaataggcatacaaaggaccatggatggcaacacataagaagaagtggcctacagtccctggtagcttagggaaggtgcctgggaggaaatgacaccatctgcattttcccctaatcagccaatgtaagagtactttaatgtggcaagtctatgatgttgcaagacagtcttaacctatctaagtccataaacacatggcaggtagtgtgactgtaggactagtaaaatt

SEQ ID NO: 57650 - DNA, 1059 bp, Homo sapiens
gctcttgcatgctactaggtgaatatggaggattatctttgggatgcttccgtcttctttggaaatctccatttaggtgtctcatggttaacagaataaatatttgccaaagcagattccttataattctacttaaacctgacacttttgctatattacctttaataattcattctggttgcttagttccagaactgtggttgggaaggagttgtcatatattttttcctctccttgtcacctataccccacatccagaaagttgccaagtcctgtagactcggttctcttctggtagatcttgattagcaggcataaccctctaccagatgctggccattgcagaaattttgtgactctgcatataattacagaaaccatcctctaagaaatcagtcaaattcatcagataatgttgaattttgttagcgaataactaataaaacttcatttaaggatgaccagtaaggaggcagggaaagtatttacatggcatttagtagagtgctttggactctgggtatgcccagtgaaataaattgcccagtgaaataaagtgaggtattaaatataatacctcacattaagaacgtgtttttcctcttgctacagtttttatttgctcagtaacaaaaaaagaacactctctcttttttgttgtttttaaggctttaaatgagctgtttaaaaagtcatctgtgtgcagattgagaaattgaataattagctgcctttcaacgcttcataagctcttttagcccatcaggttaaaaagggggtggaaagagttaatacagtcttaaagaggcctaatttacaactaaggagtacctgagagctcttggagaatttgacacaatgagttagatcaaccccattttcatttccctctagctgcagtttgtaacataaataaatccatggtctataattgttaaatggaagtatttgaatgcctcctagtggcatattgtaggctctaattaaggaatttaaaaagtaatacttattgaaggaatactatcataacctattaaagcttgtaagtacaaggtagta

SEQ ID NO: 57651 - DNA, 1006 bp, Homo sapiens
aagactatatgatatttcatttttctttaagcttaaagattcaatatatcataaataatgttaaattaataagattcttcttacttggcttattaaattgttctcatttctttgtagtactttatattgcaaaccaaacttctaaaatatgtagtttattttcctttaatttgtgtattctcaaaatgttccaggtaaatagtttattatgatagcactctcttcagaggtatgtaaaaatgtcatccagaataatatttagagtctttgccatgtcctagaaggctctattttcctttaatttgtatatttttctttaatttgtatattctcaaatgttccaggtaaatagtttattatgatagcactctcttcagaggtatgtaaaaatgtcatcgagaataatatttagagtctttgccgtgtcctagaaggctctccatcattgattctgcttctctatctgacctcatctcctgccattctcccacttcctccagtctgatctcactgacttccccattgctctgtgaagatgccaagcatgttctcacctgggacttctgaatgcctcgtttaatttacctggaatgctcttcttcccaaatccacgagtttactctctcccttcagttaggtttcagttcatatgtcaccacgttagagttcttctgtaatcctcctatctaaaatagctccccacccccatcactccctactttaggtttctttatagatctaatctctgacaatatttattttacttgtttattgtttgctttctccactaacacataagctccatagaaacggggactttgttctgtttagtactgtgtccctgttgcctcatagggatttcgattgcatatagcaggcactcaaaatttttgttgaattaagcaaaaaaattattataatattttcagttgcataattaccttatggactttagagcacctactttattaaagcactttaaagcacttaaacttttagatatatt

SEQ ID NO: 57652 - DNA, 1267 bp, Homo sapiens
tctggtaaaatgtcccattctcaaagaatctcaatcctcaaagatttagctgtgttttggttgtagtttttcattaacttttactttaggcatgcaagtcctgaggcaccatagagaatcccctggttcaagacacgtttctctttgccaaactattatgtagaagcaccccagtttccctttggttattgagaacaatcactcaagccagtagattaacttcctctttttcagcctgttgattcagtggcatatggtaccccagttagccaagtggcatcttaaaattaaagtagaagcattcttctgttaaataggaaggagttaaaaatagttaaccacctgagaaggaaagaaatgcctttattttgaaataaatatttggcatgagtagagtttccaaagataaggtatataagtatttattcatttgtgcattgataaatgctattatttgccaggtactaagtactgggaatttcagagttactaatttgtgattctataacagtgtcagtgagtcaaggacagtcagtgtgataaaaattctaacatgggagatattaggagatagagtggcagactacagagtttacttcaatatgacacctcattctcgaaaggaatttgtatcatgtctaggaaatatatctttaatatattactgtttgtgtgtgtgtatgtatgtttgtatatggagagagtgggagagagagaaatcagactacaaaatctatctggggatataaacagtggccagattgtgaagaatcacatttgctaatttaagaggtttggcttttatccaacagattgtggggaggcaaatgaggtacatgacatggtaagttttgttttggagaagataacactggtggccttataaaagaagaaatgcagtagggggaatccagctgacaggagatcagttaaaagattgttacagtaataaaagcaagagatgattagctcctgaactagaacagtgaccttaagagggaggtgaggttgggttttagaaacatttccaggcaagagtcttttgcctgtggtattagcttaagagtaggtaagaaaagggagaatgtagagtggcatacacaggacaagtctttaccaaatgtttacttagtatctgctttataaggggacagttcttgatatcatttactaacagcaaatttcactttataattatgtgtatgcatatacacacatatacatacagatattcacatatatatgatatgcatgctaaatatacaca

SEQ ID NO: 57653 - DNA, 1032 bp, Homo sapiens
ttagccggatgtggtggcgtgcacctgtaatcctagctactctggtggctgaagcacgaaaatcacctgaacccgggaggcggaggttgcaatgagccaagatctcaccactgcactccagcctgggtgacaaaaaagaaaaaaaaaaagcagattcttggggacatacactaaagatgacaattcaacagagcagctctaggttgggtcccaggaaattagcttcttttcaaatacttagcgggtaagaaagttgggaaatctgtgatctgatcatcctctgcaaatacttaccttgagtagggttatgtttcaactaataatagaatattatgtactttatgtggcagccgactagtattacacttaattattttaataaataccattttaaataataataccctttgaacttcaagactttctggtaagtgtgtaaaatgtttttcttcacattcactatgagctgtaacttacacaattatcttttacttgtacagagaaatcttacagaatattttgttgccgtggatgtgaacaacatgctgcagctgtatgccagtatgctgcatgaaaggcgcatcgtgattatctcgagcaaattaagcactgtaagtacttcacacttcttttaagtagcaggtattgagtgtttcacaaaaagacctaaaaacctttgcagatttagaaatgtgctatgtgtacttataagacaatatctacatacgtttttgatgtatggttttaatctggctcttgaagtacaaaagtctgatttataggaagccttctcagatgcattaagtcaggttaattattttttcttatcaggagatgagagtttttttttctttttaactctccagagttcattttagtgccttctaccatataaagaattcttaagagctattatgagatttttattattcacttgtggctttttccattggagccacttgaaagaaatcaaggggccatgataatagctgctatcctaacctggtaataggtagattcatctttgttgcc

SEQ ID NO: 57654 - DNA, 1758 bp, Homo sapiens
atttgactcttaagaaaattaatcatttggaatatataatattttctgtttatactatcttttaaagcatagttttatgaaatatagtactattaaaaactattccaaataaaagtaggttatagagaccgaaatctttgcatattctccattttcagtagtagtaattttaaagtatattcacagcacaagatttgtcacattttttggtcccaagatcacaaaagatcttgtgatttatctcctattgttcttctaccctggaaaattatagattatgactgtgttaactatccttgttctgactagttcaactgtgctcaaatattggctaaaatgtttcttttctaatcattaataataagatattattaaatatgtccttatgtgattcagatattaaataattttggagattaatatgaacagaaaataaaacttttgatgattaaattgcactttgattctgggtggtaaaatttgggaacattgtgggaaacatgaaggcatatatacacaatgtattctttatgtaagtattctgatgaactgttttacttctttgaacattatagaagctaattaatatttggcagatgtgtaacaatcatattttgggattactacgtgtttaagaaattttaaacattgaaaaattatgctttattgctatttgctaaataatagggtggttgatgtttacaaaagagatttcttgtgacttaccatagaaacccagcccaggaatcttagtagattttgatatatttggttagcaagctttaatttttccagtccacctcaactaaatgtgttttaataatatatatgtttatatgtatgtataggtgtgtatgtctctatatactgtatatatacacatacgtgtatatgtatatatgtacaaaataaacctttcagcaatatactctttttttgccttaacattttttccctattttaattttaattttagggtcaaatatttttaaccaagtcttaactttttgtatggcaatgtaattgttaaatctcatataaacccgctaactcatttaagaatctctcaaattcaacaaatcctgaatgtcagtccatggcattttttaatttactcaatatatttttttctgattttcattacaaattatatgttaccagttttaattatctttttcatatgtgatttatttgtattgattagcattcctacttcattgcccctgatgtaactggactcccaacaatacccgagagtgtaagtttcctattttctactttaattattcttatattattaattttgtttattttggtctcactgtttatgcgtttttatatagagaaataggatacattgtaattatctgtgtttgtgagaaataatgaagaaataagaaataaagatattattttcttttcttctttatatatctgcccctttaccttcttcttaatatctggttgtggataaggaaaattaaggacaataatataaggaaaactatttctatcatttgtagtaattaggtaggatcatatatatattcaattaggtcttcagcttcactgtatatgatagaagagatacctcaggagatggcttctacttgtggagaagaattctagcaatgggaaatgtcttcacacaaatcattattttagtgaaattgacatagtattttatattccttgtatataatgcttcaaatcgtagatgaactgttcttaatttcctgattttaatttaaagcaata

SEQ ID NO: 57655 - DNA, 1019 bp, Homo sapiens
tgtaaaatttagtgaaaaacattttaacattttaccttattgataatcagtttaaaattagttgctttgagcatgtatcgtttgaaaattccctaagaaaccacaaaataaagacttgaaaataacatttcttactctagcaacataagcttatataatttacagtattttttatctctctctctgtgtgtgtgtgtgtgtgtatgtgtgtgtttcaaaagttttctttttaaaaatgatgttgtttttgccatatatttagacttaaagtgtacttagagtatagttaaaattggaattactggactactttgtataccctggatcattttcttgtcagataagaaagtgagtagtcggtaggatttcctgttgagcagttgcttcttatcaggagttgtgaattcaattacctatgtagaccaggtaaggggctcaaatgagagaaacctgttaggtgcctaacaataggaagttggggtaagtacggtgatctgaatagtacatgccacactcaaagacagaagccacaactcagccctaggaatttgttgcacagtgaaaaatgtgtggccagtattaccagttcttttgacttttaagagaaacaagaagtctggatttttacagtgaattatatcagatttggaagttggcaacttatttaattaaacaacagtacagtgttgaccaaacaaaatatgcccttaggatagaagcagcctgcaaatagccagttagcactgtttgctgtagatgcttgtttatttacaacagaaaatgtccttgctttcttgacgtttctaggagcaatggctacgttatagagtagttccacttttatatgtgatgtttttatttaaaaaatgaatgatatgtactctttaaaaggagaaagttatcactgagagccagtacatgtttacaaagagagcattgtttataactaggcttggtttattatggtgatagtacatactgatgtaacagggagtgctgtagttgaaatttgagtctgt

SEQ ID NO: 57656 - DNA, 1004 bp, Homo sapiens
tttgtctttttttttttttttgagatggagtctcgctctgcggccaggctggaatgcagtgacgcaatctttgctcactgtagcctccgcctctcgggttcaaccgattctcctgtctcagcctccagagtagctgggaatacagacctgcgccaccacgcccagctaatttttgtatttttggtagagacggggtttcaccatgttggccaggatggtctcaatcgcctgaactcccaaagtgttgggattacaggcgtgagccactgcccccagcctagtttgccttatttcactatgtaaccaagacttagaataactagtaattttagggggaaaaggaaggtaggattatctaatgagctattcatacaatggtttagggtagtcaggtctcttaatttacaggccagcttcctttataacagactgtgctgcttccagaagtatatgagagaagatcaactatgctcattttctgagttatttatgagtagctggcaaaagcctttttgtttgcaatcagttttgtaggagtgacctcacttttagaattcatgtgcttaatagggccaaaatttattgagaagtttgataaaatccttgcataagcaagacatagacatatgcctttaaccatatttctgataacaaaaataatttatttgctatagaaaacttggaggatccagagaagtttaaaagataaaataaaaatcacttatatttgtgaacacataattgtcacttatgttttggtatttagttctagttttatttcaaaagacttgctaagatacatttacagatttttctgtgtcaaaataaatgattaactgtagtctttattcacagtttgcaaaatgaatgaatgcatctaaagcagttcataaattgaaaaagctacagtggctttcatattgtccataagtgcctagaatgtttacacatgcttaatctgacaattgttcattgctgttgtttcttttcttgtaagttgagat

SEQ ID NO: 57657 - DNA, 1090 bp, Homo sapiens
acataattcttaatagacttgatagataattattgaataaataaatgaataatgcagcaacagtttttgctattaagaaaaacatacacatatatacaccctgacttagagaaattgtttatgatctgttgtaacatgatgaaaaatttcaaaataatatttatagtatgttgttatatttgtagagaacaagttatatgtgtatgtaaatgtatatgtattttaagaaatagctaacacataaatatttgtatcttaatatgggattgtatgtacttataaaaaagtctaaaaggatataccctgaattttttttactttattcacttcagcatttatctactttttacaataagcaaaaatcatttcaattttttcctgctctaaaactctgagatgttatgatatagataataaactataaatatggaaccacaggtatcatattaaaaattagtaggaatttagctatattaccaggtaaaatatgtgcgtgtttgcaggatgggaaattatcttactagtatgttttagtataggcactccatacaagtcaggtgatcatggtgacatagcagaattaagaatggaattgggggcttggtgcaggggcccacgcctgtaatccgagtgctttgggaggccgaggcgggcggattacgaggtcaagaaaccccgtctctactaaaaatacaaaaattagctgggcgtggtggcgcacgcctataatcctagctacttgggaggctgaggcaggagaatcgcttgaacccaggaggcggaggttgcagttagctgagattgtgccactgtactctggcctggcaacagagagactctgtctcggaaaaaaaagataataataaataaaaataaaaagaatgggaatgggacagtttcattccgtgtccttgaaaattgggatttaaagagaaaaaaatattgctgatggggtggctttacaatctttgagccagatattgatgtttctctgtaatttcaacacaaaatgttcaaccagatggcaatgatttgtaagatgcttggagaaattctatgacacctaaaattaatttcttttttctccttc

SEQ ID NO: 57658 - DNA, 1044 bp, Homo sapiens
aataaagattcaatctaacgttttatattgccccttataccaaagtgtgacacatattatggtagtatgatacttcaaagttgactagaattctttacagcttagctgataagccttttattttggtagaaattatattcttattttatacttggaaatgtattcctcagtatattgatagctgtacaagagaattctagaaaaaatataacaagggtatttttgtagggtactttattggatgagaatgtcaacaggagaagcaattaaacagagttggtggtggctgccattagattctaaagcgacatgatttgctatctaagcaattttagaataattaagaaaagaggctaaagttgaagaaaaggacttagtcatgatttctagctgcttctacagtttcagtaataatattttgataatttatgaaatatgagcacttttagtcttatgatcatttatggtagactaccttatgatttcctagtgagagattaatatatgctgaactgttcagtctatgaggtattacaacttattttggtgtttactttacaagtttcacacttcctctagttttagaacatagttctagcttcaagaaccaactgattagaaagatgaaaccaatgtcacatataaatatactcttatttttgtttttcttgaagaaaattgtcaaacaaggcacaatgtttcctaatgttactatattttagggtgtctcagaatcaagttggacagcactttacctttgtactgacagacattgaaagtaaacagagatttggattctgcagactgacgtcaggaggcacaatttgtttatgcatccttaggtgagtatttgtagtaaaaaaaattagatgcaaaataggtaactatctctctattgtactttgttatgcttgggatgaagaaaaacttgttttctttaaaaacaagttgaaaaataattttcctgattttctgtatacagaatcagttaagtttaaagatttaccattaacatagtggaactttccttgaaataatcgattt

SEQ ID NO: 57659 - DNA, 1108 bp, Homo sapiens
agaggatccataaaagctatttgcatgcattttatgcctccttccaagtctctctcttttctttttacacttcagtttcaatagcacctgtaattaaggaagaaaaccaagccctgggagctaggtaggacttccagctattgatctgtgtaaacccagtttatactgtcaggggagaaacagtcaactgctgagctgctttgtcactgacataagctgagagaggatttttttttttttttgtctatactgtttatacactagtctatagacctgctggctggttgaattttaaagagtgcggaggtttaaagacttgtcccctgagggatgcttctgccagttgggaagcgagctgaggctgtttcacagaagtgtatgcacgtgtgttgcttgtggaagaagggagggggagggtgtgaaagattgagcaactaactgggaagcgttcgtcttgagtcttaaaattgatgtgaaatatattactaatttgtgtatttagagggagatattgaattttgaatatatgttctttattgttacagaaattatgtggacaattttataggaggaggtctgaatagtgttcacatgtatagtaaaaatggtgaatggtttcactttatgaagtacaagataaggattaagcaatggtcaaatgaaaatgaactggtctcatttgcaatgaactgtttttcagtttacagaatttaacttactgcaagtttagtgactcttttaactacatttaacaaaatattgtcagtggtgaaacagttagctttcgcttaatatagagtctgtgctcatatttttaaaggtacatgattatgattataagcaatccagggtaccctgccctaagagtagatgatttttttttttacaagatccttttctttctgcttatgtgcattaaggcactgaagctttcttaggtattggtattggaattttataatgttttatttttagttgacactttattgtagtctacctttttaaaagaatgcaagaaattctactttaaaacactcaatgctatatttatgtatacggtttaaatattcagatattgatgacttctgtagaccttagttttagtggc

SEQ ID NO: 57660 - DNA, 1122 bp, Homo sapiens
tgaacaagtcaaccatgtcatttcttgctatgagagtataacttttccttatatacattaagcacccttaactgatgtagttactcctagtccttaattattggtggtattcaaactgaagttaaagactcaggacccttgtgggtttcgtgtaggcaatcaaatttgtgttttgaaaaacactcccaagtgattctaaaacctcttcatcttctttctaatcctttccaccctccattgagaacatctggagcaagatagttatgaaattgaatgaaaggacttggtgagtgattaattatatgtgggggtcagggaaaaggaggggtcatggtaactaccgtgtttctgatttgggtaactaggtagatggtgctgccagtttaggtgataaggaccgtaagtaaaagaacaactttggttttgtacattcttcattagaggtgtctgggaacatttagaaagtcataccagaaagtagttagagccataatcctggagaaatatctaaactacaagactaagagatttagtagttgtagttgaaactgtgggtatagatgagattgcttacaggtatatcttactgagtagggaagagaagaaactatgcaatttcagagaacgctctgaaatttcagtgtacagtggaggacaaaagtggttgagaaggaggaaaaacaattagtggtatcgacaatgacacatctcattttatcttagattattctcagataaattcaaagacctttgttctaagaataaattctaagaactttgatcaagatgtaaacgttagtgtttttttttgaagtaaattctttcttaaatgcttgttttccttttcagttgatcaatttatggtgctaaatggtaacctgatgggataaataattaatataccactctaacactagcaattggccctagttctctcttacaagatcaatttcattgtaatgcttattactagagatacactggtatggaacccaaaaccccccaaaatataaattttcatcagtccttgtttccagtcattaacatgatagtagaagtgctgttttaggacatacacagaaatatgtattattacctctttcattttgctgttcataattt

SEQ ID NO: 57661 - DNA, 1067 bp, Homo sapiens
aatagacctttacatatttagacattttaaatcttaaagacataatgttaggtatgatatttcataaaaatattttaagtagtatacaatatttgcttaatatttgggcacctttaaatgaacctaatttcaaaaattaacttcatggttgttaaatttaagcattttaactaactgtgatggtgaatgttttatttaaagtatgaattattttgttaccttttaacaattatttaaacacacagtcacatgtttacttatgtttatttttctagataagtgacaatattgcagcttatcttggtgaattagtactaagtggtaacatacagctatatccttagcctatttgaccagacaacaatgcaatctagtggtcatttttgtaaaatgcagacacagagttcatgtggttttaactagttattgatgtgttaataaaggaaaggttgttccctgattctaaagtttgcaaaaggttagattagggaaaagttagcatgaaaatgtaaaaataaggcatatggtaagaggatcatattttgagggaagatgatgtttttaattttggatgtgccaggtattctaataggaatatcttctaagtagaaggaaacctctgactggagttcaggaagaggatgatggtatggaatttacttctgtggatgaacttaccaggcaaagtttagggaaagaaaagaatctccaagaacaactgcttttataggccccaacctatgtctttaaatccatactgaaaaatataatttgataatcataccctatgacccttgtaaatattttggtttttaagaggtaaacaatatatttcacttcctccttttgatataaccagctaggattatttaatatgttttgcattgcaaattgtaatagtctgaagttttacatgattgtctgtggagttattatttataggatatggggcattaaggaggaagattaacatcagataactccaatttgagccatagggaatggaagaagtaacaaaatattaaattaagcacaagaacttgttcaaataactgctaatttcatgt

SEQ ID NO: 57662 - DNA, 1581 bp, Homo sapiens
gcaacctgtctgtacttccgtagcttcttatatgtacctctaattttaactatattttcattttttttttttttgcatgtctctgtctctcctaggctgtatgtatgtttcttgaaggaaaaggggcagaactttctcatttttcaatctccacatctagtagagtggctggaacataagatatgaataagtgtttttgaacggctagttgaatgagtgacaagtcagaggaagttgaataaactcatgataacttatcttaattttcttggaaaaataataggcaaggtaatttaagaaggatggatttaagagtggtgtttcaccttaaatttggaaagatttcaaactggtgttatgacacatatcgtaggaattcaacaaagtttgaatgaaatgatgtaacttagcagaggggttaggtagcatgaagatttaataggtccttgactgttcatgatagtacctgacttgtttgttctctcctctgtccctcatttctgtaggaggtgaaattaaatttcagtatatactgacaacctagtatgtgcttccatgataaataatgaaaatgcattaagaaatgcttttagaaaagtgcatatgttacatgattattttaaattataacaataataaaaattccattaattaatcaaatcttggtagaaattatctggaaacagtttaaagtataactgtaagaatgaatagtagtaaaaattatgtattatacaaaaacagcagagaattttaaattttacccttcagctgcatcttcataggaatgaatggcaggcagccagctacttagctgacattaaatccagtctactcagtactatatacagttttgtttttatatttaataatgactaatgggtcattattgaatataaaaaggatgggtcattattgaataaaaaaaggatgcaggtaggagttaaggtctgcatagtttaggaagaatgcctgttttattagtaaacaatttttttatacattcataatttaaaaaattttgtattatttaaaaggtatttggtaggaatgattagtttttcattatttgaaattgagacacattgagtattctataattttgcttcttgcatcatcataaagaagatataaattattcagaaataatttattaaattctaatactctgaaaataaatatttaaatgatcgtggatttctaaaaattggatattttttggttgtttgggcttgattctgtcatttttaactaccagtcaattacatgagacagaaataatttcattgcattctatatcaactattgttttttcaaatgtaaagaatgaaatgtcttgaaccaatttttgatatgtaatagtaaattccctataaatgttatatataaactcctttttctaaccctgtgaatattatatataaactcgtatttctaaaacaaattgatttcttaatgtttaattaaataaaaatttataaattttgtagagatgatgggtaaatgtaagataattataattatattatggctgtttacttggtttcatattccaaaaattttattagttatatatttcag

SEQ ID NO: 57663 - DNA, 1030 bp, Homo sapiens
cacctgagagctttttagaaatgcagtttctcggccaggcacggtggctcaagcctgtaatcccagcactttgggaggccgaggcaggcggatcacgaggtcaggagatcgagaccatttgggctaacatggtgaaacctgtctctactaaaaataaaaaaaaattagctgggtgtggtggtgggtgcctgtagtcccagctactcaggagactgaggcaggagaatggcatgaacccgggaggtggggcttgcagtgagcagagattgtgccactgcactccagcctgggcaacggagtgagactccgtctcaaaaaaaaaaaaaaaaaaaaaatgccgtttctcaggcccacctcagaagttttgtgtgtgggacccagcagtctgtttgtgtagatatttttgttgaagtttgagaactactgaattagacctttaagaagatgataaaattaaatattgtcatctataggttaacttcaaaataatttgtacaaacatctgcttatatatgttttatcaagattagatgtagtctgaatttaagactttccagcaatgaatttgtttttattttcactgttgcttatagtcttaaggtttatagtacagtctatcatactattcttttttgagtggatcagtgaagctttttattactactttgtcaaaatgagtgatatctttctatcatgcagtaaatctgtgttttgccggagtctgtgccaaggaaaaatggcaaaagtgtcgatcttctgaatctctggcttcaccaaagtcatttgtggccctaaatgattgagtgaattgtttccttaaaccgttttttttaatcaggctgaatataaaattatggtaagtctgagtatgttggctcgcacctgtaatcctagcactttgggaggcggaggcagtacgatcacctgagcccacgagttcaagaccagcctgggtaacatagcgagacctcatctttacaaaaaagaaaaaaaaaattagttgggcatggtggtgcatgcctatagtccc

SEQ ID NO: 57664 - DNA, 1038 bp, Homo sapiens
ttgataattatatgttttctttttctttttctttttttttttttgagaaggagtctcactctgtctcccaggctggagtgcagtggcgcgatcttggctcactgcaagctccgcctcccgggttcacgccattttcctgcctcagcctcccaagtagctgggactacaggtgcctgccaccacgcctggctcattgtttgtatttttagtagagatggggtttcactgtgttagccaggatggtctcaatctcctgacctcatggtccaccttccttgccctcccaaagtgctgggattacaggtgtgagccactgcgcccggcgctaattatgttttaagaaaaatgggtgaaaattactgtaggacttaattattagtaagcatgttcagactaatagttttctgccccttcaaggaaatgattctttttgccagtatcacagtgttgtatttaccagtcataatcttgacctcaaaggttaatgatatttatccattattagtttaaggaaattctggatatgatcagggaagattttagcaataaaacaacatatttaattagaaacagaataaaatattcacatctctactttcatttgcttttcattctacatcaacagagacctgtgaactgaaatgtaatagctatgttgtgttcattttattattatagttttatgttaacaagtttcttagtttttactatgaacatttgaaaggtgttccccacaagtccttagatttctctaacatgaaggtatagatgacatcacatcacattgatatttagaatcagtttttttccagcttgataacctcttgagtaccttctgggtctcgatcccattttgaggtattcattctcttttagtatttctgtggccctccaggggtatctcataagtactgaggaattgcttgtctacctcaactactatgcttcatgcctttgctcttaatgtctcactgcgattatttccatatcactgatgcaatcatttgtctagaccttgttttagtgcttcacctagga

SEQ ID NO: 57665 - DNA, 1006 bp, Homo sapiens
acaacttgtgtctaacttatttttttaaaagttcttaaggtcaaggaaacaggtttaataatgtccatgttcattttcttttaaaatgttaaccttagaatctgcaaaattaggattaattttcctgcatttagtgtggcacatttgaaaaaaattagataaaaactattttcagtctaaaagccaccgtaacagattaaaaaattcaagtagccctttactttaaacatgtgattaaccgtaaagaattttttcttttccaatttaagttcccatgtcataatacagagataaaaaataatggccccctgacacaccttatttggctcacatggtattcatgaaatgtttaattatttttcccaacttaaaaattaggtgattttgttttcataaatattctggattttcttgaaaaatcaaaagtatctgtcaacactgggcccacattccacatggatggagctgaataatggttgcttttttgggaaggggaatgggatctattttttactacatgtccttttatagtctgtcttttgtaggctcactctactcatttttattacctatatatcctaaaggcatttaaccttgaaatctcccctttgtcttttctacctgtaaaaagggactatatttgtgtaatatataaggtataaataattataccttgactttttctcaggttttaaagaaaatcttaattagaaaacaagttttataccatacataaaaacattattttaatctgtttttaaaattctttgtgatatacctctggctctcaaagtgtagtctaggggtctgtggcggttccctggagtacttcaggagttctgtgaggtcagaacttttttcgtagtagtgaggcattattagcctttttcgttcccatttctcacaagtatatggtagatttttgcataggcttcaggacatgatgaagttataactctgatgactaatgaagtgtgtacttgaagatttttgtgctttactaatt

SEQ ID NO: 57666 - DNA, 1284 bp, Homo sapiens
agataccaatgttttaagttttgtgcctgttaaatatttgaaactacttttagaagttttattaaatagtaaatctttggtaatggcataaaaggtatgtttttgtgttactttataattactttaaattgtcaatttgataattaggttcaaacgattgtgcagaaatgtgttaaagattgtgtattgacattctcacattaggcttgttctactttgaagattaatattctaacattagaattttaaaagtatatttgtagtttaaaactgctttaatgattatttgctctataaatatgcataaataaggatggcatcattgtaatcgctttaaacccttttttgggtaatacatccttagttgggttgagttggaagtgatgatctttggaatatgcacatgaattaattggttactctatcttgggatatgtcagaagtactactgcttcagtgagaggactctggcaggagatgttattttttaccagccagcggtgtttatcttgatttgaaggaagcaagctttatcaacatagaggataatgatttacttgtcttatcctttctctttgtagcctagagaaattccagaaaatagtctttttttcttttttaggaagaaaatatagtcttcatatgaaaagctttgtgtgcttttctgatcaaaatacagaaggatttttatcttttgatctactaaatttacttatcaacataggtgttagctttgcttttcactccttccttcaaaattgtaggacagaaatttggaagtcaggaaagcaagtgaatgtgacaaatgcttatttatcttgcaaaagtgcttcataagtatagtcttttcttcagcttgtccttcataccattgataaactggactttaaagaacttattaatgaaggtggcaatttagttctgcctgaaccaacaactagttatatgatcttgcataaatcatttttcctttcttgactcaagttccttcaggtaaacaaaagctatagactatccaaaagccccttgtaatttaaacattctgtcattttaattgtattattgtttagttcttcaactacattatcaactcactgaagcaaggatttcatcttccttttgatagttttcaaaatatattgtgtagcatattcgatacagtaatagaaatttgtctacaacctcaattctcaaaccttgactttctgagactcagtcttccccatatagggatctcttgctcataattccttttttattcatccctctgccttttcaaatcat

SEQ ID NO: 57667 - DNA, 1101 bp, Homo sapiens
ttcagtacgacaaagcccttagagaaagattgaaaagagctgataatcaaactcccaaattttatgcttatttttgttctagtgctatcaattttctgacatatttaacacaggctggaaaacgttctcagtaaattgagcatttgagtccacaaatgtcttgaagcactctggcaagttatgcatatcccatgtcactttgggtttcccatctcttctttgcttcaaacccccatgcaagtttcttctttttgggggcagcctgtgaattttcaacctcctttttggcttttacaaagttgtggcaggcaactgctttggcaatctttacaccaagctctcgagtagctagctggtttttctgagttcctcagtcttctcaatattccacccctccacagcctggtctatcctctcttcaaggcctgatttctcaacatttttccttttaacatggcgttcaaatcaatcattgactccaaaatactgagtaagctccttccactgggtttcatttgagaactgttcactgtgagattctttttcattcctcaatttatcttttctggagcgttttctttttttccctctgaatcttgaggttgcgtttttctgttcagaatgttttttatgcaattcttgaaatatattctacatatctaggggaattccagaaggacactcttcataggcatttacattcgactctgtttcagttttgggttcatctatcgagaatctatgatttctgtttttctgatgctcccatcctctttatcttcttgtgagttaagtccagagttctgcaatgtagcttcatcttcagagtttcactcaacatcactttcatttaggccaggaggtagcagcccactccacatcttttcgtctgtcaggaagcggtcacctggcagccatcttaagaccccgtcagaaaatgttttaaatattgggagagttaccaaaatgtgacacagaaacacaaagtgagcacatgctgttaaaaaaaaatggcaccagtagacttgctcaaagcagggctgctacaaaccttcagtttttaaaaaatgcaatacctaaaaagcacaacaaagcaaagtg

SEQ ID NO: 57668 - DNA, 1028 bp, Homo sapiens
aggaggatagaagacacgtattttggtattttgcgctgtgattagtgaatttcactttgaaaaggatatttagcagagaataagtttgtagtaccgaatctgacagcatccatataaatatttggtgaggtccagagaggtcaaacaggagttgaaaattacaatgtgacttttctttagcgctcctttcttccaaatttttcacatgtacaacttcagcaacaaagttagaattccatatatgtgtaagttttcaaacttctaagagctaatattgataagctagaaagttgttagaatagaaataacactgggcttatatccttgaaggaatgatgatgagctaaaattaaggataatattacaaaagtgtagggttctcaaaggaaatattagttgagaggtatagtgcaattggttgtgaggtctgtgtaaacaaatactaagtattgcaacttctgaatgattaaaaaatacagaaaattcaaggctatcttggtaatgacattattcccatttatttgaattcctgtataactttcttgagtgaatgctgaatttaagtccagaaattatccttgaagcaagattctgttatatcattgatataaatctcctttttataggtaatttaataatgttgatgaagtttatattttgtcagacaaatttatgtaagacccttctgtagattcctgagttctcaataacagtgtttcttaattttatttataacacatagaaaatgacaatatttgtatggtacttctgggcaaatggacttcatgcaatgataggaggtaaatggcctggggtctgctagggttgaggggatcaatatgttcttatttcttcttacccattagagaggcacaggctgggatgttctctttatggtttctttggtgagactggctttttattcactgcttttgttcactgttgttttatgctactaggtaggatggcagaactctagagttagattggagttagaaattgggttggagttccagttgaaccactct

SEQ ID NO: 57669 - DNA, 1040 bp, Homo sapiens
ctgatagccttctgcagatatatatgattccagaaattactcattaaaataataattttatcttggtttggtagcagaaatgcaccagcatgagggtgtgtttagtatacaaatttactattaattagaattaagcagtcctttaaaattttatcacgtgggtagttataaaaacttagatgacttttattttcttaagattatcatcaaattaattataagttatttgaaattaacttacatgtttatacaggaaacatggttcaaatgaaagccaaataagttcaaatgtgttttaatacacgggaacatcatatgtcctcaaggtctatgcattaaaattataggtgctcttaaacttgcatggaagtggttcagaaaggattctttttttttcttcttcaagattacagtgtattttagatatgatatttggaagaggaagtaatataatatttagaaaatatttttgaaggtcttcatcatttttactcatattaaaagagcaatttctgtttaataattataagcagttaatgaagttaatttttttggtttttagaaaataatgtctttaaaatttttttgttcttattacttcaagacttgagaactaagttttggagtcttagttttactatgaaatgtgtgattttgttgatgaatacctgcagagtaatcactgacaataaggagcagcacaatttcatcaagattatgtgttggttctttcactgtgtacaggtttagacatgttagagaagaaataataagctaagaactgttacgtacaaaaatactagcttccaacttttaatgattactgtagtgtttgttagggatgttgactgtataccctaaacgtggaaatattgaaatggaatgctagttgaaagacaaaattttaatttgtaaatatttgtctcattttagcttaatagttgaagacataaatgagcccgcagtataatgtttaagatgtcattgttctaaattttgcctttgatagagctgatatagctgtttaaaattcattataa

SEQ ID NO: 57670 - DNA, 1337 bp, Homo sapiens
tgcactaggataaattagagtaatgcaaactgtataagctaaattgttgaagaaaatgaaactgtgaccaggcatggtggctgatacctgtaatcccaacattttgggaggaagaggtgggagaatcccttgaggtcagaagatcaagaccaggctgggcaacatagcgaggctcccatctctattaaaaaataaaataaaatgaaactgttttttcttttgcactgctagccaggaacaaaatgtaatgtgattcttcagaaccatgtccttgggttatgcccttcttgatttatatagaaaatagttgagaatatatgtacttttatatgtggcttggtgcattacatcctccttcacatagctgcctgcaagtgtaaaaagcaaatcaaatttcactgttcagtatttgttgattattactttcataggtgtgttgcaaattttacattttaatagtttggttatcactttctcattaggtgctttcatttgtttacatgttctttatttttgccgctttaatctaaggtgacctcttggtttttgatgttcatgatttccactgtaaaatgtcagaggctgcttggcctctgctgcagatttcacagtggtatgctttaagactgttgttttgtcactgctgtgttgccacagtgcaagtttgttcaggttttttcttataactttgttttcttgactttcaaggtgatatgttcctgatgtgcttttgataatattctctcattttcagatttttcttaggctcagataatatattctttttctctaaattttcatgttttatttgcaagttaggggataataatttactgtgtacagtatacattttaaagtgttcatataatactagcaatagacatgtttagagtgctttacgcagatggccatggtacttcagataacaatgagaatatcacatttgagctcttggatttttaatcatttccaaaataatacttcttccttggaaataagcttaatgtttaacattgaaaaacttttcccactttcaaactcttgatttatctcaagtagtaatttaattttatctatagaaagtaatgtcttggttcacgtttctgtgataggtcagtcactggccttgtgggggaacttgctaaaaggtgatcctgacttgaccttttaaaagtatttatttaggagactgtggtactaattcttatgacactgaataagagaagagtagaataacagaacttgagtttccttaaagagcacttagtataatcccatggagtatggagggaattgctttgatgccttttacaattcctggatcccctctgctgtca

SEQ ID NO: 57671 - DNA, 1034 bp, Homo sapiens
cccaatctatgcatgtgtcagagagattgtggtcttcttataaaggcttttgagtggtttactcccttcttcctctttttgctcttttccacttttcatgagctagttattccagtttgtatcttctacttctgccctgctttaatattacaccttgtctttttgctgttgttatttaaatcactactttttagaaacatcttcatttgtattttaacagtttatatctagcctggtaaagttgtaaatatgataaatggttaaagtaaataatgttggcttctttgtaggttgcaaataatccattctatatggctaaatggcagaaaattctaaagatattttaaaaaactaaactcagccatgtaagcagcagtaacctttcttcttttattatgacttaaatagtatgaatatggctaatattttaggatctaacaagtaataactataatcagtaactataataaataacaaatgataaattagtagctataaataataaaatcaataactataagagggctataaaagtaaatttttttgccaaattgagagatttatgtttctgtaatattttatcaatgttctactttacagctaaatcttaaatagaaaaatatatgaaaaatattttaaaagttattggaatcctcatatttaactgttagtacctatttgttttaatgaggctctgatatgtgcattatcagcttgtttaaggtacgataattttttttttgctaacattaaatgatcatgggtgaaattcttaaatagtaatagattggaaaacaaaatgtataaattaggatgctttggagtacaaacataagattggtttaaataatagagaaactagagaaacttgatatagttcatacaagaagtcgtcaaacatcgatatagttcatacaagaagtcgtcaaacatccaggtgctttctgcttctcatttctgccactcacagtaatggtgtcattggagggcttagatttcttgcggttataagactgtcagtggaagttggaact

SEQ ID NO: 57672 - DNA, 1751 bp, Homo sapiens
cacttaaatatgtggtctgagatatcattagagacttttacagtgtttccagaactaaacactattttcctaggaactatctgatgttttaagaatgtacctctgtagtattacaaatgtcgccaccattcagggtacctgagaactgggcctgagagcagggcccagttaagtgttagtgattacgcacttttggggaaaaaaaaagtaggtaattccaaaatttctttcaggttttgtttcccttgatttttttttttttttaaataggctttggtattttaaaaatgcacagtgtagtatttaaaaaatacacagtgtagctgcagctgcagctgcacaaaacagcactctgtcctcattcccggtttcattcacatttaagtgtttaccccttcgaatttttgttggaaaactacgagggtaggtatttcagtgcatcgtctataaaacatattaaacttaatgtacgacttaagggtgtcttggaaatgccatgtatgattactgtttgctccgaattgttttatcagcacttcatcaggatttatgtaaatatatagcaagatgttttaagacgcatttctttacccttttgagactttttcaatttaattctcccccctccacccatttttgtagggaatatggatgaataacatttggttacataattgtaatcaaatatatgcatttgtataatataatggcagttcagaatttttaaattgatacaattcaatctcagagttataaaacttctaaactgctgaattctcctttggtaattaatagtttgattattcctaggtgttgtgtattttcacaaaattttttttattctgaagaaaacacttacagagtatatttcatgcttttcagtgggcagtgggaatgagaaggacagatgatcatgaagcattccttaatatttttgagcaggataacttcttttttaacctttgtcaaaataactgccctgccatactatttaggtaatgaggttatacaatgagtggttttgttgtaatagctatcaaagtgttaagcggaacaatatataaatgaataaaactgattttagtggtctataaaaattgagaaatacgtgttttctgttacataatggaaataggcctttttgtaaatcttattagtagtcttctgttggtagtgggtaagggctactttttcaatccagtctgcttttttatagaatagtgattcacaatttttttctctgaaggatcacatggtaaatatttctggctttgtgagccctgtgattgcatctgctgccattgtagccaaatacagtatctgaccaagtgggcataggtgtgttcaaataaagctttatttatacaaataggttggtagctttcccccactctagaaaataataccagaggtctaaatgtggtgctatgccattgatgtttgggttgattcggaattttccacaacagcgttttataattatttttgtgcttagactcttgtgacaatttgttgatcttccacagttccctcagaataatacccagctgtccattcccaaattttgtgtttcatttcagagtttgtcagcataagaacctcttttaggtttatccatgttttcaggtttcttcaccattctttgcttctggaggatcccactcctatcctgtgacattgaatgaatgcctgtctgtggctccctgcttctgactaaagcgacatagaatctaatgtcagtcatttgtctt

SEQ ID NO: 57673 - DNA, 1038 bp, Homo sapiens
tgtgtgtgctggacttttgaccccttagccctcggggaagcccaggtaggacctgggacaatcagaattcctggctagttgccaccagctacaagcagtctcttctctttatctgaccctgctgcacatatattatcattatctgtgtttaccatgatgtggaaaagactaggcagaaaactccagggttgtcattgcctactttatgaccttggttgagttgctcattttattcagactgtagttgtcgcaactcataaagttgccttgaggagtaaatgaaaatacctttgtaaatgtatggtagcaggcccagtgttagtttcatttcacttacttctctattcttaggaccttcaggggtgggaaacacatctcctgttgtcagtttgttctgatgacaggccctgtcacccactctgccttggcccagttttgtcttaatgggctgcttcccacttctgccatttccacttcctctgcttgaattctccttttcctttgccctgtgatttccatattcaaaatttaatggttcctacatttgagttagtttttatgactttctttggagtgtggggagagccagcaagccatagtttctcaggcagaaaaaggcacaagaggcttggggggttatattatggactacaaataatgtgagttgcaaaaagatctttaaatacagattcaaaaaattggcaaaattaaaaatgttcttcctagcatgcttaaaattgtttttttaaattgttgaaatatttcccctatatccttatatttacctaggtgaattactatacattttattatggttataatcataacaaagacatatgtccttatattatggttggaaaagttgaatagatgtgtttatgaaaaattgttatacttctaaaatgtaatgaattcctaatcttgtattgcctttatatctaactgctggaccatatagtaaagtgatatgataccggcacagtggctcatacttgtagtctcagcactttgggaggccaaggtgggaagattgcttga

SEQ ID NO: 57674 - DNA, 1024 bp, Homo sapiens
aggcttaagggagaatgtggctcatgcctttctcttagcttctggtattggcagcaatccttgtctttccttggcttgtggatatatcactccattctctgcctctgacatgcaggttcttcctatgtgttttcgcttgtgtctcttctcataaggacatcctcatgacctcacctttgctgcctatcactcttacacttaaaattcaacaagcaaaatctatgcttttctattcagattctttacttagaaaagattttcaaatttctgatgtttttggtcttaacagcagattttaagattgtgcggaggttgtgtctgagagataaaggcacccaaggcatcttatatgatatgcactcattaacatgatgatgataataacaggagagaaaatgccacttcaagcaaggtgaaagaaaatagtacatctaagtgttagttttagttccttctcaaccaaacggtcccttgttactggactgcttaggctgtgtactgttctcaccatttttggcatttttacaaaatttctctcaactgggtgtgaaagcttaccacttcccttgctcctgaggtgtttttttgcacaggggcaaaagctctttgccttgccacttagagattttgcctctagttaccattacctacctgtagttctctatcttgtttcacagctcgactgcaccagacttttctgtcttgcatgtctggccacgctggaaagtgttcaagaacattatgatgagtaacctgttcctttttccatgactgtcttatttccatctgggactttgataacaagtgacaggcacttgagtcccatctaacttccctccttgtcagtagatacaagcctttgcattcaagtgttgctctttattcaaaagcctgtttggcaattttaaaactgttttctatcagcgatttgttttcaccttttaaaaaaatttggagtttataaacagcacaagcccttgttgtttatgaccatttccccttctctttatttattataagaaga

SEQ ID NO: 57675 - DNA, 1005 bp, Homo sapiens
tctcaccactttaaatgtccattttccatatgtcactgttcaatctcagtgcattaaaataatctttatcctttaaggccctgctcaagtactatacaaaaaaatacaaataaacctctttcttctgcttctttaagccgttagtacttattgagtcttgttgtagttatcttagcttcctctctggagcataagcttctggaaggtgtgaatcatgtcctgtacagatctgtgttttctgtagggcctaggaccattcttgtcagaacttgccatttaaagaatggcagatgactgcttcccagagactacacttgacaggaggtctaggcaggtcctagcagtaagggaatgcccagaacaattgagctgttggtttcaggaaaggtctaggatgaatgccaggcacacgtctctgcaaggcccacagaacatggtatgaaggaggtcttattgtttgaaataggtaaaggtctaatctgtgaatggtcactgtcaggatattcagggatctagtctgagatgcttggttttgtatctgaattctgaattccaaggtctgaaagatctcagagtggggtgagataggaatcaggactaggaaaaacgagtgtgtcagacatgaacttggtgtgagtggggaggagtgtgtggagaccagacagagactagtttggcaattaagtctaagttagaggctcgagcaacagggaataaagtgagagataagtcctggagttaagatatgatattaaaacatgacaggcagttagattaaattgacttgaagctgatttgctaagctgttgactgagtatacttaaatttcctttccttagagcccagttcattcctagttctaggtaagtcgtttggctttctgtaaaggggtaggaacctttttattccttaaaggtatgactatctatttgccaattaattccatgttccaaggatcccctcatggagaaaatgttgcactgagttaaataaggaaataactgg

SEQ ID NO: 57676 - DNA, 1098 bp, Homo sapiens
ggtatggttataaaacttataatctgagaactgggaatgaagtgttgggggaaagggaagagtgatggcatgatcagttcctcagctaacctcgggttgtgtgccagaagaaggatttcagttttactttgataatgaacaaaaagtctggttaaaggaggcctttaaataacttggaatcaccattagtggaattaagataagaaaagatatgtttgttttctaaatggctagacaaaatcaagcaagcaaacatcgtccatgtggcaagagatgaaaaaaaatagcacagaaacataagaattaagaatataaaagacaagtgtcaacaaaacaatttgtatacagtatattaaatttccctttaaaaggactcagattaaagagagatcctcaactatgtgctgctttcaaaagatattcttagaacgaatcaacctagaaaggttaaaaataaaaaggtagccaagatttataaggaaaatacatcagaaaacacagaggagtagcaatataaattttaaagtagagtttaatgaagaaaatcactaaataagagaaagaacaactttataaatcgactcaagccctaataactaatagactaatgactatggaagaattaaagtaatatgagctgccttcccacttagacttatagtcctgtttttaacgttttttacttttaaatcgaaatgaataggaatctttcagttcatgctcttgagttactatattaatatcaaagcctgcaaaaatttggcccaaaggatgatatgttggtcgaatattgaccagactgtgttcaacagattaccagacttttccaagataatagaaattctgtaggagaattttgtggctagacaagtttggaaaaatctgcatcgggtactcttttggggtttacagtgcactttagtgtaattggatccctgagaagtcttatagctaagaaaccaacttgactttattttgcccagtattttgcagattcatttgttcatggaccctctccctgccattttttgttgttgttgttgttgttgttgttgtcatggaatacagattaacaactcctggaattctagtgtttta

SEQ ID NO: 57677 - DNA, 1182 bp, Homo sapiens
taagatgaatttaaatttggtctaacagttaagtgacagagaattcatacagattcttgaacagtaaggtggtataatactctaaaaaaaggattatttttggtgtacagcaagatgcatgaggatggctccaacagaatagaagtgttcatgtaggaaaatcaagggactttaggacctgaggctgggacagactctccaggatgtggttggattttgggctaaacagtctttctgtggtcttgaggactgcctttatagtctgtgaaaccctatccttcaattgtggctttacagagtttaagaaaattttgttcgtatgcagatttctgcagtcttcctgttgccaggaagaacctacagttacacaggagtgtgtgtgtgtgtgtatgtatgtgtgtgtgtgtgtatgtgtgcagacacgtgtgtgtaaacacacaaagtagactgaacttaaacctgatttataggagtcaggaaacctgagtttctttgctttctccttgtgtaattttggttaagttgtgtaacttctttctttggagtttcttgtctgtaatctggaaattatttcccactcactccactgtgatgttttgagaagatatctgtggaaactttttgaaaagtacaaaatgataagtgtaaaatgtcaataaagcatattgatgcttattttgctagaagagtacatataaacataaaatttagaaaccttaaaaatcacggccagagagaatcatgatttctacacctccctttttttttttggtgggggggtgcttccagttaaaagtaagcattcagtttgtactaatatttaaaagcctttgcatcatagagaaaattaatcaataacgaagtatcataatttagaatcattattgttactaacattttattccttattctaaagtaatttattcaggatgtgtgctgagacctgttgttttaactgtatagctagatgaaaatatgagagaagaggtttggatgaggtttctttcctttgtaacagtttgcttgaggaatgggcaggcttttcctcacttgacagatggtataggaagggcattgagaagcttgcatttgcttggtggtgatagagacagggctagaattcataatttttgttgttgttatttaacacattttccccctttgggtacaacattttcttgc

SEQ ID NO: 57678 - DNA, 1072 bp, Homo sapiens
taatttgtctctttcatttagatcatatattaaatattaagtaggtcgacctattttggcttctgtgtctaaatggacaagggtgttttaatctcttaggccttgaactggagagagggagaatggatgtgaataaaagtgtgtgtatgtgtgtgcgcatgtgagagagagagatagagctttcctgttacagcccaaaaccatgattatggttcacaacctggggttggttttctggtttgtattcttgctgccaggcctgtggccattgatttctacatgtatgaaaagtaattaatctggaaaaaaatgcagggattttggaattattttttggaaacattacttatgtattctggattttagaaactgttactttcaaactctttgttctttgttttattacgtgctaaccatctacttataatttttacatactttaatggctcagtaaaatatagtacaactgattacagttatttgttgtactctgagaaggcttattatgggaaaaaaaactgtgttggatataatgggagattcagaggaatctactacagactttgttgttatggacttcataatcccgattgatagtagtcattaacaatataagaaaggcccttagtgccactagagtataccatagtataggccttctacaggaaggggatgtctcctttggtttgaatgagaactcatggaagcatagggatttgtgcttggctttgagaggaggccattgtggtaggtgaaattataataggatttctgaaactcaaaaatgggccagtttggcagaaataagtggggcatgaggttctgattcattctctttatagctgccaaaatggtggtatttgtgaaatgaaaaatcaaccctataactcccatctggaaaacccgtctttagaggttacattggtagcctgaaacttcagatttttcttgatttttcatgtggcgatgtctctggaagatgtttcggaatactactacttccactaggccatgagctctttaatggaaccattctgagtacctgcctggttcaaaggaggagtttagtaaa

SEQ ID NO: 57679 - DNA, 1028 bp, Homo sapiens
aactgtgtggcaatcacaaagagcactgtagtttggatttagcaccaagctaaagtttcatatcttaggacagtttattacaatcaattcatctcagggcatctagtctgctgactctttttggctttacctaaaaagtcagaggtacttcagccacgtctatttccaaaccagaaataactcagacgtagcctcagcagcactagagatccacattagttacactggcttaggatttaaatgttcacaggcatcaatcatcatattaatgtttcagtgccgttgtaggtgtcgtcaggaatattaaaaaaaaaaaatgtgacccagcctttcttcacaaggaggattggagagggctggtttggcgctttcctcactttagcaatcccctgtcaatcattgagtaacttgcccaaaatcctgtgtggaaactcattactgttaaaggtgttatttttggatggaagcaaatgattgtagcacctctaatgctgtatgcacagcctctcaggcaggtggtgttccacgtccgtgttctcccttccagttcactggtgagtgttaccagaaatcacagtggctacgctggtgctgcttttctcagaatctctctgtattagtctgttctgaaaaagaagtctaatggaatcatagtttcacgtggctagggaggcctcacaattcatggtggaaagtgaaagacatgttttacatggcagcagatgagagaatgagagccaagcgaaaagggaaaccctttataagaccatcagattttgtgagacttattcactaccatgagagcaacatgggggaatctgcccccatgattcagttatttcccactgggtccctcgcacaccacatgggaattatgggagctataattcaggatgagatttgggtggggacacagccaaaccaaataactctcccttatcccaaatgactctagggtcagggatgggaaggctggagaaaaaaatggaaacaataatacattgggaaaacacctttctaccacttct

SEQ ID NO: 57680 - DNA, 1089 bp, Homo sapiens
gaaatacagaaatgtaggtcctacttcagacttacctaatcataatcaggggtggaggtgttgagtggcccaagcagttatatttaaaacaaaaaaagctccatgggtgattctgatagccaagcaggggtgtgaactacttgttcatagtatgcactcaggattacttggcccaaaataattaggtttatataactgtatttgctctgggagaaacagatttaatgtgtaattaataaatgaaaagtatttactcatgacatacactgcactcacattttttttttttgctttctcatacacatcctaaggtacagtctcagatttgagttaatccttttgcctatttaataatggtacgtggagtctatttcttattaggttcacaaaactacagagtaagagcgaataaaaagataagtaaaaaggcagcttactgtagctttttttccctttaaagtcagtttaaaaaaatttttttaatgttaggaatatgaaacaagtttttagaaagaggaaagtaccacttctcttccattgtgttacagtgggtttgggggaaagaggagggaaagaagaaagcaaaattttaaggatttagtaaggatgatatattatttattgtcttaatttcatcagtatgggatttggggtttgcttaaacaaacaaaagtagtaccttgtgtaatatttttgaagacatcatgtttttgtgtttttgagttctattaatatggcctactggtttttgcagtttaagttaaaaaaaaactgtaactttagtttcagaattaaatgtcagaattaagtcataaggcagaatcaaaatattaggtaacagactttgaattaagtacattcattagggagtgagttacagtaataaccacaacactgatttcaataaaaatcagtgaatatgggaagtgattggctgatatgtgctcatttcgtttttgggtcagtggtcccttgattaaagattctgttttatgtgctagaagcctttgtatttagaactgttaacgtatcaatatgtagtaaggaagaagataaaattgaaccagcaggtgtcagcaagaaccaaaa

SEQ ID NO: 57681 - DNA, 1693 bp, Homo sapiens
ttcttctttatcacttgatgaattgacgaaaatacaaattcagtaggcaaatatgatatccagtatttttgataatcttattagagtagtaagcaataaaataatgagtgacaggaacatcgccgagaccacaaagaaggtatgtgataactcaggccagtctgaaatactttcattctctatgttttatttcttgttatgccaaataaagacctgctattttacatttatccttaacttattaaatgtaatactacccagaaatttgattcctaggtatttaccagagcgtagagtgtattgaaaacttatgtatggactggtacgcaaatatttataatggctttattcataattgtcctgaactggaaacaatgcagacccccctcagttggagaatgaatattgagatacgtccattcaatggagtagtactcagccataaaaatgaacaaactgtgtaaccttgatgaatctgaaatgcaccatgctaagtgaaagaagtcatattcaaaaggcttcatttatatgatatcctagaaaagataaaactatagggacagaatacagattagtatttgtcaaggattggaggagggtttgacactgaaaggacacaggggacttgtatgggctgatggaactgttctatattttgattctagtggttgatttcattactgagtttgtcaaacttctagaaattgtacattaaaatggcaatttaattgtatataagttataccttaatttaaaaagttctaaaaataaatgttaaaaagggacatagactgaaaaataaaaatgaaataaagataatgttaatatagtttttcttttcccagacatcctaatagaacccttagaacacttcaacttcatttatctctctatttatgtgttggttgtcatgtatttcaattttagatacatttctaacatggcaatcacttttatctgtggtttcatgtagatgtttaattaaatttgccctgttgccatgctcttcatttaacatttcttcctatatctttagccttctatctgaggtcattttgattctgcctattctctttgctattttgtgttcatgtagtcttacttgcttgagtgcctggctgtttttcatgatgtattggatatagtatgtgcaaaattgtttgtacaaataatctggagcgtaagatgttatcttccttcagataatttttactttttgtctaggtagctgggggcagtagctatcagaaatcactttaattttagggtttgaataaatgtatgaagtataatgtgttttgtttgtttattttgggacagggtcttgccctgtcacccaatctgaaatgcagtggtacgactggtgctgcaaccttgacctcccaagctcatgcagtactcccacctcagcctcctgaggagctgggaccacaggcacctgccaccacgcccagtttattatttttattttttgtagagaccgtgtctccctatgtcgcccaggttggtaatgcatttattaattagcttgattgagctattgtacaatgtgtgcatatttcagaatatgtttgtatgataaatatattcagcttttgtcaattaagataattttagtatttgagataatttgatgccgtgagaaggcttgtttatgatgtttaaggcttttgaagtccttagccaaatcatg

SEQ ID NO: 57682 - DNA, 1015 bp, Homo sapiens
ctctcagtagcattattttagaagactgggaaaggacagcctctgctcagctttgacaaccttttttttgttttgttccacaccactggcctgaataatggggatgatatggcaacatctggttagcccagtgacttctttcacttttgtaatagaagtctgggcataaacagaaaactaaggatgtcaagtttctgagtgtcaaataccaattccctgttataatgataagtgatgtatattgttggcatatccattctttttcttgtttcaaaatgaatactctcaccccataatgtataatatgtggtctcatttttggtacagtgtaagttccttttgttttgttttagaatgtgagatttatgtttctttattaatgtattttgaaattttttctatcagctccactccttcccaccctcccttcttttccccctttcttcctttcttgattctttccactaacatctagaaggtactgaaaggatattttgactagattcttgttctgtatattttcattgcctttggactcttgtttttggaacagtggatttagctttttaaaaataaaaataaaaattcaaactgtataaagatggtggttgggaaatagtaaaatttttactctttactgtaagactaattttaaacaatggaagtttacaattaacattttgtgagtattttgatttatggttattgggtgaagatggctatggtagagtcacatttttttccaaaaagttaattataaaccaattataatcagagtacaattttaagaatttttgcgagttattagaaggaggattaattttcattgtgatatgatcagaggcctaggttatttttttttaatttgaagatagtgtaatattttggctacttatgaaagagaaaagacatgtcactcagatctgtgggtagaaaaaacagatattccttattcttacagtgtggaaagtatgaaaatcttatcttggagtcttgcaacttaaccagtaaggta

SEQ ID NO: 57683 - DNA, 1031 bp, Homo sapiens
agaagagaacctccacagactcctaccgtagttatcctcctcccagaatctgtattcacttcatctgccttttctgttgttaccagatgaactatccacactgctctcaaaggccaaccctcccatgtgcaccccctctactgggtccgtgctactatgctattacttctcccatctaaacaacaaaatgaaacaaaagaaaaccccttaaacagtctaagttactcttccttcgagttgttaacctatttctccgctcccttttatagcaaagttcccagaaaggtttttctgtaattcagtctcccatttctcctttctctctaaaatctactctaattaagctctctaccacactgtgccacctaagctgctcctgtcaagttacagttacctctcctgctccatccagtccagttttcaggcctcattttacttagcagctgcatttgatagagttgattatgctgtcttctttgaaacctattcttcacttggcttccaggaatcttattgttctcttgtcttaatggtccctctattgatttcttctcaccttctgagaaggtgacacttaacagtggagtgccccaaggctcagttccttagacctcttttctatctatatcccttacttagtgttctcttccagtctcatgattctatgctggtgactctttgtatctcaacctggacctctgccccgaattccaaactcatgtatccatttgcctacttggcatcaaattttcatgtttcaaccctaatgctgcccaaactgaattctaaatatttccctccagactgacagcccaccatcttctccttctcagtggcaagtctatccttccagttgctgaggttaaaactcttagagccattcctaacttcctcctatttctctggtctcatacttaatgttagcagataccagaggccgaatctttaaaatatatttagaatttgagcacttcttttcttctccactgctgctactctgaagttacttaatctttcacctattttattgc

SEQ ID NO: 57684 - DNA, 1050 bp, Homo sapiens
atttcctgctgctttatgctctcgtttcatagagagttgctgtgatattcagtgtatttttttacgggagtggggttgggtagttaagaaattctaaaattgttttctgaacatgcttattagttctgtaagcagttctttataaaatagattatatcaggaaaaaaaatcataggaacttcttttgtgaaggaatagaacaatgccttaaagctttacaaaggacagcagtgaatgcttgaattgtaatgaacatgattcatttctttttagtgagtaatattgtaaatcattgtgcatcataacaatatatttcattctctcaagtcttcagcttaattggggtacaagaggaaatatagcttctggtctgtattccagaaatgaacctctggatagcattgcatcaaagatttttacaagtaaataattaattggttcagagcaggctgacaaatataattaagcaatttatagttgaaatattcagtatttctctaattagtgacaaaggaatacctgaggctgtggtcagatgaaatacttcccagatgagttttaggataaaaggaaatctagaatttttcatcataatttcttcattatcagcaatcagaattttaaaggaaaatcgactcttacaaaacagatttcagttaaattgtgctgtgtatgccatatattttctttattgtagttaaattggacacatacatgctccattttgtagtatgtcttattatactgtttatttcactattctaatgtcaagaaacatatttggtgatgaagacccagtgtagaggaaattaatctcaaaaaatatataaataagaggattttaaaatttcaacttgtcaatagaaatgttactaaaatatattttaaattttcatagttcatttcacaaaatatacttcattcattgaattaatttgtaagtgcctgtatttataactacctatttgaattaatataggtcaatttgagacaaatagaagaaactgtaaatgcatgtatttaatattatatatttttaaaaattgtttt

SEQ ID NO: 57685 - DNA, 1045 bp, Homo sapiens
taagtaattgatccgctgatactgaagtgtgaaaaattttaatacaattcatttatgcaattaagatttttaaagccatctaagtaaataaatatgtgccttatagtgttgtcgtggttttatattttatgcaaatctaccagtaagttaatttttattaagatattttatttaaaattgatatcaaaaggacacgtgtattttgtgctttgaatttcacaggttttttgaaaatggaaaacaaaatgcatttgaaatagaaattaataatcatgttcatcatgctacattgatgattagctgtctagcagagaatcgagaactcctaggtattaggatatatcagaattattcaaaataaactaattggttcataaatcaaactttcatgattaaaataaattttaaattctgtcacgaaaagtagttgttaattcctttaaaatttctaaaatgtctatcatcttttacctgatcccttcatttattcacagatataaaaccagctaatgtgttcattacagccactggggtggtaaaacttggagatcttgggcttggccggtttttcagctcaaaaaccacagctgcacattctttaggtaagagacacaatataatttcattcagttactttgtgtatgtgtgattaaaagataagaggtataccaattacatgccagctcttacattcttaataaaactattttaaaaatcaccaggtcctgaacagatgcctgcaactctctattaggtataaggtttcctctaatatgacagttggatacttctgttaacttgacctcaggcagacactgagttaaaaaaaaaaatgctgataagtctggtttaactattgccatagaaaagtccttttattgtacatttaataatagataatatggtgattaagctgtctcttggaagaagacttcacctgaccatttaaaaatacaatagtagtttgtaaatttttatttattaaaataaagtatatggctgtgagtgttattgtttagaattaatagaaattactaaaggagat

SEQ ID NO: 57686 - DNA, 1138 bp, Homo sapiens
tagtgatatgacagaaaatggccagttggggaactaatttggagagagtgaggtggggcaagtcccttctgagaaggtgatatttaaactgagatgtaaaggatataaaagaggcagctatgaaataatgtcccaggtagactgaagagcatttcatacaaaaggtggatacaggataagctctgtctgctggaactgagtgaagaaaagacagggctggatgtaggagcaattcacattttattctaagtgcagtggcaagctttcccaaggttaaatataatgagagcgatgtgatatgggttgaagacagcagccacgagcctccttcgttcttctttgggctaagcatgcccagggtagtctcctatcttcagggtcttctgtgtcctgcgagtctgcatcttttcctctcagagtacccttagtatgtgctacccagaactgagcagagtacaccacattggaactcattagcccatagagcagaatgtttacactgcctgtggtctgtgatctaaacggttgtttggttttttttggtctccttatcctcctcccaccttcacttttgtttttacacgaagttatgttagggaagattttcaattgttgtttttgtattaatttgtatggaggtgtggctagggagactaattgtaggatattttgacataagtgtaggacacttatgaattttgccttattatttgtcaatcttataaaaatatatgttaagaaacttatctatatctacatctttaaaatttatgatgagggcacaactttcttaagctttctaatagtataggtcagtggctttcaaatttcttgacaatgatggaactgcattacattctgatattgtctgttctatgttatttcactagaaatcacactggttacagcccactaaattgatttcacaactcgttaatgggttgtatgacccacaatttggaaaacagtggtctaggtctgcagcgccttcatgctgtttcatttacttaaaggctaattcccattttctacctacttttggacattctccagacttgttatctggcctgttgaattggtcaatcataaattactcatttacacagcttcttgtgcttctggaggggtataataacat

SEQ ID NO: 57687 - DNA, 1051 bp, Homo sapiens
caaaaaaaagctagagaggttctgtggaagaggttccaaaattagaggaagtttacatttactgaaaataaatatttcttttttgaagagatattttgactttagattttcacatttttattataggtctttataggtactttattgcattgtaatttacatttacttttcaagggagaaaatgccacacttggcttaataaaaatttataaacaaatcattttctttcattgttagcttactgcatgtttgtgtgtgagtttacttgtatgtgcttgttgtacatcctaaaaatgagacagatttttgctttaaaaaaaaaaaagctaactaaaactctctgatattgatccttgtgctaaacaaatatttgaaacctcttgggaggaaattatgttcttgtttttgtttttgttataggattgcttgaactgctgtttacctttctcagtgagacaaatggttctttgattttgtaatattgccagcagagtaaatgcatggccatcattcaagctcgatatcagaattttcacactagagtctcttgagtgtacaattcgtgttgcccacactatttccaagtgtgatatatcctctgatttcaacttagaaaattagtgttcttgaaccaggcattaaaacagtttcatttttggtgccaggtgccacctgtggtcacatacttgtttttcccacacctttcctagcacctctagatagatctttggcttattccccttcgttgttcagggtggttgagagctgtaaaggcagcatatgttcagtcagtactataggctgctttcactgatttatttttaactttcaatcccttcttaagtaattgctctggtaaggagctattatctaattttaaacggtgtacctttaacctcccagccgccataacaggtatttatttaaatcagcgtagctgcagagtagcataattttcacatgtggcccattgaacctggacccttattcctggtttttcttatgtacatgctgtgacttttagaagatttctctgcttcttaatttggaa

SEQ ID NO: 57688 - DNA, 1033 bp, Homo sapiens
gtaaatttaacattctcatcacagtatcagttggccaccttgctgaaagttgccatgtaagattagatctttaagctttgaatgttctatttttgtttaaaaaatatagttaagcagtccctttgttcacctatgcttctgaagcaacactggggacttgctccttgatgacatgaatccaaaacggtgtcctatatttcacatgtcctgtgggatcctacaaaatcatgtaactttctgtaagactttcacagttttcaaaagacactgaatgatcttcagctgtgaaatatagacattacattaccttatatctgtgtaagattactttcttttccctttccctttacccccaattcaatcactagtgacactttggtgtacaagttggatacgcctaatcattttgtatgaatatctaaagctccaaaatataatgtactttaatgtattagacccactttggggtgctaaaatgtgtccttgggtagatggaaattgggtatatcctggaggctgacataacataattggtctcagagggattaagatgggggtgaaaaagaaacagtaccaatagcactagtctttattattctgttgagaattgtgttagtgacctaaagctgtaatgcacaaagagccctattgttattacctgtacgtgactgaacttgatctgtaattgggttatcaccctgacaacaatgactgttaacattgtcttctttttaatatttctggtatcaacctatttgctttgatatctctttagaaatatacagatcgaaatgtattagtattttctctactttattgagaacattcattaatttccttatggttaatgacctcgtaatcccttaggaatgttgtagagaatccattttatttttactttatatactttgtttcatttaagtgtttctgtgttgctttttaaatttttgtgaagcatctgaattaaacagttttctctgattttgcaaaggcttttgtatattcagacctttacttttgccttatttttaac

SEQ ID NO: 57689 - DNA, 1729 bp, Homo sapiens
aatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgttttgtttgtttttcctgagggctagatgcattttttttctcacactcttaatg

SEQ ID NO: 57690 - DNA, 1040 bp, Homo sapiens
tgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaatgtctgggtatctatgattttttcccctaaagtcttccattttttattttacttaatacttaatgtacagaaacagttcttacgcattttcataactttgccattttggagaagcttaagaattggaatagacaagggtgataacagagattacacaaatcctaaaaagtagttttatcaacatgcattaaactaaggacatcttcaggacatcattttctgtttt

SEQ ID NO: 57691 - DNA, 1609 bp, Homo sapiens
agtggcaaattcaaaatggcatccttctgtcaaaagttcgagcttggccgggcaaggtggctcactcctgtaatcccagcactttgggaggctggggcgggtggatcacgggggcgggtggatcacgaggtcaggaaatcaagaccatgctggccaacatggtaaaaccccgtctctactaaaaatacaaaaatacaaaaaaaaaaaaaaaaaaaatagctgggcgtggtggcacggctttagtcccagctactcgggaggctgaagcaggagaattgcttgaacccgggaggcagaggttgcagtgaggcgagatcaggccactgcactccagcctggcgacaaggcgagactccgtctcaaaaaaaaaaaaaaaaaagtacgagctcgtgctcgtggccccagtggccagaaagcgttaccaggctgagtgggacgactatgtgcccaaactgcaggagcagctgtctgggaagtagggggcagctcagggacctgaactgtcccagaggccccaagccgtgttctccagttcagtgttgcatgtataatagatttctcctcttccggctcccctttgcacatgcaagacctgagcagtcagatggtttagggtaacttttcctgctgcctggcctttataattctagtcactcactcactcactctggtttatgttttgatcaaattggaactctattttcaggaatattctggtactgtgatggggtcatcaaattaatatgaaaatagcaatccagagtttaaagaagaaaaaactgggggggaaaaaaagaccaggcccacagtaatagagcaaagcatcaaagaatctttaagggaggttacaaaaaaaaaaagaaaaagaaaaaggatttgtcacctctctgcctttgtgatcctaataccagaattgtacgcagcgtgtttttatggtgctgtcgctcacctagacaaccagaggctggctggcatggaggctaaaccccaacacggtgcatctcagatgccttaataggcgtcagtatctcgctctggtgcctttaaaaagcaatcctggaaaaagcattagggagagtggctttgcttttgttggggcatggccatctagaccggcagcagtgctcattgacagcttattaagaatccttacaactgtggttgttaaattgatagctcttcatgggggtaagaaaagctgatctggagttgctgaatgttgggttaattctgctgtttgcttataattgaataaaaatagaaacgttgagtgaacaacatcaaaaagttctataaatggtagtcattattgttaccaccatctggattatcaccttcagtcattttgactttttaatttgatttgtccttcttaaaggcactggtgaaatcagcatcccttgtatcctacacagtagttagtttatagaagaacaataaacatttttggatttactcttgctatagtttgtgcctatggttccacagtaaaaatactttgagcaatataattttgaaactcactgtaagatatgtgtaatttctcatttcataagatggtattgcatttcctcttggcactttcatgtgctttcgaattttcatatgt

SEQ ID NO: 57692 - DNA, 1100 bp, Homo sapiens
agagatgaaatcctcctgtattgttcaggctggtcttggtatcctgaactcaagtgatcctcccagtttggcctccaaaagtgttggcattacaggcatgagccacctcacctcaccaggtcacttactttaaaattttctactaggtgatgtgaaggcccccaaatttaaatataccaatatttctcttttattatatttttaaaatttgaggttttaataagctatctagatccatgaatattaaaatagatttttcttttgtagacccagcattgttcactgaggatagatgtgggatcagttcctttcaggtattaattgtaatgttgctaaacatattaccatgaatctgtagtatcaaaattcagatattaaacttgggaggatttatagtccaacttgtagtaactaaataataaaatggtggcatgattatagttcaatttttttctttatgaagagcttagggtaacaatgctttgttcctgtatgttgcacttttaaattacagtaaagtgtttccctgaaaacaaataatatggcatgcaataaaggggaaaagtggatatgagaacttatccttgccagtatatttgaaatgtgactaaacatttttacagtgaatatgttcatattgaaaagaaattacaatttcctttaaccaagtactgggtcactatttcttccaacttagttattgaagaaacactcagctaccatagatttgctaggccgaagtttctcaaactttagctgtgtcagcattacttggggggttaattggaatgcatattgctgggcttgatgatcagagtttctgagaacttgtgttcctaacaagttctccggcgatgcagtagtatagagaggcattgttctggagacatgcttaattttaggtacaacttattttgacttgagaactttctctttattaaaatagcaaaggcggtgtagatgaaaataaataaattgtattcatttgggttttctcatttgcaacagaccacatcagcattaccactggaaagaatgacttaggagagtggttgttttaatgagagattctttacatgccattgaaagacaggaaacct

SEQ ID NO: 57693 - DNA, 1035 bp, Homo sapiens
gaacttgtcccctgtcaaagagaaaaccttcagctcaatataaccaaggcaatttttgaatcaccctcattcaactaaatacttgattagaaattaactttatgcttttacattgtagagaacttaggtgaactttctccccattttctgcctttttttggcaggtgtgatctccaaatccttccctttattgattgcagtatcaatgagtatttatcaagaaggctcctaagagagatggaaatggaaatatgaaaactctaattccttttctttttaattgtgtatttattgatttttttcatatactttctaaagccaagaattagctgtatgaatgacctttgcatgttaactaaagcctaattggtaagctgatgtatcactgagaggaaatttctattggagaaaaagacattttcctagcacataagtcaccccaggttgcatggctgttaataatggctaacacatataactcttcctatgggctagatactgtgctgtgtgcttttacccatatcaactctggtaattctcttaataaccctgtgaggtgagcattattattttagctttacagaagcagaaaagtgacttggcaaaaattgcatggctagaaagcgatggagtcagattcaaactcagagtccagcttctaacttctatgctggactgctgctagatggaaccttatctagcagtgatgaagtgtgctagatgggactgcattgtcaatgcaggaaaaatgctcctatagtcaataaaacattttgtgagatctgcttgtagctgagctgagtttttcaaaagaaaaaactacaaaataaatgttaatatttgcaataacatttactggttcctcttcagattagcattatataaatatataacttgtttccttagcaactttgagataaaatgtaggctatccatgtacaatataattgcttgattcagatgatgttgacatggagagtaaataaaggcaaactggcaaggttcatgtagtaattttaatttattaaatggttc

SEQ ID NO: 57694 - DNA, 1067 bp, Homo sapiens
ccctcaccagacactgaatccaccaatgccttcatcttggacttttcacactccagaactgtgagcaataaattctgttgtttgtacattaccagtctaagatatttttgttatagcaggctgaaaggacaaagacagatctttgcctgtcccattcttatcattaatctttaaatgaaaataattcttcctgatccaactctttttagatttgtggggaacgttctggggcagtgtcctaagctagtagtactctccgtggttcttaagaaagtttcttatggcacaagtgtatgtggttgagtgagttcttaaactgatttccccaccattgaaggagatctacacttacatggaggctctctataaagagtacctcacctcataccctatctagtggcaggtgcccttcagcaaagaaaagcatctatgtgttccttgttcagctccacactctcagcttcttcgcattgccaaattgatcctaagaggttctctataccagtccccccaaattctcattcaaagacagggcttattggattaacccttcagcttagatcacctactttgagcactaggttctataggctttctttgacatctgcagccacagatatcttctcttggtgtcttcccacatacatgatagatccttgctgactttcctcatgtattgtggtttggggatatggcagctcatagttttaccaatgatggaatttacatttcagtttctcatttttggtattgttttaagatgattgctgagagaagggagcataaatgtctttttcctgctatcttaaagatacaagttgatagtttattggaagagaagtcttcctcttgcctctctgcttctcacaaatattttgtctctgctgtaggccagcactgtccagtatagcatgtatgatgatgaaggtgttctatatctgtgctgatcgatacaagtagccaatagccacaagtgactattgaacacttggaatgtggctggtgtggctgaggaccacattttaaaatttatccaagttaatttacttaaaattaaatttaactag

SEQ ID NO: 57695 - DNA, 1066 bp, Homo sapiens
ccccggtctcaccacagactcccaggcctcccgggttctagtctctggtctccgccaccagttacaattcccgcagcggtaagtacggggtgggttcctaagtgtgcttacactaagaggtacagtggcagttgctaagatgtccccggcggaggatgagatgcgtctgtccacccgcggtaggtgtatttatgggtcagtgcagaccaccgctggcgccggcgtttagaccacacagacccggttccacctacttacatctcaactgctttcccttcccgcagccacttggctgtcttcatattgtggcctcgggaacccagaaccattctcaaataacccatcttagacaccgcaaactcgggttcctcctcccacagcttcctttcggagagggctttctgggggacgcccagacccgtccaaggtcactgagctagcgggtccccggcttcaacaggggtcccttgcccagcagaattgaagggtcaaaggaccagagtgagtgctcagagggaggagggagttctgagggagaagaaagggtgcacttggagggcagtaatgagcttgacgctggaagcctggtgccgccgcccctgcctctgcctcttggatggagacccagctgcttccttaaatcccttgcagagctacctgaggaaggtttgtgtgccctcgggtctctggcaagaatcaattccagtggaagattccttgccttgtccactgctggcggggatcttgacatccttccaggggatctgaaatagggctgcccccagggagcgtttcccatcgtcgagttaaaggcctggagcgccgagggcttaggcttctgagctaggagttcccttggttcttaggaaaggtcgttttctctcgctcgagactttctgctctttcagtccccctccatttcgctgctacgcttaggttttggcctggactagactttcaaagcaaaggaaagggcttccctccgtgatacaagctcctgcgttaattttttaaagcatggatttttaaaacccagtccccagccaccgttccctcccgcacccct

SEQ ID NO: 57696 - DNA, 1030 bp, Homo sapiens
tggtcccatcagacaacagaatgaaaaagtacagcctggactgatccttgtattccgtgtggaaacacaggtcactaaaactggaaagtctgtcgcttagatgatcttgggctccagtcgagggtcttttaaaagtgaacgaagggactagggagcagactggggaaagaggagtcgctgccccttcctctaattctatgagtgagctcttggcttgtggcccgcctctcattgagctgaccctcggccccttcagggcgccggggcccacgtgtcgcctcttcagggtctcagtgccctggggagttgaagctggaggacccttgaccgcagaccaactctgcatgtaagaacggtcagctaaattttctcctttcaatggtttaagtgggtgtttaactcccttcatctcctcatccgacacactagcaagggcacacgcccacccgcgcccccatcccttcttcttgcttcccctcagatcgaggaaattgccgctctggctgcttctccttcgccgccacgctcagacagaggtcgcttctgactagctgtaagacccggctgcatttacatccccccgccccgggccagggtggggtgggagggggtgaggcggggtgaagaggttggggcaggccgggggactggagcctgagcctcatccttattggctggcggctagtgtccgacctgagtccggaacccgcgtccgcattcactgtcttcacccctcaatccagccttcccccaacccctggccctacttacctccttctccccctcgtcttcccccctgtccttcccagcaccgtcaccctcggggctgggaagggccgttctcggtcccgcgcggggagtggaccaggcaggagagggaggttggaacttcacaactccacacttgcgatagtgagcaagagagaggcagagagagatagggggaaggggcggagaggaggggagagagaagggaggcgagagaaagaggagagagacccctgccgatcctgagccagagggcggtgga

SEQ ID NO: 57697 - DNA, 1018 bp, Homo sapiens
aggggtcttctggacacactacctagtgcccccaaaccagagaagtagtttttctttggtgcctgggctcagaagtcgccactcactcagcccatggttcgaaatcagcatgggaagcgccggggcaaggcttcgtcggagactagaggcctgcctgtcgggaggagcccctgggggatggggaccccattctcctgcttgctctggttcccacctgggacgcctccgtaggagcccagaaagacgatccactacatggtcccgggacagagcagcgcgcccaactttgagggaactttgtgcgcctctctgaggccctagctttccaaggcaccgccgtccgttcttctttccctagaccgaaactggggaagagtgtgggcgcttctttgccccgatgagttcgcctccccaaacgcctacttcggctgcaccagagcatctgggaaactctgaaaggtgcccaggcctcacacagcagcgtctccctactcagcctctgtctttgggttttttcaagagagtctctacctcatgcctcggtctttcttcgatgtcgggtccccgaggtaggcacggagtccctctgaaagcagttgcctatctgtgcccctttggtgtaaagttagagtttactttgttgggggaaggggaggtagaaaagatcacagttgggaaagtgcgcttttcgccttgttcctaaaacatgcctcaagactgtcatcgcgattgttaggagagctatcaacgtctaggggctataaaggaatttctgaaccctcggcccttcccaaacccccaggttcctaaaaccctagtgggggtctcttggggctgggattcaggctggcaccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccg

SEQ ID NO: 57698 - DNA, 1041 bp, Homo sapiens
aagactaaagcaatccaactgaaaacaagaataatttgtaaaactattaaaagtaaaatattctttgagtttttaaatcaagatacccttggaaaagtttgatttcaattctttttaaaagaggtgtgcttgtcacaagtgttaactactaatttcatgattcttaagagttaaagcctttaatggtgaaaaggagtttctcatgtaggatattatctttgatagtgtagaaatgtatttttttaaaagataatgactgaggctgcaaaataaaaaattgagaatcaggaaacatgaaaaataacgaactattaaatcattagcaaaggtctgaaaagaacaagaaagtggctcctgaaaagccacacttgaactttgttgaaagagcagaccctatactacaatgtacagattggcaggcagtaaagttaatatgtgactgctgtaaataatttgtagttcatggactactatggtatgttgctgctttctagcctctgacctgcttgctttccatggattaaatatactgcaaataaagcaataacagggatacatatcaccgatggtgctagatacaagagtgcattttatttgatcaatgaggcacaggctatttttatttggaacttttctgttatatggaactcatacttgatagaaatactaaaaaaaaaaatcatataaatctgctgaatagctaacacgcttcttccgaacagaggtagccactttggttattatgaggactgttaatgtcagtatcatttttaagagatcatgaaaggaaataattgatgcttattaattttcttattaccaatcactattatttcccaaatagcaaaatattgtggtagatgcttactacatacagtaagagactcagaagataagtaaatgttgtgattttgcatgatgtcatttaattccttttcaacaaaaataataaggctgcatttctttaccttaaataattaaactttcttttttttaagttaagctttcacaattgtaaatcacttgtggtacatgctcatg

SEQ ID NO: 57699 - DNA, 1173 bp, Homo sapiens
ttcttggtgctgaaaatatgtgttccttaattttctactttgtatgatttacagagtagacgtaattttattaccttgacttcaggactgtggcagcttaaatttatggggctttgattttgtgtagctcttagtttgggggggctggcatttaacataaagtataggaaactcgggcttttttttctaaatagtagaatatctgtattccttttaattcagatggtttgtggcttaaaacatttcaagtcaatgtgaaatagcgcctagtaaactatttttcttgaaaattaccatgtaaagagctatattataatggtgtcatcttgaaggtttcttttgaaggaaaaaatgccaacatttagtagtgtttagactctaaggaatgaaaatgataccactggttagtagtatcaagtaggtatttactactgtttgccttgacattaggttggtaaagcctttgttttcgtagcagattccaataggatgtttactgtcattggatggggaatgggcaaatggtgagtgctagtttacttggtttgggttgtagttctcataatctatgtcttgttgattttagtggactggtacattgtaaacatagtacttgtttgtatagggatctatgtttaaattaataattattttatttcctgaaacttaagtctgaatgaatgtgagaaagttatttagaagtttggaatctaagaggggctaccaaaacacatttggtagtcagtggtttcattcctattttaaaagtgagtcttgaatttgatttccaagtatattttgtcacaaaatcaatttcttccttttgctgtaacggggagagatgtggctgctaaatatctgtgacttgtgattacctaggacaggagattgattgtaaaatttctgagagaaggaaaatgcaaagccgacttttaattttaagagttactgttaaaaatcgtctgtgtaagtagatggtctggggaatgtggaagccacatgcaaatggaaaataatgctttcatagcagtctacattaagcactgttctttgtacatggaagcaaaaaagttacctgaacagacctaaataagttgataaaattccatcagcacgctgttaagactgtggacacatccagctctttatttccacgtcctttattgctacgct

SEQ ID NO: 57700 - DNA, 1323 bp, Homo sapiens
agtccagatgaccccgtgggagtgaatgagtcactttaaaaagctacaataattctttcaggccactggggtatcattcagtacagtggattcagcacttctgggccttgagtttctgaagcattctctagtgccctaccctctgcggatagtttactctccaggtgaatctggttcagtgacggcatatgggctgtgctctgccgttaaagcggccaaacacgattatatcctgtgctctactagaagctgggcatgttcagtatgggtttcttgttacgtatgcttgtcgagatagcagaaaaagaatgcagggagctcactttggcagcatatacaataaaattggaaagatacagagattagcatgaccccctgcacaaagatgacacaggcattcatgaaactgtccataaaaaagagaacacaggatggtaaccgggtgataggtgagccactaataaaattttctgatctttaaaccaaatctgttgagtgacctatgctcttgactgtttccttgtgtttttagaaattaagagctaattcgagacttttgtattctgctgaaagagctgtccttgtgagtcaagaagattggctttttttttcagttattttttttttcacctgtgtcttgaatatctcacaaacacaagagcagtgagaaaataattcccactttgttaaacaactaatgaatctggaggatctatttgatcttctaatgagaccagatgtcttaagagaattctgggaatggatatataagaacttcccctcggtgaatgattctgatacatgtacgtattaaaaaaaatctaaattaatcctgactgaaactcccaactagcatttctgtggaaaataggtctcagagactcagggagtttgtgccaaaggaatttagccatgctgaagttggtttttaagtatagctttatctaaagcgagggcacaaggggaggagcaaaccttcttttttctctagccaattatggaagctatctgagcagcattatttatctatttttaacattctagatcctttttcctaaatcacagttacctttcccaatgcaggcctataatctcagactttattgaatctgccccaattttaagctatattctttagtaaatttacttagtcctacttttttttttttaagacagggtctctctctgttgcccaggctggagtgcagtggcatgatcatagctcactgcagccttgaccttgtggcctcaagccatcttcccactttagcttcccaaatagctgggaccacaggcgcatgcaaccacgctagctaatttttt

SEQ ID NO: 57701 - DNA, 1598 bp, Homo sapiens
ctgacctcaggtgatccaccacctcggcctcccaaaatgttgggattacaggcgtgagccaccatgcccagccaagtttttctttttaaccttgaactgatttattgctgattatttcatagttattattttaatgacaccaaatcatccttccagtatatgcacacatcgagggggcagtctagcccagtgtgcctaaagtgattccacactagctttttaaaattacatattcccaaattctaccccagacctgatgaattgctcatccattcatatatttattaattcaacatacattaattaagtatccagtatgtgtcaagccctgttctagaagtgggaagaaacaagtgaggaggaagggagcagttagaggggttcagagaagaccaatgtgaagagctgacatttcagctgaaatccaaataacaagaaagaaaacagccttgataaatctggacacacagcactacaggcacaggaatagcatatgcaaaaatcctgaggtagaagctagcttaatattttcaagaaaataaaggaaggtcactacctaaaaatcaatgattgtgggggaaatagggctcttgaaaatgtcaaaaagtttgacaaggtccagctcctggagggcttggattttattgtttggaataggaagccataggaggattttaagcaatggagtgatttcatcgaattctcagtagaaaaactattgcactggctgcagatgggaaaaaagttgaagggaagcaagagagtatacaggaggtccatcaccccaggggagagatggagagatggtggcttagatcagggcaggagaatggagatgggggagaagttgatggacccaggatacatgttgaggtaaagctgatagaatttgccaaaaagactttgagagaagatgaggcaggcaggactcaggtttttggcttaagcctttgggagccatttgtggagaaggggaaccagaccatctaggggaaaatcctgcacatgttctaaaacttccctaaacagatagagccaggtgccagagccagttctcagatgtcacctttgggaactattcatttattctaatccttatttttattcaagaaggcacagctcgaccactccacgcagatataaattcaagctcttcccaaagatttctcaggggtggggatcctctatacattccctgccatctatttaattaattatctttttttttttttttttgagagggagtctcactctgtcacccaggctggggtgcaatggcacgatctcggctcacagcaacctctgcctcctggggtcaagtgatcctcctgccccagtctcctgagtagcaggaattacaggtgcccaccaccatgcccagctaatttttgtatttttagtagagacagggtttcaccatgttggtcagggtgatctcgaacttctgacctccagtgatctgcccacctcggcctcgggattacaggcgtgagcccccatgcctggcccctgccatctattttaaagtttggcagtagtcaagacattcttttatgtacaacttaaatccttccttctgcatcacgtgtcattccctg

SEQ ID NO: 57702 - DNA, 1607 bp, Homo sapiens
caggatgatcgcttgagctgaggaggtccaggctacggtaagctgagattgcaccactgcactccagcctaggtgacagagtgagactctgtctcaaaaaaaaaaaaaaatcactcactgttcctgcataataacttttaatcaaaaatctgttccaaccccccagccccatcccccccaccaaatatatacacaaacctgatttagagctggtttaagtggctggcttttgctctgtgtcaatgtgccacgcctgtgtatgtacctgagcagttaggatgcatagcagagtttcagtttatatgtgcaggctctcaggtaaaagggagaattctggaagaatctgcagggaatactagaaacgtgttggcaatactttataagagagagtaaaaatgaatttatcttttgaaatgggagcaaagctacctatttttccagatatatacgtccttttacaagtcgtcctttttagagcaattgacttctttggtttgaaattatttacccagatggctgcctaacgagaatttgagattaggtcaaatcatttgtaggactattttgattaatgttctttgatttctaaatcaaatgtaccagaccaaacactttcaaagagaggaattaatatccacaaaatattatttcatatgcttttgctctaggtttttccacagctttcagccctgtctcatttcaccttaggaggtagagaaaaataactaacacatcaataattagtttagacctgaaaacactctgctgcacagctgtaatgtttcacaatggtttctgagctaagaggtgtttatgtagcatcaactttatcgaaacaaaaccctaggtaaaaacacattgaaatggcacttaaaacaacaacagtgcccaaaatctgttgtttcattacacttgagtataaggcaaatctggaagttaaattgtcccatattgagaataactgaataaatgtttacataattgctcccacttttgctgaatcttttggtttgatcaggtttagagcagagaggtaaaaaatacatttattaaaagagagcttttgagattgaatgctctaattaactgctaattacttctctaactaggctattttagattaaaaacctaactgtctcaattctagtggattttgaggttgtgatgaagagcagagccgatattcagtgggaccacaggatcaagcactgcctgtgttactcagtatttctctgctcagagacagaaccaattataatatttagcagattttttttattggaaagtcttaaaaattgatcagttttaaaatagatgcacacaaactaccttgagctttactttctgatgaaaacaatctatactatatgataaagaacagatagatatggaatgctggttcaagctgacaaaatatgcacttttgttgtcttagatctagtgaggaaattgattcatgtttggtatgactatcttcacaaggaattgcttataaagaggtagggcctaactcatttatataaatcgaggtaaaggaataccaggagtaaatctaggaaaattaatttttctgtttttaggtgcttctaatactgggaaaccctatt

SEQ ID NO: 57703 - DNA, 1032 bp, Homo sapiens
attagactttcattaaaactaagtgccacacagagaagaggtgtaaaacagagtagtaatctgttgcgtgcacttgaagggttcttgaaagacgtgcataaaccgttaccgttgtagcacaagttgagcagcaaaagccaaagtcgcacatctgtgtcttgtcgccacctctccacttatccactcatgctggcttttctcccagcagctctttgccctcctccttttaacactgtgggctgaggtgaggatgttctagtcaagagtctttacgagccttatatcgccaggctttcagaaaatgtgaagcatggtagtgtgaatttagaaaaaataaaagtgtgtataaaagctcttctgttttcttttcttttttttttgttaagaaacaatagtgtttatttatcatgttttgcttagaattcctttggtattctgttctcttgattttaacaagaagctaaactcaataacatcttttaaaaacaaaacaattttcggttgagggtgggtgaggaagttatatgaagattgagtgggaacctcaacccaaggacataatagacaagaaacagtttttttcctcccctttcttcagaagtagtcttccgcatggtttaatgtgctaacataaccccggttccaatatttcaaaagatacagaacttcccagcatgatgataaagttttcctgtgttccaataataaaacctcaacgtaccagtgatttccagttcctttgtggctcagcaacttgtgaagaccaactaagtcctaagtacccagcctgcagtatcagtgtgggagtcggaaacagatgttcacgggacaatgccatttgttgtcactgtcgatactatgtggcaactttcccaaatgaaattgtttgtggatggaaaagaatgtaagcagtgattcatgcccaggaatttttttttttttttgtctgcaggctaaccgtatcttatttgttttaaatcgcagagcattagtggattaaaaattttaggttaacttactattatagtatct

SEQ ID NO: 57704 - DNA, 1074 bp, Homo sapiens
tgatagtcccaggtaaagaagctagttaaagaaagttagtatcctcacgtttctgtgaagattcaagcaagcatttcaaattgctccaaacgtgggcatcagaactttctgattattaaacaaagttgattgtttttattttctaacatatctacgttagaaatttggcattgataccagcacacttggagaaggcaaaaacacatgagttggtccactaaagacttcaatagcacttggaaagagatactcgtgtgtgttatgtatggcatgtcaagggaagttacctacatcccagctaccttgctttagaacaggaaaggaatgaactaaggtgcacttgcctgtctcaaccagtgaatcaagactgattgtttgtagttattttaatttatgaaaaattcaaaatttaatgctacagaaaagacaatgggcctagggaggactatgttaaagtcttgttcattttctagacccaacagagaatacttgaatgcacagaacaactgaggaaaatcatactttaagtaacaaatacaaactagaaattaattctttcataattaagactatttcaactattaattttcttccaatatacccctctactttttttagccatttatgggtcattctacattttcttaagttctaatatgatctggagaatgtcttggacttctttaaagtaacttcatgcatgtgctctcattagatcctttatttactaccttactttaatgttatacataatacataataaacatgtgaaattcattttaatgaatagtgtaagcctcaaaaaatttacttaaccacttctttgacctagcaaatttataagcgatagtaaaactttccttttacctttacaataatagcttttaagtactcaggctgacaaattcttcatggactcacttttatgtttttcaatttctattaatttctctgtattaaagttgaattagatggatttatgttgcctattcctggcattcatagcaactataaggcatgatcaagaaaacagaaattctaatcctcatgttacagaaatggccccaattctac

SEQ ID NO: 57705 - DNA, 1051 bp, Homo sapiens
ttacttagagtgctccgaatcccatctttgatctctggcgatatttttctctgttatgtcactgaggtcacctggctcatgtgtgacaaactgcctgcataagtcacagtgccagtggcagagatttgtaaccatgcccctggtccattgcctttgaattatttcacaggcccgctgctttacatttacactctgtcggaagatgaacaggggaagggagtaaaatcaagggcagggtctcatcctgaaggacaaggggaaacaggtggaaggttaatggccctggagcgattccacaagcctctcaggcttgatatatgggcctggggcctaaaacgggcattggctttcaaagatatattatttcatttgaggagagacattctggagttcctgcatttgtctgctgatagatgatcctctgtccacaattggttatggcgtgtgagttttccttgggcctgctcccatacataaaaattttgctgagctctccaaccttttgcatgcctttaggaatgggaccggtgcaagcccactggcaggctgttggatttttttgctgctattttagtagttccttttgaaccgtgaggcaagtggggaatgaaagacacttctgttcattcatacatgacttgataagggtggccttgttataaaaaaaaaaaatggtgaaagggatgttaggaatcaaacatatgtgtcattttgggaagacaggctcagtccaaaatttagtcatttgggtttcaaaaagttgcttacataaaagctagatactatcaaatagcttttgactttattactgttttgcactccccaggcttttagcaaatggcttactctatttttctttattatttccaaaaagtttgaggtgatttggagaaagaaggagaacagacagttggaaaaaggtgctttacacagagatccatgattaatttgcctaacaagaaccatcaggcaatgctaccaagaaatatgtctaatggctcaaatgttacaatcaaatagaactggtcactagattaatggaaccagtcac

SEQ ID NO: 57706 - DNA, 1026 bp, Homo sapiens
aattgtattcctttctgaagcttggaatcaagggaaaaaaagaacaataatgatttagggaaaaataatagttttttaaaggtagatttatagttagtaactttatataggtgaactgatcacagagaagggtgtaaatcatctgaataaacaatggattttcacacttactagaatctctaagaataatattttccatattacagctaaatgagacccattatgtatgctttcagataaactcacaaagctcttacccatgtaaatctcatagatctgccattattcgtaatgaataacaagttttatcatgcattttcattaaaaatgcattaatccctttgtagtaacctctccctaattcattgattcgataatacaagaacagtaaacatttctggcataacaaaaatgtggtatcaaagcatactgtatccataaatacaaaatgtaacaggaaaacaaatacatttatcaaaggaggatcaggttttccagccactaaataatgctatggtcgaatactgctacagtctaatacattaagaactcaatcatagtgccgcattgtgagccgtttgtaccggatctgattcttccagattaaatgacttgttgaaacttgaagatgaaagacaggcagaagtatccggggctctaccctcaggaggctccagggtgggttactgccagtgggggactaatgcttccgtctagtggagataggaggaggaggatcagaagtgacatgtatgtacccttttttacttgtagattatttacttagctcgttttaggctctgtgtcctcatctgtaaaacatggcattacctctttcaggtattttactggggattaaatgacttaacacaaattaagtccttggtagatagtatatattcaagaaaagtcaatttcctccttcctttattgatgcttaaaagcccctggtgctgtatttgattgattcaacaaatacttgggcttggcacaaggcactggctatacagttacttccctcttatc

SEQ ID NO: 57707 - DNA, 1402 bp, Homo sapiens
aatgagttggctgaattaccttattgtttgacatgagtcaaccagcccactccagcaaaacagccaaccaactcagtcactctgtagaagcagcgtgtcattgaacaaccaaacacacagtacatcgtgcacagcataacgatgcttcataaatgatggactgcatatatgatggtggtcccaacatattataataatgtatttttactgcccattttctagtaacacaaatacttaccattataagtattgcagtgtagaatagtaacatgctgtacaggtttgtagcccaggagcgatagactattccatatagcctaggttcatggtaggtgctaccatctaggtttgtgtaggttcactctctgctgttcacacaaggatgaaatcacctaatgatgcatttctcagaacatgtccccatcattaagcgaagcatgacctgcatgcatgagtaattatgtgtgtgagaagccatgagaatacctctagaaacacaattcttctttctctgaaaaatgctttccctcaaagaacagtgcatgctcatggaaaatgtaaacgatttctttctataaatatcaaacccattttctctgtgattcatatttcaaataaaacacacacaagatcaacacttaaattgggtattatttctttttttaaaataaacctttgtcagaatattatttcttctttttttctttttattgccactcctcctctccagaatattattcctactgtgtgaaatccaaaggcaatgggaagggatacagttctgtctctctcccttcttacaagggagacaaaagaactcccttcgtcactcacctctgttagaaatgcattcctttaatacaaagagtatttctcccattttatgatgagaataattgggaaaaagaaattcaatactttatctttcacttctcagccacctttggggaacttatattttgtatatcaggatggctgtgctatgcataacttcttacagatcttgatatgctatctttcatcattatattcagatataaacccaatagttgtagagattactaacagtgagtaaaggaaaggctatctagaaatatggaagacataaagggattgtcttgggactgacctacagagtccttgcctcatggggacagattcaacagggcaatgctgacgtcttaggaagggagtgtgtaggcggtgtgtatgttgggtgggaatgggaaaggcagtatagtatcatagcctgcatattcttctcctttaatctagaataggaagaatatgaaagtagaggtaataagaaatatgccataagacacaccctcttcagacagtgcaaaagagctaggtgtggttttgctaaaaatctagctaatgtgattctgatttcaaaatc

SEQ ID NO: 57708 - DNA, 1013 bp, Homo sapiens
aaataacttacagaaaaaaataggaagattgttctttactcttatatgaaagaggcatagtgaaagagcactgggcttggattcagaacacctggattcccatcctgtttctggcacctgagtagccttatataaaccacagcccacctagcctgagtttcctcttctataaaatgatgtagttgaacgaaatgtagctatcagatactttcagcattgattcagcaaatattaattaagcacctgcggtgagcctagtaccagggtgtgattcagcatgtaacaggatgggggtgtccccagtccaggtaatgaaagggtagaccattcacagtgtcaaagacagaaaactagataggacctattactcttagcatgctatgtttagggcactggcataaatatttcccactaaatattctacactatctagaaatttttaacaaagcaaaaattgttgtttacctagacttaatctttctgtagtttagggccaaacttcgactgttggagctccatcttcaattgctactactttctatgaatccatttctgggaatctctgaaggcatagactgactgtacacttagcactgtgacattaaggggacatttaaattgtgtgaagggacaagtcctctacttgtccctggggaactgagcagaggaattctcccaggagcctttgtacccagagaattcccatcactgaacagtccttagggacctctcctttacctctgccctaatttcggttgtacttttggtgagtaatatttaggccactcgaattcttttctcctttctttggccaactgcctgatggaagcagccagccaaaaaggacccaaggacattttagcctctataagcctttttttttttttcctggctttgtaaagcaacctatgaaggaagaagttgcattaaatgacctcaagggagccacggagcatgccctctggaatatccctcaccttctccctttcttcttaatcctactatgccaagga

SEQ ID NO: 57709 - DNA, 1052 bp, Homo sapiens
gttgtgaatgctcactgttggaccctaggttacagagtggtttctttagcggttcctgaagtctaggcctctgacttcctgtactgagtgactctggattgagctgttcaagaagcagaggaccagcctgttttgctttctgtctaccccttctgctgacagctatcatgttcatttcccaactgctgtgctattcgttcactttacacctaaacatgtgaacgttgggcaggaccgaggaggccctgcttccatggagattaaggatgtcagcagaatgacagccactaaactccacccctacctctgctttacttccaattttacttccctttactcccattcccaatttatgaagttcccaaaatctggccccaagacaatgaaagcttattttgtacaatttaattttcagtctatatgcactcaagttttgaaccgcttactctaagaattttgcacaatccaaatccattaatgcaggttaacatattacaaaaggttacatgaatataggaatgatagtatgggatggagttgatcagggaagacttcctgaaggaggcgccttttagaatggtttctcaatgcattgatggatattttaggtaaggtataatgctatatgccttgttgctaggaccatgaactcttcagatattggctctgctgcttatttgctgtgtgacatttggaaagttacttaacttttctacctcagtttcctcattggtaaaatgaggattataataagttctgcttcattgagttgttgtgaagattaaatgagttcatgcatgtaaaactctttttttttttttttttttgagttggagtctcactctgtcacccaggctggagtgcaatggagtggtctcggctcactgcaacctctgcttcccaggttcaagcaattctcctgcctcagcctcccaagtagctgggattacaggcacatgccaccacgctgggctaattttttgtatttttggtagagaggggatttcaccatgttggccaggccggtctcaaactcctgacctgatccaccc

SEQ ID NO: 57710 - DNA, 1051 bp, Homo sapiens
atatctgtgtactatttcagcttcactttaatgtactgtattcacttttagatacataagcataggcaatctggggtcattctaatggagcctactcaggacaacctgaggcacctggacctaactctaatagctctattaatgttaggtagaccagtttaatggagtgcattctcctagcagttcattgattataaatacttagcttaagtacctacgtgtgtcctaaaaaaactatttgtccgaatgaaaatcctgattttcaggagcagtgatatgaattctgggcacctgtgcttcagtgaccatgggtggagactttcttgtttatatgtagtcctcttatgttgaaaattacacaaaaacaaaaaagtagtgaataacagtgtcattttttgttttttttgtttgtttgtttctatttcttttgcaggttgatgaccaaatgaagctgcttcagaactgctggagtgagctcttaatcctcgaccacatttaccgacaagtggtacatggaaaggaaggatccatcttcctggttactgggcaacaagtgagtgtagagaccaaaaaaaaaaaaaaagcatctttttattaagcatgttcagaatggccggaatttaactaggtcagaagcactcttgtgctttgaaagggagagattggctgccaataatttagaaaagatgacttggtgcactctgttcctgctctgattattatagttaaacttgtaaaagcaaacataatcatgaacattctgctgcttccagtctgctgggactgaaagtcctgcttacaagggtccgaagaactggtaaatgaaacgtaatgattagtacccaggttttctttttcctcgagcttctgctttaacccaagacacttgtttgtcagctgttttaaaaccttataacttgtggagtccttactattttggaaaaatattggtgaacgagatggatttggatgtcatgaataattgaaatagttggtataaaggcaaatgagaagggaggggaatttcagttttcaagatccagtcattcaa

SEQ ID NO: 57711 - DNA, 1042 bp, Homo sapiens
gaaatgaagggctgtctccacatcatttgctgtattattaataaatcaaaatttcccaatcaaattaaaagcaagcactatttcagagtttttgcaaattgggtcaattcaagcatctccatcactatctggtccttgctatctgcacctctcaggagaaaagcgttgcagaggagaaaataaagtctcaatgggtttgacttcctgtgctttcaaattttttttggcattttcattctgggacccaagtctttggagaaaatgtacccattttcagagtctaatcattgggtgtgcctcccaccttcaccgaactaggagctgcattggaagtacaagactgggcccactaattaatttgatttcatttccttctgagtttcagaaatgaaatgggtttgtgccgttctttttctcaaagcacttccattcctgctctttagaaatatttcttatttcacatttcattttgccttaagtgctgcccgtgggtgagggtaattactatttaaaaaatagagaaaagtgcatttcttgctgtctgattttcaaaaccaagaacaatcaaggaatggatggtattatagttttttggatcaattactggtgctttgtgttttgtcatcagaactgaatgaggaactccatggtggagaaatagttatttccttatatgtttcctgcagcctggattcttccagctcccctccccactctttaaatatgtttcctgcagcctggattcttccagctcccctccccaccctttaaagtgtgccacaggtctgtcagaacccctcccttcacttttttcatccagtccagtggctaccctagtaatgattaattgtaatcagacattctcatttatggcaattatggtagacatgtttattttcttttgcggaatatctagacaaaacgttttgaatttatctctgtgcttcttgcgtttcataggatggaagcaaaagtgctgcaaaggaagacttcaaaagcctgtaacctctctatcagaatgagacagatatcttaaagcagg

SEQ ID NO: 57712 - DNA, 1030 bp, Homo sapiens
tgcctgagagctctccagtaaaaaaaggatgggagcgtcaggtaccaactgggctttcccattatgctgtaatcgcagcagcaaagccagtgctatcactgacagccatcccaacatcttaacttgttataaattgaacttcttatgtccccatgaataatctaagattggtgcctagcaacacttttttttttgagacggagtctggcttcttcccccaggctggagtgcaatggcacgatcttggctcactgcaacctccgcctcccaggttcaagcaattctcctgcctcagcctccccagtagctgggattacaggcacatgccaccacgcccagccaatttttgtatttttagtagagatggggtttggccttgaactcctggcctcaagcgatccgcccacctcggcctcccaaagtgctgggattacaggcatgagccaccgtgcccggccagcacttttttttttttaatgaaaagggaaataagccttttctttttttgcttccagacaacggaattattctcctaaataaagttattgctgtctttagagagaaacacattaatctgatgtaatctaatgtaatcatctgagaatagcagttttatgtcatgctttttaggaaacagaaaactaaagaataatttatttgtatttattttaaatttttaaattaacacttctgctgttctataaagaataatttaaatgtgattctttcatcatccacaaacatccaatcttgaactatgattactttaaaatgtagtctcataatacaagtagaaatatatctgcctttattttcctcatgcactagttaatattgtatatacatagaacactctcctggattcacttttcatggacagtatgtttttctttcaccttattcatgagagttaaaattttttatcttatgtgatgatgtaatttcataatataaaaaaggcatatatacttgaaaaatttaggtagccaaaacctctttcctacaaagcttatcaaaagtgattatattt

SEQ ID NO: 57713 - DNA, 1094 bp, Homo sapiens
tcactccagcctgggcaacggattaagatcctgtcttagaaaattaaaaaataaaaataaacaaatagtttgaaacttaaagcgaagcctttaccgaagcaactcgtgataggtaataggaggtggtttagctaaaagccgtattcaaatacaggttatttttcagagaccactttttccaaagaactctctaataaataactcctcaaaattaaattatttctgttatcagtttgcattctcccagtttatgagaggagatgtttattcataagctctttgggaaagctaacgtgaagaaaaattagaaagaatattactgactaaaaccaggtggcaaatgcatttctgttccaagcaaatgcaagatgataggctttcagcccatgttaagtaatagtagttaagacaatgttgtacaattctttcttggcattgatacaatcctgtttccagcaaaatgaatggagaaaatgttatatttgttcatcatgatagctctttgcttcatactaaacttccaaattttgaatgtgacatttgattatacacatcccaggtaagttttgtcctcatggagacaaacaccccagggaagatgggttatggttgcctcagggaatgactcaactggcccagacagaaaagctactgcatgctaaatgtcctcaccagcctgtcacctgatcctcatctgcagagaagcaacgggcataattcaagaacaaaactgattgaagagttgcttgtttcatccacaggttcagttcaggcattctgtagtgtctagtcatgatttctttatcttaaaataattaagaacattatcttaaattataaaaggtcatctaagcaagtactataatgtctcagaataaacagtattgtttattaataaaaaatgtgacttgaacacaagttgaaagggattttcaaaatggatgggtaagaccttcagggcttgaaagaactttattttattatttattcttcttaattttagagacagggtcctgctctgttgcccaggctggagtgtagtggcatgatcataactttctgcagcttctaactcctaggctcaaatgatcctc

SEQ ID NO: 57714 - DNA, 1800 bp, Homo sapiens
aatactcagtatgttcgattataatagctacatcttattgtcctgtatgagcagagtacattatacctgttgtttctaatcttcataagcaagccttcgatgaaagtatcatttgccattcctgttttactgtctttccctaagatcagagaagtcaaacaactatacaaaattgctgagctagtaagtaatagaactgggatttgcacactttagtcatcaaagtctaggttttctccactattcactgctacttttctggttcattgattaagtatgtagatcagaaggcactataccagtgcttgtcatttatgatgaagctaacccattctaaatctgatccttctagatcctacttgaaagtacaagggctgagtaacaatcctgccttcttaaatgcttaataattccccctcatcaacatgccatggtttcagtcagagctgctttctattgatcggtttcaagaagtatcacagcttttatcaccacggtcagaagcactgctgaaattatagggtatttaatcccttatgctggcctacttactctaagcagattttcttttctttatcttttttttgagacagagcctcactctgttacccaggctggaatgcagtggtgtgatcctggctcactgcagcctcaacctccctggttcaagcagtccgccagcctcagccacccaaagtgctgggattacaggcatgagccactgtgcctggccagattttattttatttatttatttatttatttttgagacagagtcttgctctgttacctaggctggagtgtagtagcacaatctcggctctctgcaacctctgtctcccaggttcaagcagttctcctgcctcagcctcccgaatagctgatattacaggtgcacaccaccacacctggctaattttttttttttttttttttatgtttttggtagagacgaggtttcaccatgttggccaagctggtttcgaactcctgacctgaagtgatctgcccaccttggcctcccaaagtgctgggattacaggcgtgagccaccacacctggcccagattttacttttaatatgaagaaacatctgctgtctaaattcctatcctcttacaaatatttactgtgaacagaatttgataattgattgaaaatcattaccagattattagcctagattattagcagattctccctttcctaatattgccagcatcaaactcaatggagtgaaagaagaaggaatgaagattaaaacatgaatttgtgtacgtttttaagtattttaagaataccaaaataaaagtgtcatatgaatttcttagtatgtttctgatatagacaggatagagtttagtaattagcaatttcttctaattttttttaaaaaaagtttattgttgttacttgctacaagaaattatgggacaaattggataaccacatgtgctggcatttgtccaggacagcccatatcaaaagggattggggtccatgatactgtaacagtatcatttctaattataacttcaaggaaattcctctctcaaagaggtagctaagaaacttattcttgtcttacaaaagaatagggtttttaggatttaaaaacaggttgatgtgccatttttcctccaacttatgtattttagattctattttgattttcactgatccatggtatttcgttatataatgtaccccacagtttattgattcattctccgattggtggatatttattacaaacaatgttaaaagaacatttttctccatgtcttcctgtaatatatt

SEQ ID NO: 57715 - DNA, 1047 bp, Homo sapiens
aaccttctgtgtagacattcatagtctgaaaataaatacagatttatcttttgcttttctggattccatttctgatcttattttgttggttagacaatattgacttggtgtgataacaggtactcttgtcttatttcagtcttttataggaatcattctaaagtcaaatgacttgatatgaaaagtgttgtctattttagtagtcttctttttagtagaaaaaagagaagaagctattgatcttggagagagatccaacagctattttttctttgccttttatttcaacaaattattctcttatcttttgttattttattgttctggttctagcttcttcagttgacgattttattcatctaattttcagccatacattttcattgttcttttgttttgttttgttttgtttctcatttgatgaaagcatttagtattagaaagttgcctcttggcacagccatagttgtatttgtggaagttttgatattggagacagacattcaaggctgctgtgggtttatgcaagtcactgtacagaactctagggggcaccactcacactatagtatatatcaatgcatccctaagagttgtgtggtacacaacaccagtagccctgtctggtagccctacgtccagtgctaaatattttgtcatctcgattgtaatcgagatttatttcacaatgggttttaaaatttccaaacaaatggaggttttgattatctttttatttttggattataagatgatttcactatgaggttatgcatattactgaaactttcttttgatgtgatatttagttaattttaataaatatggcatatatgacacagtctcaattttagatgtcagtatttatttctttatatcattattgataaatttgttatatcttctgtgtagattatttcttttattattatcgtgtgcttcttattttctttctttcttttctttttatagagacaaggtctcactatgttgcccaggctggtctcaaactcctgagctcaagtgatcctctcgcctcagcctccc

SEQ ID NO: 57716 - DNA, 1032 bp, Homo sapiens
gagccgctctctgtatatgctgactgatacattaggcttgggataaatcatatctgacctttccttataatagcactgggtggacttcaaaggtggaagagatatttcttgttcaattaagtcatcattgcagaaagatgaaacagatgatactttataagccaggcactgtcctaccttgtggtaattcctattaaaacacatttaaaagattaggaaactgaaacttagagcaatttactaatttcaatgtcttatggccagtgcagtgttcacggatttaaaatcacttcaatgcaagtatcaataattctgctaaataatcaggagttgactataattaatctgcaaaaaccaaacaattttccccacttgaattaatgatttctgggtgtgaaagggaatggtcaccacatagtcttagtttccttccatgcaaaccttagaattgagcatagcacttacgaaaccaatatgatcagataataagatatcttactattatcactgtcttagcaaaatctgtcattacactgaaaaaaaaataggatagcttcttttgcaaatgtttcaagctccaaaagttcttagaataatctttcttgttattttctctgccacatggttacacaaatacaaaacaaattggaaatatggattttctgtctttcatatacaaatacatatccctgagcaattgaatgaattattaatttgttttgtccaaaaatggataagtatttggctttaatgatcttgttaggcaactagtttcccttcccttatagttctcaactccagagaccctctcttttcatttttcaagcaaataattcagaatcagtgttgatccactgcatgatttttcccccttcatttcaacctctgatcttactgagcagaattttaatagctaagggaaatgatgtaataataagtaacaagtatatctagctcttaaagagtagctttaatttaactctacaaactcataaaatattggatatttagaatgaatgtagatagtaacag

SEQ ID NO: 57717 - DNA, 1034 bp, Homo sapiens
tgcatactttttcatgaaaattaaaacatgaatcccatataaatagaaatttaaattctcagaacttggggatggaaagggaaagcatgtttaatgcaaagctatggcccaaatgtaaacactgaaatcgtcctgatttccattttctctggaatgtccctccaataaaaatcaagtcctattccatattaagtaatggatagtagctggcaacttgggagtctgaactcatctatagcaggagtctctaacaacagaaatatacaagtgaattgatattaaattatattaaaaaaaccaaaatctagacaaatgattacatgttctggagttcccagaaatacatgtttttgaaatttgctgtttggttctcatattaaatagcattgtcccacatctggattttagcaaaagacccccagctggaggaaaagagatggatatgagataaaaatttccaccagttcttctgtggcattttaggctggattgcaaaggctcctgcatttggcactctgtgcgttcctttgaaatttatataagcttcattttcatacaatttaaaaacaccagttaataaaccctatcattacaaattctgagttggaaatagtatgtaaacagacagaggcatccccaaccctttctctatagcctttaaattttgatgactggcgagagcattttgtgcttctcttagtatcaatctgttatcatctattctactttattcactcagggactaattaccaactttttatatgaagcagcattacgataagctcacagtggggtgctcagattttttccatccttattggaaagtaaacccttaggtcttcttgaatatattatagtactgacttttcagtcacacacaacattcaggctctctctgaagaggaagatactcttctctgcctccctggtagctgccataatggtgcagcctataaaccttgtcattcaacacactttttcagaaatgggtcctctgctgagccagggggctgggggctgtgaggctcacatgg

SEQ ID NO: 57718 - DNA, 1027 bp, Homo sapiens
tttaaatatacaagaaccgttctgtccgtttttcttctgaccgtgttggtatccatctgtgagttcaatccactccattacaatgtcttttatatggaatcctctggggctgtgaagcctttgattcacagtttgcaatacaaataccctgatacatcatttatttgctattaagtatttgattattatgcctttttaaattcaatatctttaaagcaagtttttaattagcgttacttggagcagttcagagtactttttttcttcctgttcttcttccccctccccactcccccaatctctttttgttttgaaagcagagctcctaggggttgtaacttatgctcttttggcatgcaacatttcaatgagaaggttattatagggcacatccccgttcaggtgcttgtagtagaggtattcttcagcctgcatactgatggcccggatttcgggtagtcgaagaagtagctgtccaaatttctctgtctgctgcgggtagttacacattgtgtagtccagcagggcggcattgacttgttcctggacaccttctaccagctggaagttttcaaggtttttgacatctgcattaaaaaaaaaaaaaaaaaaagcaacatttcaatagcatttcaattcctgtttactaaagcaatgtgttcaattaatggatgtattttccttttgacataaacatactttacatgctgctgaatattcagtaaaccccactcaccaaacttcctgggaaaaggatcacaaaagagctttagaagaatgtcttgttgaaattctgcatatacctcaaatcaattagacaccagtggattttgagcaaggtcaactcttttcatatcttacaaaaggaaaggattgaggattcctaaagtagagggatcttaatatattgccagcaaatgagtccctggagaaagacctatcttaacccagtatattacacaattcatataattctgtattaatttttctgacccaaggtgaaatctgtgtccagggtatgatgtag

SEQ ID NO: 57719 - DNA, 1028 bp, Homo sapiens
ctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaac

SEQ ID NO: 57720 - DNA, 1049 bp, Homo sapiens
ttcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaagtttttatgttgtcctcattctatcggatactaaagcttctaaataagagacttgactaggagtgaaatcaaaagaatcccacaggaatagatacttttccctttagataacttctagagtggttggctgtccttccatggatacctgaagcattaaattcaatctgagcatcatctctacatgtgaaacaaagtattttatatcatttactgttataatcaataagcagaaaaatcttaatagcatctcacttttttgtagagcttatgttgtcctgataactttcccaagtgctttcttaattcacttggtcctcagaacagatccaggaggtattattattctcatattaaagccccttgcac

SEQ ID NO: 57721 - DNA, 1035 bp, Homo sapiens
ccaatgcttcggtagcgcatttagactgaaaggccaggggaggcctcactgacctttaagctgagatatgaatggcaagaaacatccagccatatgaagacctggaggatgaaattttaggcaagaaagagccatgtctctcttttcctttttctttctttctctttttctttttttttttttgagatggagtctttctctgtctcccaggctggagtgcagtggtgcaatcttggctcactgcaacctctgccttccatgttcaagagattcttctgcctcagcctcccgagtagctgggactacaggtgcgtgccaccatgcccggctaatttttttatttttagtaaaggcagggtttcatcatattgtccaggctggtctcgaactcctgaccttaggtgatccacccacctcggcctcccaaagtgctgggatgacaggcgtgagcctccgcgccaggccagccatgtctctttaaggaatggagagaggacagggaactggaacatgctggatgacggggagcagaatttaatcgaggttcagctatttgtgtaggaataattccccactcctctcattgtatgtactaaaaattgagtacatcatgttcacttattccagaaaaatgtagtgagtgtgtctgctatgtgcccagcactgttaagtgctgagtgtatagtagtaagaaagatggagtacctgtccccaagaaacctcagcctggggagggggcttgagaaggaagcagacatttacgatgaagggtgatagatggtatgataaggaaaagcgcagtgggctgtaggaaaatcatctaccctcgtcaagcgctggactattgagagaggcttcctggggtaagcaaagcctaatttgagacttgaggtacaagtaataattggccagacaaaggatgaaaagacagcattttggtgaggaatcacctaagccagggtcaggatttgaatgagaacagagcttattatggggattgcatagtgccgtgtgaatggagtaaaggggtgggtt

SEQ ID NO: 57722 - DNA, 1798 bp, Homo sapiens
caacatgatcctcaaaggaaatgctcattggaataatgaaaacattctgggctgggtgcggtggctcactcctgtaatcccagcactttgggaggccaaggcaggcgggtcacctgaggtcaggagttcgagaccagcctggctaacatggcaaaaccctgtctcttctaaaagtacaaaaattagccaggtgtggtagcaggtgcctgttatcccagctactcgggaggataaggcaggagaattgcttgaacccagcaggcagagtttatagtgagctgagatggtgccactgcactccagcctggatgacagagcaagactctggtcccaaaataaataaataaataaataggatcctgaaatcagaattctgaagcatttcagatcttctgaaatcagaagatcccaggcatttcaggtgagggatattcagcctgtacctggaagagttggggaggaaatgaaacctgactgagtcagtaaaaattagtcatgtgagtgtgcacaatatggaataaaaatttctggcggaagaagcagcctgtacaaaagcgtgaaggtaagagtgcaatgtaaagaactaactatggtgcacgcgggagaagaggaagaaagggcttcagtcggcaaggcagggcttgaattgtgaaggctctttcagcaaaataaggagtccctgaaggattttaggtgatcagatgatgtgattagagaggggaaggttcgtagttaagaattaaaccatgtgggttcgaatcctatccctgcctgtcacattaaatgcttttgttttcctacttgtatacagggtataacactgactcgaagggctggtgtggggattagatgagttaatacatgtaaaatactttaatagtgcctggcacacatgttcaagaattctgttgttataactctggattggatggtgagaagctggggtggggaaatggattacccttttgtattaatccaggggagaaatgatgaggatattactaaggcaacggcaatgaggatgggaagagatggtaacaatggattagtgatgtagaaggtacaagcagcaggatctggtgatccactggacgtggtggggggtggcagggagaagatctactgcaagagaggaagggtcacagctggctcctaggattctggctagggtttctgggtgggtggtggtggtaatcaactgagatagagaatgtaggagcgggagcaggtttttgaagaaagacactgagctcagtttctctttgaagtgttggtgctttgtcacttagtatctggcatatgggattgaagcttaggaaaacggttcttgctggagatataaatttgaactcatcagctatgggtggcaattgaagccatatgcatcagagtactttggaccgcaagtaattgcagaaatacaacccaaaaaacagaagagatttatcagctcagaaaaattaaagggcaccagaggtaaggtggtggtcagtcttatttcacttggggctccagccttgcttttctgatgtcctctggcctctgcatgccttctctgtgttgccttctcctctgactgggggctgatggttccattagctccacgcctcatcaatgggtgcattcaacaatgccccccagaaaagagaccatattttgaaatgtctctcttaaaagaacaatgcacagaagccttttccaggacactgaccatgggtcccatgcccatttctgaatcaatttactgggtcaacagatcactgcggttcctgaacctgtcactggcaaagaagacaaa

SEQ ID NO: 57723 - DNA, 2077 bp, Homo sapiens
caaaactttgttttatgcacaaaagtattaaaaatattgtataaaattaccttcaggctatctgtataaagtgtatgtgaaatataaatgaattttgtgtttagacttgggtcccatccccaagatatctcattatgtatatgaaatattccaaaatccaaaagaatccgaaatcctacaacacctcttgtcccaaatatttcacataagggatactcaacttggacatcatctagtttctatgttttctgtagtgaggtaaaattgcatttattaaatcatttttaaatgatgtagtaaaaaaaaaaaaaaaagaagtcagaaatataattgtatctcaagcgatcccagctccatcatgcctcatctgtgtttcaccaagcagcagcaacagcagtgggttcgaagagctccagaagtgcaaatttagcatttcgcagatgttccaataaagccaaactggctggtaagtgagtcagggcagatttttaagccctttctttgctctgcagggcgccaactgtgcttgtgtaatctttatacaaagtaatgttgatctgtttcgttctctttttgcagtggcatttttcacttgaatgattctgcttcgtgcaacatcaggataagcacgcggaggcttctttgcattagaaagtaaacatacgtatgcacaattgcacaccacacagtggttcgtgcgggtggaggagattgtgcttttaaggaataatctctcctcttcagaaaactaaccgctttatatgtttatcgggcagattttctttggtggtgttttaatggcttgtttgtcagacatgttgcatattaaacaagcaaagcctggcttctcttaggatccaaggtcctctttattctctcctccatattggaaatcattcctgtcagctcgtgctctccaagctgcctggaagaactttggcatagttttcctaacctttcaaacagtaaaagcaaaactctcctttgataaaaaagccggaggactttggcatgtagccataaaggatgcaggcgactcggctgcgatctgacagaataatccacaaaacactgaaaagttctcgttaaggtccccagagtgggctgaggcactttgcttgtacttaacatatatcaactgtcacccggcggcagtcagtgttgaactgaacacaatggaacatccagatggtctaaacaaagcgaacaaatgttcactgctattaaaagctgtttacatcaacttccaggatttcatgtagtgaagtttatattgtgtcactactgaggtgcttagctctgtctgcattgaagagcggccttttaaaaactcctgttgcttatatgctcatgctctcagcacctagtggaaagtgaagttgaatagtaagttaggaaattgcataatgtcaactagtcatgcaatttcagacattttaagtgatttgcccccattctgttatattggtcatctattgcagcctcagctccagacccaataaacacaaagcagaccctcttctctgatgggggtgtgtcatggatggatggatgggtgggtgaccgctatctgcttctgcagacagggcctctgagtctcgttggctcctcactggggatgtttacgcagtaatggttttgttttcttcctctaagatgctgcgatatcagatcctgtcttattggggattaatatacatgagcgataaacccacactttttctgtcttcttcctttgacctctttatggcatctcttttacaaattccagacacactgcctacattgttaaagatttgttgttgccattaataacaatactcatataaaaggtgtccagcttatttatggttaaagaagaatctacaaaaactgtccctctttattaatcactaccaattcctcttggcataacatagctaaacgaataagtaaatactaaaagaatactatttattaatttgctctacaaatcatagtataacaaaatagaccctcatacatgcaagctcattaattaaaataattattttctatataaacatcattttaactcaattttatgttacatttgtgt

SEQ ID NO: 57724 - DNA, 1786 bp, Homo sapiens
tttcggaatggaaatgactacgaatatcccaccacatgttgctgtttaatgcaatatgtggttagatattgatctcccgaatcaagtcattaaaatgtgcagtttttgtttattggaatgaagcaattaaatggttcagttatgccagaccttaccttttctgatgaaaactattgatttcttgccacagctttataagcgacaatgtttttgattactcttgacaaacctccttggagtgttaattaaaatcgtaccagatgagcaggtgtgggagatcattagatcgcccggatcacacatctccacttcatattctgcagccttgcataatgaatagggcacaagaggggaaaaacaatatcttcatcagcagaattagcatcttcactttttaaaaaactaggtgacattacattttatagtacagatgctgttgaatcattggctcattcctaccactacatttgatcaaaatttgctttttatgttttgctttaattttttgagtatctaatgagttgctgttgttggttctgaggtagaaaatatttaaacacttatttacacagaaaattgaggaatcaaataaagctctttcactgcttatgcagatgaagtcatgaatattaatgtggttcatttaacacttaaaaaaatcccctcagtaagatagcctcgatgtgatttttaaaaatcttttactacttatttttgggacctgtataaaatatgattatttagaaatatgctctcttgaagactgcagtctgttgatttacaatagaactttttttgtggctattaaaagattgttacatttgaaaaatcaaaaatacttaaatgataatttataaaatcagaagcaaatgatattcagtttttgagaaatgaataatctttacattgatgccatttattatggaagatgatttaattattacttcattaatatgggcattgaaatggactttttttcgtttttgtataatgcaaggaatttagctaattggaattagatttaaaatcctctgtgaactggtgtctatagatagaaagacagcttgtatttctcagaatcataggacctgaagagaactttaagaggtcatctaatccaatcccctgctgccaaagtagctgtttaaaaatgcactatttttcattagtctggaattttaaaaaggattaatgaatttataaatgtattatttacaatgttctgatcatgtacgtctaactggagctgttagattttgaaataataagttgtatgtgtgtgttttaaaatattgacttcttctagtagaatgatttatggtttacaaagtgtttttccatttatattctttcatttgattaataaccaagttttacatctcaggaaatgtcttataattttttaaatgaaactctggctcagtttacccaactgacttagaaatatttatataatcaaattatttgatgttacattgttgtttcatagctgctattatggatagcttctagaaagcataaataaaccctaaattgttatttctatcttataggtgaatgttatttatgttttgtaggtgaaatataaagttcagatagagcttcaatccaattttctagtactaaaatctcatttcctatttctaacaagtcccacaaatactaattgtgctctaccaaccacttaagcaaaatattacaaataatatacatataactttgtagaatctcagaattctaatcttagaaactatatgtgctttgtatttctgcataacaagccacc

SEQ ID NO: 57725 - DNA, 1028 bp, Homo sapiens
attggtaggaataattagaatagtcatgcatttctttgtagaactcttaatgtgttttcattatgtgacgctgccctggatccccactggggtgttacataatgtatgttatttgcaccctattatcttgctaaaattggaaaaatctgaagcatatttcgttctaagcattttgggtaattattgtggacatgtagttgaatataacttatagatgaaaaaataggcatatgttgtgggtgcaagctcaagggttttttgtttgttttgttttgtttttttttttttttttactaacacggcgtgtgaatcttggagcccactgcaccagaccatggtgactctgacgttaacctcatcaggacccaggcctcctaactcatccagcaggccaggccaggcagtgactcttactgagcgccctttgcttacccaccttgcttaaagacaggtgggagaaggacagatgcgctgtgcaaaccaaagacaaaaagaataaaaggttctatatatcttcgttggaagagtctcatagcctagagcctgacaagacatttcttaggatggagaactcatggctgaattctagaaattaaggtctattttctacccatgcaaaatattgtgatatttttggacaattaatggaagcaattgtttatattttgaatgagagacagaaagagacagagagagagagagaacaagaatataggtttgtaaattatgaattaagtagaaatttccagtttcttaactctcatgatgtaatgatgaaatcatagtaacaagaggaattgaatgatttaaaggaatgtgaacaattggtacagtatctcgaaaatttttttttttttttttttttttgagatggagtcttgctctgttgcccaggctggagtgcagtggtgcaatctcggctcagggttcacaacattctcctgcctcagcctcctgagtagccaggactacaagcgcccgccaccacgcccagctaatttttttgtattttttttttagtagagaca

SEQ ID NO: 57726 - DNA, 1061 bp, Homo sapiens
aattgatattgttttcagaaaaaattcaacggtaaaaaattcaatagtatttctttgcagtgaaaattatcttatattagaattagcagctgtttagaagtagacagcagaagaatccagcaaaaatagcagacaccatgacttgtaaaatattcctaattttggccaggtgcagtggctcacacctgtaatcccagcactttgggaggctgaggcgggcggatcatgaggtcaggggttcgagaccagcctggccaatatggtgaaaccctgtctctaataaaaatacaaaaattagccgggcgtggtggcgggcacctgtaattcccactactcaggaggctgaggcagaagaattgcttgaacttgggaggtggaggttgcagtgagccgagattgtgccactgaactccagcctgggcaacagagcaagactctatctcaaaaaaaaaaaaaaaaaaaaaaagaaagaaagaaaatcctaattttaaaattgatttgttaaaaatgagtcaaaatcttatttttataggacaaacaggagaaagcaatcccttatttagttggtaattttagatatcatccaactatgaatttcatgtattcattccatggatatttttggctacctactgtgtaccaggggactgaggatagagtggggactgcatcagacttgtggtctttgccttcatgagtgtatgggaactagaggaagacagattaaaaaaaaaaaagtatgatgactattaagccaggagaagcagaggacatagtaggagaaggtcctggaagccttcaaaacataataaaaattactcataattctgttgttctaaccacacttaatttcttctctatctcttcttttttgcatttttttcctctttgcatgctcactgtttacactcttccagtcatggtgtaaggcttcctcggcattcattactgtggcttcattaccatggctaaataaatcccagctgttattcaccctggagcatgttacagagttgccaaagcgagaagcatctcccgtgtacatcaattttcagtggtgg

SEQ ID NO: 57727 - DNA, 1740 bp, Homo sapiens
aagcagttctcctgcctcagcctcccaagtagctgggactacaggcatgtgccaccatgcccagctaattttttgtatttttttagtagagatggggtttcaccatgttagccaggatggtctcaatctcctgacttcgtgatctgcctgcctcggcctcccaaagttgtgggattacaggcgtgagccaccgcacccggcctggtttgtaatttttaaagacagggtagggcactaagtgggagacagttagatacaaattggaagtggtgagggcatgtgccatatggatgtctggggaagaagctctgcagaggccctgagatgggtgtgtgcctggtgagttcacagaccagccaggaagtcagtgtggctggagtggagtgaatgatgggcagagtaatgggtgtgaggtcaaagcagttgtggggaggggaatatcaggttcagggaccttataggtcatggggcactctgagtgaagtgcagagaagagttatgacctgacttcacatttgtggaggcccattctgacgctatgctaagaatgcagctaaggggtcagagattgaagcagagtaccctgttaggaggttattggaagaatccaggtgagaaagggcagtggtttggatcagagggttggccagggaggcgtgagaaaggaaatggtaccgtggtactgcaattattacctaaaatcctatttcttttcaaagtggtgctacttgttgatggcatagggtggctccgatgttactgaaaatcatacccaaagaagatgatccatttcgctagtactgattgatcaataaaggattctttataccttagggttaaattacttgtttgttgaaacctctgcagctaaaggctccctctttggaaaatgttagttatttgagggcctgaaattgcacaatcagtttttgacttgccctgtcccttcgaacgagagagaaatacaaatgtagttacttgtgtatgcagttgtggtacctggtgttggaagctgtatgggggaggctgagaatgttgatcataactcactggctttgtaattaaactctctttttattaaagctgaaattcttaaaggcccctgcctgtgtgggactggaaattatttatcatagaaattgtctgctttgctataaaaatgttgatatattattctgttcataagatgtagacactgttttttaaaaaatatctctagctgtagatgtgcagacatcatatgaactttcttactaatgtcacatttattgagctctgtatgtgtgtgtgagactaatgtctcaacctttcttttaaaatttttgcttatttgttacaatgttggctgtggccttgtaaaaaaataaataaaataaaatgtttaagtatctgaagcaccgagtggatgtttcaaactcacaagagcggttagggatcaaaaagaagtatacaatataacatatccctttgccaagtccagtccatttcattccgtgtccctagcactccagtgaaggtagcagccatcagttaaataaacaagcatttctactgatggcagcagcctcagtatgcttacatccaccatgttactctctactgagggacttttgctgatagagccttagttgagattatctagagagttttttcttctatgtggagccaattaccatgtaacacatatgaaactacaacaaacagacattgaaatatattaaaaaagatttattttaaata

SEQ ID NO: 57728 - DNA, 1486 bp, Homo sapiens
gtaaagtatttctcttgagtttttttagaatatgaagaatatatatatatattcttcatatatatatgaagaatatatatatatatatgaagaatatatatatatatatatatatatatatatatatatatatataaaagagttttttttttctcatggttctgtgagctgagaagttcaagggcatggtgccagcttctggtgaggtctcacatgctgcgtcatgatgtggtggtggaggtcatgggagaagcagacatgtatgaagatggaaaaacctgacagacacccttgtttccctgagttctgtgagctgtcctagtaaattaatccaatgtgaggaaggggtcttgggaatcctcaagttctgctgattggtcagaagtacaggtaatacaacacagggcttgcaactggcatctggagagggagacagccttgtggaactgagctcctaaccagtaggagctcttaaccaggtaaagagtgtcagagttgagttaaattgtaggacactcagttagtgtcttctggagaattgcttgatgtgtggggaaaaccccacatacgttttggttatcagaggtgaaatatcttgtgttgagtgtatgagagtgggaaaaacagtttggtttttcttatctcttacacaagaggcacattaggagagccttgtgccttatgaatatgaagagtccctaaactgagtggaagaagtggttaaagaaggcaatcagggaggtgaggagttcatcctggataacagattgacaggacaaaggacgtgaggaagggtgttctatctatggaggaggtgaatggctcagagtcccacatggcacagaacaacatcaatggtgctgtcaggaatggacagccctgaagaggagaggctggttgggagaagcactgatttcatgttctaaggtgtgcaaacataagttaccctgtgtatgggcttcaaagagggtgtgacaagaggaaagaggtggtgccaggacctggcaggcccagtcctcacactttctgctgactattggggtaatgcctgctggagtcagaaagaaacctggagtgtctagggttccaaatcctggacaggttttagaaggattggtaggtcagattgccctttcacctctacatccatgttttcctgtggaagagctggtccggccctgggcagactggctcccatcccagtgaggtgagctccccgtgacctggaagacatgcttaacaggagagtctctgacctaattaagaggattttaatttaaatctgagtcttgaactgtttagtatgtaagaagaggcgttccaagatagaaaaaaacagtaaatggaagaggcacgcatttttcaagagaaaagtctgctgtaggggccattgccaagacaatacttatgttctcagatgtctgtgtgttaattgcatttttaaataggcttcaccttccagttttaaaataatacacattcacta

SEQ ID NO: 57729 - DNA, 1835 bp, Homo sapiens
ctttgaatcccagtcccaccatgagtacgaggaatgcatttaatctacctggcccttcgtttccttatctggtcagtgagtaaactattgcctccaaagtttacattgagaatcaaataagatttttgtaaggtgcttgacacagattttcaacaaatgcaagtcccctcattcctgtgatctcctttttcttgtgccctgtttgctcataacagttttccaaaatcgagtctattgagagtttgaaaaagcaggaattacgtgttttctatttgatgctttatatttatttatttatttatttatttatagagataggggtcttctgtgttgttcgggctggcctcaaactcctgggctgaagtgaccctcctgcctcaacccctgtagtaggtgggactacaggtgtgagccaccccacctggcttggtgctttatttttaagcacgttaacctttcagtagtatttaaaaagcaccttacccactgtgctgctattatatacaggcatctggagactgataggttaagtgaactgggggctcactatggaatattgtgcagtggttagaaccaacatattaggtctgcaaattataacatggatagatattaaaagcatagtacatagtgaagaaataaaaaatacaaagtggcatttaacttaataccatttatataggtaaaaaatttatgcaccctcctggaaatctaccctatagatgtaaaagccccagtatttatggattcacgtgcataaatatgcagctttatttgtagtgataaaaaaccgtgtgcaacctaaatgcccgtcagtagagggatggttgggtgaactgctgaacatccatctatcccatgaattactagacagctattaaaaaagaatgccagagatccggatctactgccctggaaggatgatcatgacatattcttagatgagaatagcaagccacagagctatggattacgaatccagttcattaaaccaaatctctctcctctctctctctctctctctcactttctctctctctgtctctctctctctctctctctctctctctctctctcacacacacacacatttctgtaactaccagtttaaaggattgagtgatcctgaagacgtgtggagagatagaccctgcccatgctgttagcagtggtcacctgctgggggtgcagggagataagaaaaaaagtctatcaaagactaaagaaaagaaaagctcattatagaaatgttaaaaatcaggacacaaatattctatcatggatattacttacaatgcgtaaacaatgaaaacgcagatggacaaggacctgattgtaacaggaataaaagtaatacttgggtaagaggattatgagcaaaaggaaaaatacatgaacacaagacagagatatccagacaaacaaaataaacattaaacaccttaggatagcagcctatgtgtgggaggagagaggatgggagtgagtaggaagatcaaaaggaaatttaaaaaatattaaagagaaggcacgtgtacagcccagtgacattgaatggaggtgggagtatgatgaactcaacactctgcacctaaggttaaaaaaagtcaaataagaactttcccctagagtagcttatgtaaagaacaacaatactagaacttacatagagcaagatgtaccctcgactttagggtccacttttccacagagcgtaattcaaggatgactgcggtgagccacgtccccagaggtagagtaactaaaatttagcaagagtctgagtaaggactagtaagtgtcattattattccatgcatgggaattcccagatc

SEQ ID NO: 57730 - DNA, 1068 bp, Homo sapiens
ttgtggctttacttacaggtagtttcaagttgatgaattttttcacagtcgtgtcttcctgttcacagtaagagttaggcagagaatatagatgagcatgcaagtttctcatttttcctgatgaacacacacatgatgaggactctactgaggctgctacaataggacgtaatacatgaggaagagaaagcccagaacaattgacatgcttttctaggcaattgagtggtaatccaggattatgatttctaaatgtctgctcagtgcttgcaatcacattcttgacagtagtggcatgtaacattgttaaagcaaacgtctaggaaggcttaatgcatgtgctttgtcatcagaattaaacccaaatttcttaaactgacattcaagtccctttgtgctttggtctcaatttaccttcctagactttttctctgatgctccatcataggatgtatgctacagtctcatcaaaatgcaccattcaaggttctctaaaccctaagctttatgtttaaatagtgcaaagtgcatctactccttatccatctgttgaagtctcttccattctaaatgactcagctggagtattgattactttctttacaaagcatctgatgctttccacctactgtgatttctgtcttctgaatctggatagtgttttaattgttatggtgtgtttagtttactgtcttaaagttacttatttctttttttaatgctcattgaggataataatgattatttatctttctgttttctacagcaccttgtttcttaattaagggaggggaacaatgtatgctgtgttttttttttaaattatttatttatttatttcaataagggcttaaattcaggggtaagaatatgctgtttgaatgaatgaattcattgatttatttatttaggaattaaatttggaacacattgagttttctcttagtaaaatagcatgattccagtgtccttaattacattaaaatatgcacatttatctttactttgatatttctatttctattttttaaaaatatatgctataaacagaagcattgtgataccacg

SEQ ID NO: 57731 - DNA, 2256 bp, Homo sapiens
gaagtgggaggattgtttgagcccaagagtttgaggctgcggtgagccctgatcatgttatcgcactgcagcctaggcgacagagcaagacctcgtttcaaaaaaaaaacaaaaaaaaaacacccaaaccccacaaaacccaaaaacaacacacacacacacacacacacacacacacatattatggagcaccctacatgtacatgtaccagatactgtgctagacacaagtgaatctgctctgattaaaatcaatcccagtgtcatagaactttaagttggaaaaacacacagttaagtaaataattaagcaaatcattccaggtgtgccaagtgctgtgcaggcaaagtacagagtgctatgggagcaagtagtagggaccacacctgttcttatgagagagtggccagggccagctttgacagacaagatggacaaggtggacagataggagttagccaggtaaagagagaggatgagttagcagaggaagtcgagtgtatggcagttgagatgtatgaagaactcaggagggggtcagatatggttgcaggtgagatattgcctgagaagctgctgagagatgagacgacagaagtcagatcaatcatggtcttacaggctctcttgaggagttagatcttcatgccaagagcaattggaagccactgaagactttgaaaccaacaatgaccagattcatattgtatgataagatttgtattataaaaattgtgattttggcagtggaatggagaatgggttggaaggggtcacgagtaaaggagactagttagcagcccatggttgctgaggtccaggtgagatatgaagggggcctggaccagggtggtgacactggatgaggaagacttaagagtcaagatataccatattaccttgatcctgaaatgtaagtatgtttcatgtttttatctctaaaatggggataaggcttagaattggtgatactgattctttcttagagatacgagtgacaatggtgcatctaacaatccgtggcctgttgttagatgaaatttggtgtttgggagacaaaagctgcaggacttgctggtgtcattgagctcaatgggtcgggggcttgagcagctgaatgaatggtagaactgcaggttctgacagagaaaaggctttatgggaacagttttagtctttagccctaaaaaaaaaaaacaaaaaaaaaaaacaaaaaaacatggcaggccgggtgcagtggctcatgcctgtaatcccagcacttcaggaggccgaggcaggcggatcacgaggtcaggagatcgagaccatcctggctaacacggtgaaaccccgtctctactaaaaatacaaaaaaattagccaggcgtggtggcacacatctgtagtcccagctacttgggaggctgaggcaggagaatcacttgaacccaggaggtggaggttgcggtgagccgagactgcaccactgcactccagcctgggtgacagagcgagactccatctcaaaaaacagaaacaaaaacaaaaacaaaaaaaccatggcaaaggccaaactagaaaagttattagttaatatgtgccagaagttgagttaccatttttttttttaagaggtggggtctcactatgcttcccaggctggtctcaaactcctgggctcaagcaaccctcttgcctcagctgaggctacaggctcatgcccctgctctcagcttgagttgccaattttaaaggttgtgaaataggatatctaggttttaattgttgatattaattgttgatactaaactgttgtgttcgttttatgaaatactgttttgttaattgctgaaattaaactggctttagggacaaatgaaccatctcccagtttgatctcttggtccttggtcggcagagctcacccttttaaggtggcatatttacattccctgccatcttttagcatccctttagcttcaattttcctgtctcttgaggacagaatagctttaaattgtaaatgactgacttcatggtgatactaaatatttgttgtgctggtgtcttcatggctcaaatgttctggaatgttctttttttctttttttaagataccgggtctcactatgttgtccagctggtctctgaacttctgggctcaaagcatcctccatcctcagcctctcgagtagctgagtttataggtaggggagccacctcacctggagtcctattttttactgcctcttgacaaagcaaccaagtttgac

SEQ ID NO: 57732 - DNA, 1049 bp, Homo sapiens
acaggaccactgaccccctcttgcattctctcaccatttagtgtctgctgtgagctgggcgctctgtagtgtgtctgtgcatatgtgcgtggatgggacagggatctagacattgtaaaaaagctgcattgtaaagaactcttgggctcaggcaatctgcccttcttggcctttcaatgtgctgggattactggcgtgaaccactgcgcccagcctggaaaacctcttttaactacacattttattttctggtcactaaaaagtaacctaagaccaaaaaggcaacagacaaacctagaacacattataagaaaatgcattttataacttttttaaaatgcatttaggacaacaaattggtgaaaatataaggaagcactgaaaacaatgcatattttcaggcgcaatttaaaataaggatctcattaagattcatgtcccaagaacatttttatttctaaaataggcttggttcagctgaggctttttatgtataatttaacaacggaaaccataacaacaataatgtatggataggaagagtttcttctcttgaatgaacaaattaggtcatcatcaagcagttttatttaatgggaatcccccgtgaggtattcacatagtgagaaatagttcttctccctttagagatgaacgctgaaaagaacattccactccatttcacacaagagtggaagggtgcagtgaaaattgggaacgtgttaattcctgacagtgatgctggagtgcgtccgccaatccagctgtcagcgctgttaggagcacggccgagcctgcagccactacgttctgtacttgtgctaggtccgagcgtttgaagaaaagatagcagtttctcccttgctccctgctccgtggttccagagcaggtctctgatttggagcttattaatagctttccataataagatcatcgataaaattctgagcacccagtgcatctacagtgtaagaattcttaccagtagggtgacagcacaaaggaaactgaggttctaattttgactccccacgggcgataggcatct

SEQ ID NO: 57733 - DNA, 1026 bp, Homo sapiens
aagtcaaacatccaactttaaaataattatagctgggcattgtggctatatcccagcactttgggaggccaaggcaggtgtatcacaaggtcaggggattgagaccatcctggctaacacggtgaaatcccgtctctactgaaaatacaaaaaattagtagagtgtggtggcacacgcctttagtcccagctactcgggaggctgaggcagaattgcttgaacccaggagccggaggctgcagtgaattgagatcatggcactgcactttagcgtgggcgacagcgagactctgtctcaaaaacaaacaaaacaatcactagatgggcttagatgagacagattttgcctattatttgtattcctttagaaagtttccataaaattcataattattaggtaacagaaagcatgtatgcacacacaacttcacagtttcaggctattctatgtgggagaagatgatagatatgaagggcctggtggcatttgacaaacagaagcaatgcaaattttgtgggtggaatacaatttgagaactatttgccagcttgttttggttcatttttcatagtccagttcaatctgtgaagttcccttgaaatgtaagataatctcctggggtgaaacaggaacaaagtgtttgcattatgagtccagcttctctcagataattagtaactttagaagggccatcagttgatcaattaattaatcaatcaattattacttatttggacatctatttattatctagttctctgctaagtgttgtgaggaatatgggagaaatttaatgcataatctcatacttgcatccatgttaccttctgtgccttcatatgtggggtagggagaaggaagtgtgctataggaagccatggataggcaggggtgtcaaacggcaattttttaggtgttttaacataaacacttctgccgggtgcagtggctcgcgcctgtaatcccagcactttgggaggctgaggcgggctgatatcttaaggccaggagttcgagaccagca

SEQ ID NO: 57734 - DNA, 1840 bp, Homo sapiens
ttgaaccgggaccccagaggcagaggttgcagtgagccaagatcacgccactgcactccagcctgggctacagagtgagactctgtctcaaaaaaaaaaaaaacacaaaaaacacacacacacacacaaaacagattctgggtcttaatatggctgatgacaataaaatgtctcaagatagatgtatttgtttaatggtatatattatgtgccattagtaattcttagtgatgaaattaagcctgtgcttaaatcttaaacaagtcaagcatccgtccttaaaacacttggaggcagctgacagctctgtgtaacctgtgctgcaaaaatattcataggaacacagaagacatttctataagctaaacaaataaacagaccacgtgcagcagacccaccgagttacttgatccaaaactcaactgccagaggatttaacatatcaacaatagaggtgtcaaaagcataatgtttctgttggaaataccacccagaattcccagagagcctttccaattgattaactttgaaacaaaatccaaacattcttggctgcagggaaaagtttatcggtttttttttcccccaacacactactaattttgaactaaaaatcatttgatgtcaaaatttttcttctgaataagatgctattggtatcttatattctaaccatcctcccagaatgtccagtttcttccattttacagaatttttgtcacaacacgaaaaatgaggttgctctgctgaatttgtagtatagaaagtgggacatggatgggcttcaagacgtccaaatttatctacaaaaaactattgtgtatgtgttttttttttctggagagaggattcaggctttcataatattctgcaggctgtgagctcctctttccccatttaagaagcattcatgggccctaacataaatacaataggaatataatttgcagcaagaattctcctttcctctccctgagatgtatttccttataaggccgagaggtggcagcataaacaccagcctgtagcagccccattttcctgacggtggaaaacttttaaaggtgaaatttatctatgtgagatcctgtcaataaccttgatttggcttggatagattgtggacataatgtcccatcaaactgccctaaaatattcgtagaggagtagcgtgagattgaatcagcagtcctggactttgaggtcacaaaaattgaaagacaacgttttgttagaagttgagcaccatggagagaaaagcacagagcttgattattggttgactcagaggcatttacatattccatatcaaatcaaatataatttcttgagtggcgattagtattttattttactacatagtatcattgtttaaatagtatataagttaccctaagagattacttattctgaataggaaaatacttttgtttcttggaaccaacagccaaaagatctctttcagttcttgtccttaggtgactgagaataacagaaaaaggaagttgttttgcacatgtagattctgtggatttttattttgataattaagtatcactttcatttcctgtgaaagtatgagaagcatggatgcagaggcatgctacaatttttatgcacactggatagtttttttcttctttaaacatgtctagccaattcaaatatgagaattttacgtagctggtcaggcacggtggctcacacctgtaatcccagtactttggggagttgaggtgggcagatcacttgaagtcaggagttagagaccagcctggccaacaagttgaaaccccatctctaataaaattacaaaaattagccaggcgtggtggtatat

SEQ ID NO: 57735 - DNA, 1163 bp, Homo sapiens
tgacctcaggtgatctgcccaccttggcctcccaaagtgctgggattacaggcgtgagacaccgtgcctggccccatctcagtctcttgagtaaccaggactataggtgtgtgttaccatgcctagtgaatttttgtagagaacagggtctcgccatgttgctgaggctggcctcaagtgatcctaccgcctcggcctcccaaagtgctgggatcacgggtgtgagctaccacgcccggcccattttattacttgtatagtaccactttgtgtttatgaacaaatgcatttaaaatcatcttttggaacaaactgtgtcactaaagaaacggctactctactgtgagtataactgcttctaaaataccgatttatagacagacttgaataagccatcattcattctttgtatgattaatttataaaatgcagagtttctattaatggaaaagcaaactcaagcatcacgtggataatatcaataatatgcatttgtaattacgtactgtagataactctagaagctacattttattatgttaataaaacgtaaaaactcctgaagcaacccagactgggcagcagcaacactattagggctcgctgcttcatcagttaggagtctgttcaattgttcttagctggtagtaacactcacagggcactgagaaaccttttttctcccataaaataatgatgatctactttccaagataaaatattgcatgttgatggaataatatgagagttatgagagtagcagcaaagataaaaatgaaacttaatgaggacaaaaaggaggatgggagaactgcttgttcctctaggcagaccaagtgaccaggttctgtcactgtacatgtaaaaaaattgtttattctgttaacatgcagcagatatttgggagaactcataaagagagtgctaattttatgaaagggaagtgtaaggggtttcaagtgttactgggctaataccttggtcacactgacaggcaaaaggaacagtgtgttggatgaactggaccaatcgatatctctttaggtatctgccaatcatgccattagagtggaagactgcatggattagttcaagcagtttctcagatgctccaacgactcagccagacacttttccctaggtaggaaatgggaagaatgact

SEQ ID NO: 57736 - DNA, 1585 bp, Homo sapiens
ctcctatgatattttaaaatgtacaaagggaaaaaaattaaaaattagaggaatattaaatatagctatgtttcttagctgaagtgtataccaaaagtgtgatggaggtcctgtaatatcaccccttaatttgttccgttacatggttttaaccttgactttgctaaataatctctttaaacaggacaatgaattactgtggtcattaggttggtgtcatttgtcatgatcggtgtaggcttgactcctgaatatagaaggttgttaaataactatataattatcaatgatccaggccaaatttacatgtgtgttttattcatgttttttttttttttttggtcaagtgtcaagctccaggaagggccctgaacatctcgagagggtgaaagagtgtgctacagacttttagaggactgggggtggccatgtcctaagaaacacgttcttggccagtggagatttctgagaagagatcaaggctaggcaaggaagggagtgtgcataagggtagggaaaggtagcagaattggaggtgagataaaattttggcatttgagaagagaagagagaagggaagtattggtagaaaattaacagtaattataacacagggaagggacttggaaggcattccattttgaagtaggtgaggggatagagttttcacagtggcattctgtatgtcagcctggggttcaagaaccaggtctgccagatcatagctgtgatacttttggcaaaccttcttagtgtcagagttttaatttgtaaaatggagataaaactgaggtggcttccctggaagtgaattcaataaactacttgaaagtgcctagcatggttgccaacacacagcaactatccaatcagtactggtggccttttctcccctcttcattctgaaatgaggatgtcaacctcttccttctttcagattttatgaacctgaagatgtccattctattcttgtgaaagggagtattctagaagtttttttcaccttcactaaaccaaaaattcttattctagtttcaattactccagttatttggtttaagaaatccagactagaacctagtgtcaatgaattttagagataatttgcattgtggttttgtaattaacattgattaatattacaagagaatatgggagatgagatgaataagtttctcacttgggctcttgtttatttattcatttatctatttgtttatgcatttggtcattctcgaaagattcaatttgatagaaaaagaaggtttcctgaagcaatatgttgcaataagatctttgctctcaagtaatttaaaatctagtaaagaagaaaaagatgcctacaaaaagtttaagcctggtggcaaaggaaaaagaatatggtcaggagggttatgcagaaacattgaagtgaccattgagaagttgccatctttgagacgcaggatggaggtgagcgttctgtgataggaatgaggaccaggagagctgtgaaggatgttccaattattgtggggagcactgtcctgagaggcaccctccagggcaagagtgccaatacatcatgccagcaacagatggagtt

SEQ ID NO: 57737 - DNA, 4845 bp, Homo sapiens
atgcttgtagttccagctactcagaaggctgaagtgggaggattgctcgagcctaggaggtcaacagtgtagtaagctgtgtccgtgccactgctctcctgcctgggtgacagagagagaccctgtctcaagaaaaatgtactcttttgcacaagttttagtgtacatttaacatttttcataaatttaaatatcagattttgaaaatcgataataaatctttaatatcttttgtttaaggattctcaaccaggagtgattttgctccccaggagacattaggcaaagtcttgtggtcacagctgtgtgtgtgtgtgtgtgtgtgtgtgtgcgcatctgcgtgcagagatcaaggatactggtcaagatcctataatgcactagacagcaaactataacacaaattatccagccccaaatgtcaacagtgctgaggctaagaaactgatttaaatgtgtccagaggaatatgaatatcatgggattttgcacttatcagggccaatttaaaaaatacataacctggggccgggcatggtggctcaagtctgtcttcccagaactttgggaggctgaggcgggtggatcacctgaggttgggagtttgagaccagcctgaccaacatggagaaaccccatctctattaaaaatacaaaattaaccgggtgtggtggtgcatgcctgtaatcccagctattcgggaggctgaggcagaagaattgcttgaacttgggaggccaaggttgcggtgacctgagatcgtgccattgcaccttagctggggcgatgagggcaaaactgtctcaaaaataaataaataaataaataaataagaataaaaataaaaaaataaaaaaattacacgactcttccatagcattgttcctttttttccttggaactgtatttccattctctttccctcatagaattttaccttgatgaaattcatccttatgcttgaaagcccttattaactaccacgtaattctctgctacaaaactaggtatataaattgaaatttcttttcaaatatcctataaggttctaaatgttaacatttttcctctgtattgaggtagcactggaaattgatcaaaacaccatatatatattacaacctatttgatacatttgatagatgagttttaaacacaaaaatcttttggttgaaatgcatctcttaacgggatgaattggggagggaatttcagggacctggtacataggctttgggtgaagtggaggtttatattttctcaggtggatcaattttagaaaaagattttgaaatgcatttccttaaaactatttgtgcccacgtaccctctggaaagtcttcgtgtacccacagagatactcacatatcagcctgatttggctctctttggtttctgagtaacttagcaacgcttttcttttaatgattcagacagttttgcatgcagctaatgcatgttaaagaaagctaagccagtgtatattataaatactttataagtcaagcaagtagaatttctcacaggagtcataattacagtggaggcggcataccattgtagtgagagttctggagtcaggcacagtatttgttcctgttcttcatcactactggctctttgacttggggcaaatgattacctgctctggtctgtagctttctcacctatgataaacaggggtcaataatagattcctcaactggttattgtaagattcaaatgagtcatgcatacaaagcacttagtacagtgagtgcccaacatatcctaagcactcaataaatactagctgttgttatctttagacattatagggtttatctcaagggatgggcactagaaaagcaatggaataggcatttcagtcctttttcttatatcatggctcttttttgcacaatttactgtacccaacttccctgatgttatggacagcagtgggtctttgatattcccattgatcatgagctctggaagcccaaggctgtaaggctgctgcaaggcacctgctcccaacagcaatgtgctctcattttctggtcagcctcacaaggacaaacgtaaactcttgaacacctgggagagtgagcctctgaatgcctgaagttatttttaatattctcagaatgctgtctgggagttgcatgatgtagatgaacggcactcatttgaggtctcctatagggtcacttggacaaaacatgtaaaggcatgacttcaagtaactggaccaaagtaccttaatccttgtatcgacaaccatcctattgggttacacagttttaatcccagaggagttgtctcttgacattaaactgtccaaacagtatttatatctgcggctgccctgcaagatcacttaaccctgcacagccgtttaaaagtagttaatgacagaaccggcatgacttgccccttatgaatgatcacataagttcgacctgtgctgtcatggtttatggaggaggcagtttgtccatagcctgcttcaaccacagcaggtaatttgaaatgaaatgagacagtttctacaagcagattgatttgggaatcttgcctgttcttccctttgacccttgacaagttgacactacaaagattgtgactttaaaaaatgattgggtgcaaatacatttaggtagatgatttactgtgtgctgaagcaaggacagtgcgtttagagcgatgctgtgagggaaggtaattgtaaactttaacaactcatgttttatgtttctgtatcttattaattatcctactaggtgaatccactgataatccttgatcaagtagtttatattcctggtaagagaccagagacccaatttcaggattaagagatatagcatttatgataaacttattaaaagttacagattcagttagttattttggccgtaaatcacagcttgtatataaggataagaagtcgcgatctctttcatggattctgttctttttctttttctttttcttttggttttcctaaatatagttgaacatatacaggagaaaaacattgtgattaaaaagataatcagcttgatttttgataaccaaagagttaccagggatatctgaaaaaaaaagaaattcccaactatgaattcacacatgttattttctaatttagattttcacaccaaataatatgtaataagtaaacacgtattttccatattatttctattctattcttctggtgcagtttttcttagaagtgaggttttgtcatgaattggtgctaccataagtagaattttaaaattgactgtcttccaaaacaaaaataaaaaagacagtaaggtaatttttaaaaaactgtttccttagttcacagtgatataatatttatgctgagattgttttaaatgaactctgtgatagaattgttgatttattaatatttggatttgggttgatgttccttttacatttgctgtaggaaatacccacgacatgaggtttgtaagcttttgtgtttttctctattctaaccactctgcttgaaatataatttgaagatgctagtaaaaaatataacaaattccctattggtctccgtttaaattatttactacccttttgagccatatcttcattgaactatgttaaaagtattttgctgtaatgtttctttatgttgtccatcgggtttaatagacgtgccatttaataagctctctacctgtaaggctagactatttgacctctatgccctgccactggtagacatagtataagattgctttgtgaaataaagctgtcggtaacatcaccaaaataaaaaatgatcgtattccaatactctctgctgagtactatgacagcactgaaatatggaataaaattgaaagtagattagttttgggttttaagtcatgttttgacaagaaataagagaggagaacatatctttgaacttttagttttaaagttttttaatgaaaatatttatcattttgtaaggttccttctttctttatcacatctaggctgtataaccttaaaacaattcgttctcttattgtgagggatataaatactcttctatctttatattaaatatcataaaggagacacgcacagtgagagacggcttgacacttacaagttaaaaattgtcacactaataaaaaagcttattgaagaggttggaaaatcagtcattaataagctatatatttttagggtatgtaaagcatgtaaatactgtagacaagcaggctgcttttgctgtattttttgctcactttttggaatggtttgaatctgaagaggaagaataaatatgtcagagtggagaaagccttgctggtgattgctttcaacctaaaggaatttgaaaattgctgcgacgtgcagattgtgaaattatttcttttgcctctgtggttacatattaatcagctgaaatcatgacaaataaatggcattgatggcccacagggagtgtgggttgagtacagtaacccttccctccaggagtttgcaaacatcctatgtcaccaaatgggagattgtggagctcttaaaaatgcagtgccttcttcccttcattgcatatgcggagtgattacacagggggcaggttaaaccacactccttgttcatctcagaatgaacttttctttcttcatattctttccctttaaaacacaggatacaaattctctgcacaggtcactgggctgcccttgctttctccagtgtgttcaggggccctcagcccataggggcaaagctcactgacgggagccttctaaccctggtgtcattttaaaaaattgaaattgaccccccaccccgctctccaccaataaatgtgaattacatgatag

SEQ ID NO: 57738 - DNA, 2029 bp, Homo sapiens
tcaagtgattctactgcctcagcctcccaagtagctgggactacaggcccagctaatttttgtatttttagtagagacggggtttcatcgtgttagccaggatggtctcaatctcctgacctcatgatccacccacctcagcctcccaaagtgctgggattacaggcatgagccaccgcacctggcgtttgaatctttacaatcataagctctagagataactactaggatttgaatattgactcttaccttgataattttatgtccttggacagagttactatgattaatttcatcatccataaattattatgctaaattgtgaggattaaatgagataatatatgtgatatgactagcacagtcctcagaacatagtaaaaatctcagtcaaaattagcttccatgaagaacagttgttgagctccatacagagtagtgtatcattactactcatgttaccatgaataacatttgttgagctccctacatagtaatgtatcgtgtactttaaacacattacctaggtcggttgcagtggctcacacctgtaattccagcactttgggaggttgaagcaggaggattgcttgagcccaggagttggagaccagcctgggcaacataggaagacccctcatctctacaaaaaatacaaaagttagcaggtattgtggcacatgcctgtagtcccagctacttgggaggctgaggtgggaagattcattgagcttgggaggtcaaggctgcagtgagccataatcgtgccactgcactccagcctgggcgacagagtgggaccctgtttcaaataaataaaattaatgtattagctaatttcatacaatggactagatatttccatcataaatggaggaaactgaggctcagggattccataatttgccttgttggctggtgagaggtacactagaatttatgttcccataagcctggctgcatttgatggctcttccaccaccccaggctgctttgtctgaaccgctcctgtatccccagagcctagaacgctgcctaccactcaggcgcccaccaagtatgtgttggctgactgcatgaatgcttcctgtctcttctcaccatgacggttcttttgttcagtgtgttgggcatttgagtatctggcccgcagtgtcggacactgcactcattagtatgctgcttcttctctttaagcctttgtttgtgtgttgccaatcccctggctagacggggaattctcgggccaggattgccttgtattcactaatgcaggggactaagctccagcatgttggagcccagaaagcactttccagaaaaagattctttagaacatccaaggatggagtatcctgactttttttttcttttaaacattcagatatcaaatgcacacttggctagctaatctgtcttaactaggatcaaatgtatgaaactgtcttcacactggcagctgagccaaaaacgaatatttggcatgcttaaaacaaccgttgcctgcttttgtttttgaaggctgtatatttcagcagaaagagagctggacttggggcatgagtcacttaacttcttgggctctccttccttccttccttccttccttctttatttatttatttatttatttatttatttatttatttatttatttatttattgagacagagttttgctcttgttgcccaggctggtgtacaatggcgtgatctcggcttgctgcgacctctgcctcctgggttcaagcgattctcctacctcagccttccaagtagctggaattacaggcatgcaccaccatgcttgtctaattttgtatttttagtagagacgggatttctctatgtttgtcaggctggtctcgaactcctgacctcaggtgatctgcctgcctcggcctcccaaagtgctgggattacaggcgtgagccaccatgcctggacttccttcctcatttataaagccagggtgataatgtatgctccagtaacccaaagcttggtgaggtcagaagatacagactatt

SEQ ID NO: 57739 - DNA, 1125 bp, Homo sapiens
cacagagtttccttccatgtgctaccaggtgcaccaccctccagacacctccacacatccaggaccccagaagctctcctagccctgtcctttgagtttttacagaggcttcactacaaagacacaattgattacatcattggccattagtgaataactcagccatcagccctctctctccccctccctggaggtgaaggtggggtggagatagaagttccaaccatccaatcacatggttggttcccttggcaaccagccccctttgggaggctaccagagcccccaaccatcagtcatctcattagcatacaaaaatacttatccctttggagattccaagagttttaggagctgtgtgccaggaaactgggacaagaaccaaatacatatttcatacataaatcacacatcacaagggtctgtggcccattcatgaatatgtagctcctcatccatcaactactctttggtggcccagccttcctaacactttacaggttttgggaaatagtttaggaatttttctccacaagaggtctgctctcacctaggacttagatcccaaatattgaacaatcaatatggtgcaggcatcaaccagtctgcgcacaggacatgggccatggtataatgcagcaggttctgaattccatcccccaccccaccaccccaccaccacaactccccaccatcaggctcaatgctgtcgttgctggaacatgaagtctcctggtcctgggattgaggttaaggaggcaatgaccatgggagggcatgttagggtatcgactatttaccaaccgatatagaagtattttattttctatttatttatttaatttatttttaagatgaagttttgtgcttgttgcccaggctagggtgcaatggcacaatctcggctcactgcaacctccgcctcctgggttcaagcgattctcatgcctcagcctcccaagtagctgggattacagttgcccaccaccatgcctggctaactttttgtattttcagtagagatgaggtatcaccatgttggccaggctggtcttgaactcttggcctcaggtgaaccgcctgccttggcctcccaaagtgctgggattacaggcgtgagccacc

SEQ ID NO: 57740 - DNA, 1045 bp, Homo sapiens
aacacgtttgtgatttcagagcagtctgtgtcttgtgtcaattcattgctgcttctaggctaggaagggaaaagggttgccatatttccagtgatgaaagaactttgttaggaaagatgttcagattaataacacaaaattagattggagttttttgagagcctttcaattattcagcagtgatgtctcagtaaaagtggaagtaaactgggaccatgtaaacctttctcaagtgttaatgtttcacatattttagtttgtttagtcttttacatattgttcaaaccattaagttagacctcagaatataaagcatgtttattttctaatgataaacgaaacacatatttatgtgactaagatgtgggaattgtagccctgggctgtggttatgtaaacatgggaatgtgtggaatttactcatagtttacaggaagtaaggtgtcattgttcggatagtttcctgtcataaaaagttatctaatttgattttaaaatagtaaccttagatgttgtttttctactcagaaattcataggaaacccaaaattgtatgttttttctttttcttttctctgtttttgtgaaagaattttctgtattttccaccaaaaagaaattagatgtttctgttcctggtagtgctcaatataatgatgtatatatttaccacatgcacatgtgtaggtgacctgacattaaacatagggaaactctgtgttgatttcagtgatgagctacatgtacacaaaaccatcctccttacttggtcatttctacaacttccagtcctgagaactggtcactccagcaggtttaaagtaataatctgtggctgtcaaatgattttaaatgaagcatttttggctcgtacttcgttataagcttgcatttaaaagcaaaggcaggccggaagcggtggctcatgcctgtaatcccagcacttggggaggccgaggcaagtggatcacctgaggtcagaagttcgagaccagccggatcaacatggtgaaacctcatctctcctaaaaatacaaaaaagtta

SEQ ID NO: 57741 - DNA, 1062 bp, Homo sapiens
tgagggtgctcaaaacctgttagtcaatttgaccaagaaacttctgaaactgtaacatgattgactctacagagacagtatctgaagggtcttttaggatggtcccaattgcttctattaatatctcggccagccgggcacggtgggtcacgcctgtaatcccaacactttgggaggcccaggtgggcggatcacgaggtcaggagttcgagaccagcctgaccaacatggtgaaaccctgtctctacttaaaaaatacaaaaattagccggacgtagtggtgcatacctgtattctcagctatttgggagcctgaggcaggagaatcgcttgaacccgggaggcggaggttgcagtgagtcgagcgagccactgcattccaggctgggcgacagagtgagactctgtctcaaaaaaaaaaaaaaaaaaaaaaaaaaaaatcttggccatattttaatgtaggatccatacataaattttaacgcccaattttaaattatagtcagtagcaaacatgttatttttgggaagtctcttttctgacttgttaaagcaagtatgcatgggcctataattctacaacacaaattgcgtttttgttttgatgagctctgttcctttattcatacattcattcattcaacaaatatttattcagaacttactaggtcctggggatactacagtgaacaataaacagcaatctatgctctcatgtgatagcctctggttataccgcttgattccttttctttttctttctgactcatatactgctactttctgacttatatactactttcttactttctgacttatatactgctaatatcactgcttaacaccaatttgcgaagataacatttatgtgacgtaaatagatctattttatgttctgctgttcttaacacttaaacattattattgcgagtgatttttgtattcttttggatgtgggtaatttaacttttattaaggtaattttagtatgttagatgctcaactcatttggccattagagtgctcttctttatttaggagcgtgtaactacttgtctctga

SEQ ID NO: 57742 - DNA, 1080 bp, Homo sapiens
caggacttcccatgacatttaatgatggaaactatttttctgatttccaaaccaaaactaacatgcatcttataatttaataagaaatgatcacccgattatattcagtcatatactcacctgaaccaatactccatctggaactagaatacaaaaatactttgaatggtctgaaagtactatttgttaaaaatgttcagtactgaaatatcagttggaattttgccaggtgaatgtgagagcagaaattcaatatatgtatagaattgcctttcataaggcagttattttgtttataagccatgtatagttatttagatgatcaagtttatctgtactaaacttgatcatctaaataactgcatggctgatcaagtttaatacagataaactttatcatctaaataactgcatggcttataaagtatacatgtatttgtgttttaataaaatgttcagaacacaaattactggtggctgaatatataaaatacactttgagaggaatactagcaagagcagatggtggggacattgctttgcaataaataagattaatgtgtttagagctattaagattgtgaagagaaaggcaagaagtttagcctatcaataggaagcacaccagtgcctgaacctgacttgagttttgaaaaagctcatttcttaaaaacattcttagaaaattgggcttcacggaatagatatgtttggaaatcttggttcacatatgtataaggaatatccagtttctccctgttttcaagaatagccacttcacatcttttaggtggctctcaaatgtcggacaggagcagttgttagggtttttcaaatgtaagtcagaactgttgtttggagaaaactgaattttttcatttcgtaagattataatttctagaaatatctattaaaaggtggaaattacattaaagatagtaagtatattgtgagtatgtgaaatgaattttagaaatgatcacctctgtattattttaatagagtggaacaaaaatgttttaaatggttcttactttggaaatggatatcttaaaaattctgatattgccaccatttgtt

SEQ ID NO: 57743 - DNA, 1466 bp, Homo sapiens
gcaagccagtctacatgctcacaagacctcctccaactttcaaataaattcttagttatggaccctaggttaagaatttagaagacatcctaaatattgaaattttattgtatagataagtaggaagttaaaacctaagaaaatcatcaaatattaggggtgcttctgaattgatttatctgcagtttaactacttagcatttatggaaggcagtttacaaaaagccatagaggtttatgataagctggtcaagtaattagttgaatagattttataattctttgcacttctcatctgataataactaccgtataggtagtagacttgacagtagttcagtattttctgttaacagagttgtgtttataacaattacagtcaactactgtggttcttcagttgcacagagtagcttttggcaaaagtgaaaaaacctacaaccaacctacatctttttacctaggaggaataatattgagttcttaataacagactatacttcattatagcctgtgtgtgtgactagctaggttgaaatgtactgtgcatgataagccttgtaaagcaagttatatgttgaaattagtatctttggaagtgtagatagatagctggagaaaaatgtaatgatttggagcttgtactccagaggggaaaatgtatttcccgtgtttatagagaatagaagaataatgggcaggggttgaatgtaaagggaattaagggatatcttagaatggagaagaaaaggaatagattttgaaggaaaatagcatacacattccgtactcagtcacatttggaaaatagggaatataaaatttactccaatattaactgttaaaagggtaaagaggatctttagttggaaaactgttctgattttgttgttctttcagttcagacttatttcagtactttggtttgttatgaactttagaactattgtggagcaattaataaataactcttaacagacaactgtggtgaatttctgtttacatgtccagtctaggaaaaagatggctaatctttgtgtttatgtattaaatcttttctttggtaactcataaaatcacacagtttccatcggttgttaagaattttaaataacttttttcttactaaaacaattggcagtcaaaattgttatatgtgatcaaatggatatgaacagaatttaggaattaagaccaaagctctgaatccacattctttacccaccaaaaaataaatgtacaaatacagtgtacaaaggcatgttgtgttacgacaaaggaaaagtgtgagtggttataaaaagttggaaacccttaattatttttttgttttgctttgaaaaatgtttgcaattttaacttgtgactagttcatttctttattctacgttagataagaatcttataagcattatctattggaaagttaaagttttaaatgggagctaaagttttaaatactgagt

SEQ ID NO: 57744 - DNA, 5523 bp, Homo sapiens
gttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaagattgaagaaaggagatattacttaatatccagtaacgtttttcagaattttctattaacattttctaaaatattcacatccgtggtataacctgcagtttagaggcttgtattttaattgtatttttttaacttaggtattttgtgtttctaggtttattttagttgaaaatggactcaaggccgggagtggtggctcacgcctgtaatcctagcacttcgggaggccaaggcgggtggattgcctgagctcaggagctcgagaccagtctgggtaacacagtgaaaccccgtctctactaaaatacaaaaaatcagctgggtggggcggcgtgtgcctgtagtcccagctactcaggaggctgaggcaggataattgcttgaacccagaaggtggggaggttgcagtgagccaagattgtgccactgcactccagcctgggcgacagagcaagactccgtttcaaaaaaaaaaaaaaggattcaaatttatataatactaaatttttgttcttccatattgctatgcacctaaaacatattcaatgttcataaaatattcagttttatgacattatgaaaacattcaacattttatgaacattgaatactttatgaacgttgaatatgttttaggtgcataatatggaagaatagaaatttaatattatataaatcaatgttttcttgaaattgggttagccatcctaatattactccagagaaattatttattgaggctttattttaaatcagattccaatatcttctggttttaggtgcatccttttttgcctcaaaaatgttgtaatatcctgtggcaccagttttgggaaaaaaaactttttacttaaaaagttgtaataaagtgacagtatgatttagattacaacagtcttgagcattttagttaggatgaaggtattattaaatcagcaatgttttaaaatgttgagagtataagtattagaaggaaagagctaaacctataaataatggagatgcagaaactgaaaattagtaaatatgtaatatattagtaaacttataagtatgaagggaaaaagtagatcataagacatttgtgttttgaaatttagtggctacagtgttgaggaattgggaataaatatattaaagggtagaataggtctttgaggctttgttttctttttagtatatgatagtattacaggaaatcataaagatattaagtataagcatggatttctctgtagagattatctgtactggcgagtctgtgattaggaaatgtcagtttttgtttgttttgcccaagtgtatttcctagatttggtctttttcttgaacaagagtgctaagcagaatctctgattctatattgaaatccaatttttgatttctttgcacaggtgacttattctctattctagattagccctaacagattgatttttttttttaacccatccacctgcctttatttcttctgtggaatgtctgtctctgaatatgatcatt

SEQ ID NO: 57745 - DNA, 1228 bp, Homo sapiens
gaatatttgttacatatatagattacaataaaaatgtatgcagttcacaacagatggtaatgtgaaattttatctcgagctggtatttcaagtattatttcaaaacctattcatacttattaccttaagtttattcttttagctgctttataattttttttttttaattttaaccctgttgaagattgtaacaaatatattctagttgctacagtctaaaacagtgcttggaaatactgatgcttagtgttatttctatgattactttaataacatttcctgagtttaattttttcattacccagctatctttcagaactggtatattgatttttctaattaatattctttgtacttgggatggtatttttattttgtacttctaaagaattgaatagcacaaccattataagtgatgtgcttgctatgttatcatataaatgctcaaggtacaccttctaatgttgaaaaataggaaaataaattgaccttgatgaagtgtgtcttcttttgtctgttcccaggaaagtttatttcaggtatttctactgctgaaatgattagcgttaacagcttttcccctccattttattttacagggtctcttcatcttcctgatatatggggtgtacaacacagaggtaagtctgcttggagtatctcaaggctgacagagtgaatgagagaaatgacaggtttcttatcttgataactgaggaacaaagttggcttttcatatgagtgtcctactgcccttcatgcttggactagcttatatgcatcccagcttaccattaaacactgacaccctgaataaagggacagcctcatttctcacaggcgttgactaatattttacgactgccttaagtttttgaactttcagtctttaacacttagctattgtagaaaaaaacaaaaacaaaaacaaaaaaacaactcagcctctcctatactctcactcaacaatcaacacagaagatttctgcgaccaaatgtgtaggggtttctccccacacaccgagcaagcaatcaattctgcagcagacaccactggggtgtcctccaattcaattctgacactacctacctggagacagcatcagatcccccagattaagagcccaggcctacaagactggccggccgcatttcagatgccaatcacaagccccaggtagttttacctgtgcttctgactgaccagctgtaaatcggggttcccatg

SEQ ID NO: 57746 - DNA, 1166 bp, Homo sapiens
ctcaaaaaaaaaaaagagttatgaaggtgtctatttaagacaatgtgtgtgaaagagcatttattaggagtcaaacagtaatccttggctctgccaacttgtcagcattgtggcactttgagcaagcctcaaaatccccatatataagaataaagctaataatactcacactgcctcctttgcaatgttgtagtgaagaacaaatgggtttatgtaaatgaaagtgcttgagagagctatccagatattagcactgttaatactattcttattcctgaggaggcaatgtgctatgtatggggcacctgtcctgttctttctgttgccaagaaagaaaatattaccacttaaaaaagattgattctgtaacaatcatgaagtgtactgtaaaagtacagatcaatataacaacagacttgatgtcaaccactgaatctatttgcagataatgctcaagacttctagaacagtgtaaatatttacaaagtcgcctcagttttcaatgtttcatagataaatgagaatgaaatcatcaagaatgtttttttctctttcccttagtttctatttttaacttctgtacagtatcagatgtaatatcctggtgttctttcccaactcctggcccctgcccataaagtacacgcatgctacaggaatccagctacactttggatgcttcctgcccaattaatgttatttttactgtgactaaagcattgagaaataggtacctctatagaaaatacttcatatattaatacattacagatgaactgttctataaatggaatagtagaaaccacctaacagacatgagagatcattcaattcagaaatgtgacatactttcagtattgactctttagtaggacagaatgttgctataaggagttccagaaatcacagtgccagttgaagtttggcagttggttccttccagctgtttttaaaggtatcctctctgcaggaatttaaaagtggctcatagtatggcttaagatgtttatgtttagctgtttctgttgtgattcttccctttgagaaaataggatgtttttctagtagtaaagggtttatgaagttctgtggcattagatctaaatgatcatgactgtgaatacctggtaaaattaatggagaaaaaagacatcatgtgtggggca

SEQ ID NO: 57747 - DNA, 1594 bp, Homo sapiens
caactgtgtcccctaaacacctctgcattctcacaaccatttccccatttctgtttctctttccctgactaccttcctaactggttgccctacttctgatctgtgccactttaatccacctccttcattgctactagagttatttaaagaaaaaaaaaaaggtgggaattgaacaatgagaacacatggacacaggaaggggaacatcacactctggggactgttgtggggtaggaggaggggggagggatagctttaggagatatacctaatgctaaatgatgagttaatgggtgcagcacaccagcatggcacatatgtacatatgtaactaacctgcacattgtgcacatgtaccctaaaacttaaagtataataataataaaataaaaaaaagaaaaaaaaagaaaaaactcattacatcacttttcccattaaaattctttaataatcccctcttcctagagaatagctgaactccttgacatgatatgcaaaacctttcatgatctggtcctttcttcctttccagtttcgtcaccttgcctgtctcacttgaaaactagttgctccagcaattctgaactccttggaggtaactctggcctggttggtgctctcaaaactctctttttcaaattatctcagaaatgtcctttcccagccgtctccctgatcattccttctactccttcaaggatcagatctttatggccagacacggtggctcatgcctgtaatcctagcactttgggaggccgaggtgggtggatcacctgaggtcaagagttcaagaccaggttggccaacatggtgaaaacccatctctattaaaaatacaaaaattagcagggcgtggtggcagatgcctgtaatctcagctactcaggaggctgaggcagaagaattgcttgaacccgggtgacggaggttgcagtgagccgagcgaagcaagactccatctcaaacacaacaaaacaaaatcagatctttagaaaaatatcaaatcaaaatgcttcacacaaaaaagaggcagtcacttcatgaattttggcttccctttgaaaactcactgtcttcccttggtgaaactgagttttctacttataagcttcttttggtctatttttaaaaataacttctctactagacttcttgatggttaagatccacatcttaaccctacttggagtcacacagtgcctgatacctagtgagtactcaataaatgtaaatggataatgtaagaattattactaattactcagtttccattgtatgtagatagaagaaatagacttttgtctagcacacattgaattctagcacacattgaattttcattatgtgctaggcatcatgttaaatgttacctactttatcgtgacaaccctgtacaattactattattactgaataaggaaagttagcctcagagaagttaagaaaactgcccaaagtcacagggttagtgtgtggtagagctcggagtaccggagtacatccaagtttgtttgactccaaaccttttttttttttttttttgagatggagtctcactgtcaccaggctggagtgcaatggcctgatctcg

SEQ ID NO: 57748 - DNA, 1069 bp, Homo sapiens
ataaaataaaaaataaaaaataataataataatgaaagaaaccccatgtacatgtgtaactgtgataaggataaaaattaaattaaaaagttaatgtaggccgggcgaggtggttcatgcctgtaatctcagtcctgtgggaggctcaggcgggtggatcacctgaggtcaggagttcgagaccagcctggccaacatgatgaaacctggtctctactaaacatacaaaagactgtggcgtggtgacacgtgcctgtagtcccagttattcgggaggctgaggcaagagaattgcttgaacccgggaggcagaggttgcagtgaaccaagatcgccccactgtactccagcctggcgacagagcaagactgtgtctcaaaaaaaaaaaaaaaaaagttaatgtagagaatgtcactcactgaaggcatttctacaacgaacccatgctaatgtgatccaaatatactgctttctgatgatctaactttatacagaaatagcactcagagaatctaggaatagttgacatataccctagataccatctctcattaatatcaggtgtttcaaataagcctttgggcaagtcagtgttgcttgaacccctggggagagctggtgttctgtgtcattgatggaagggcttccaataaaccttagaagacagagataagacagcaccatccttgtcttgtgccatactaggttccactggcactcttctagactgtgggttagcgcacttgtacgtggatggtagatgtgtgaggtaggatacatgcaagtatgtttttgaacatttttacaactctctagaatcccagaatctcacagcagtaacacagtagacatcattttggcctgagggactctaacctcagtaatgcattctaacccagcctcagtatattagccacaaaggcataccgaagtacctgaatgtcatctgattgggcagttgttctatgtctatttaactgattgagaagttctactgaatacaacattcttgctgtcaatatgtttgaagcttctgactctaatagccaataggattagctgcttttga

SEQ ID NO: 57749 - DNA, 1049 bp, Homo sapiens
agccactgtgtctggcctattttaagaaatttttaatgacctagcaaaatgctcatgatataatattttaagccaataaaatacctcacttcagataaccatctggtgaagctcacagttgacaggcctttgaccccaaacacagagcttccaggcaaattgttttttcatgtcccagtcttaagtatatgtaaaagaaaacttttaaaagagacacagatcctattattagtactaatattcatatcaatagtatccataaagtgcaaatactgttaaaaagaaaaaaaggaaaactcaggaaacagtttttgaaagttaaaatagtatggcatgacaaataaaaaactaaatagacgataagaagaaaaaatcgaggaagtcctccagaaagcacaataaaaagataaagagataggaagtaagaaaatagtagagacactatccaggatatccaccattcaagtaatagagtgttccaaaaagaggggggacaaatcagggaaattaggggaaggaaaagaaataatcaaagtaacattttaagaaagtttattttagacagaaaaaataggcatttgcagcagaaagggacatcaaatttccagcatgatgaatgaaaactaacccacaccaatgacatcatcaaacactgtaaatactgagaaacaggcttccagacaagaaaagtaggtttcacaaaaaggattaagtatgagaatgacatccaactcctcaacagcagttctagatggtagacgataactgataaatgcctttataattctgagggaaaataatttctaaagtagaattcagtactatcaactgtgtatgaagaaagaataaaggctcttttttaacttttttaagacagggtctcactctgtcacctaggctggagcacagtggtgtgatcacagctcattgcaaccaccacctcctgggttcaggtgatcctcccacttcagcctcccgagtagctgggactgcttgtatgcaccaccacgtctggcttattttttgtatcttttgtagaaacagagttt

SEQ ID NO: 57750 - DNA, 1055 bp, Homo sapiens
cccagttacttacttgggaggctgaggcaggagaattgcttgaaccaggaggtgaaggttgcagtgagccaagattgtgccactgcactcgtctgggcaacagagtgagactccatctcagaaaaaaaagaaaagaaaagaaaaaaaatgatccatacaatggaatattatttggctataagaaggaatagctgggtgtggtggcacatgcctatagccccagctacttgggaggctgagatgggaggatcgctggagcccaggaatttgaggctgcggtgtgctatgatcccacctgttgaatggccactgcactccagcttgggcaacgtagaaagaacctgtcttttaaattaaaaaaaaaaaaaagatggaatgaagtactgatacatgccacaacacagatgaactttgaaaatattatgttaaacaatgaaaaagtgaaagaagccagtcacaaaagatggcatataatatgatcccatttatatagtttccagaataggcaaacctatagagactgaaagtagatgagtggttgtttaggattgggggcagggggaggagtagaaagactagggaaaaggtaataattaaagggcacagattttttttttttagaaatgataaaatttttctaaaattgtggtgacatttgcacaactctgtgaatattcttaataccattcaattgcacacttcaaatgagtgatatgtttatgtctcaataaaggcattataaaaaaacaatcctaagacagttaaaaacattgcaatctagtatatgatcctctaatggtctggcttggttccagacaaaattgagaaaaagtaggaaggggcaggctgtatatctttctggaaatcatcccataggtatcatttttcataactgggcttcgataagaacagggtacagtaagttcaaggttacattttctggcaagatcctaaaatgtaattatatgatgattaaagatgaatttgcatactttggcaattcaaaacagaactcttccacaggaaccgaaggtttaattatattctattcaaag

SEQ ID NO: 57751 - DNA, 1047 bp, Homo sapiens
tactaaaaatacaaaaattagctgggggtggtggtggacacctgtaatcacagctacttgggaggcagaggcaggagaatcacttgaacccaggaggcagaggttgcagtgagcctagatcgtgctgctgtactctagcctgggtgacaaagcaagactcctgtctcaaagaaataaataaaattcaactttactaagttaatcaatctttttcttatgcgttttagaaagttcaagcaagtttcaccacagaggttctgaaagatgttatttcaggtactttttttttagtattttgcgttctgagatggttgtctatccagctggggcccaaggcaatggatttctctggatacacaagaggaactggggtaatgagtttggcttagaagaatattatcaaaaagaatgaatgaaacagttatcttaataaaattgaaaccaggggattttgctgaagctgctttcaaaacatgaatgacccatgctgacataaggaaagaataaaattacaaggtttggtttctatatgagagttttgggggttttccagttaaaaagtgttatttacgagtactgtaaaagtaggccaaaaatacatcttcaaatgcagaagagatctttaggtttcactgtcccagtcaaaagaaaaaagaattactttccatccaatctctaaaattttggccacctgcctggtatttctcttcaatttcacacttcaaaatggcctccaggaagacacggttcaggatcagtacgaaagtacaaagttgccaaaataacccttccattctcttttcaaagccaaccagccatctgaaatctatgtatacagggatcgctaaaagtaaccttgcttatgaaagttattgttttagtgtcatatttcttacagtataggtgtcccttatcataagccaacaaaattcatgaaatttataatttaagccatctcacctgaatcttcatgtttatggaattttaactagattgtgttcatttccccacaaaactaaccataggtacattttttaaagacagtgt

SEQ ID NO: 57752 - DNA, 1034 bp, Homo sapiens
ttaggtgaggaaatttagggttagcaagactacataacttacttacagcctttcaaccagtggctcaatgattaaaaaggaatccttaaacacaattttcaaagaggaacctttttcataaatggagtgagactgatggaaagggtttataggttggataaagaggatagacaggaaaattgatcccctgacacatgacttcctcacatggctgccatgatccatattcccatcaggaatttctaataccactaccagatggatataagaggctggtataaagttattccctactccaggagaatttgattggcacaataagaagagagaaaacgaaaatgaggggatgaggttaggagattttagagtagtgcctgttaagtgggccacttaccacctgcatcagatcaccagatatgcctgttaaaaatgcaggttcctgggcctgtgctcagactttctttagcaaatctggaacccggggtggaggcagggcataccaggtgagcttctgtacactaaggtgggaaaatttctaaattagggtgacagccaagagattgggaatcagtgctataacaggaaatcacaatggaaagatactataatttaatgttcctagctcggactttaaaatttacttacaatgcttgttttgccagcacaaatctaaaaataataaacaaaaaaaaaccaaagaaataaaatgacataatttaatgcaattattttgtttaaaaaattaggaaatttagataatgagaatcacagaaaattatacaactagagaaaatccccgttactattttggctatttcctttccatctttttcattatgcaaatctcaatacatttatataactgacatcacacactctgtactcttctttcctaaaattgtatctaccataagcaatgtttctagttgctaaaaattctttgaaaaattaatggctgcataatcgtttatcatttggataaaatttaatttatttaaccacgttttcattattgaacttttaagttgtttttg

SEQ ID NO: 57753 - DNA, 1140 bp, Homo sapiens
gagagatataataaggagaaaataaaatagtacaggggaaatatttaacattgcgcctggtgtgtagaaaatactcaaatcactgttgcatttgaatctcaaggaagatgcttatgatagctcttgaaaccatttgagtttctagacatggaaaagaccttaaatatgacactttctacttcagcctgagggaaaaaacatgaaaaagataagtagctatcaaatgagtaaggatttatgtgaaaagtaactgtaccctcatttttgcatttctctaaatgttgctctaaattatatagttttaatttcagtgtaattactagtgttagtataactgatatttatgatagtatttaatgtacagcaatgatagcctttaatgagagtatttagctgtccagagaaaagcataaccaagtgggaaagtctgccaaatctttactttggttaattatatttattcattcaatgttatttattgagcttctactttgtgccaggcagtgtggacacagccaacaaccagctgtggggattaattctgggagaaacagatattaaacaactatgtaattgcaaagtgagtaattataatttggggagtacttccaaggagctgtacaggaggctaagagggcacatgctagaccccctggatggaaagctggttgacgaggtattttggacacaaggtcacaactgagacaccatcatcttccagacccaacttctaaaaggtatttaacaatacctagaaggagactgtctactgtgacagtcctacaggcccatagtcatccctggctactgttcatgggtaatctaatagccagtgccaaagggttggagggaaaaacacaaggaagaaagtaaaaactttgattttttatttttccacaggctcaagaatactcagggaacaacttatatcaactttatattgttaaatgttatcggctgggcatggtggctcacacctgtaatcccagcactttgggaggccgaggcgggtggattacctgaggtcaggagtttgagaccagcctggccaacatggcaaaaccccgtctctactaaaaatacaaaaattagctgggcatagtggcgggtacctgtaatcccagctacctgggaggctaa

SEQ ID NO: 57754 - DNA, 1158 bp, Homo sapiens
tccgttaccaaggacaacatcataaataaaagtgtttgtgaaattttacctgcagcttcctaactttgtgcattaagcatgagactagcagagaggtggtcaaatgtgaaaatttataatcatttattacgtacggctgaagcaagaagggaataaaagcgtgaaggcatacatctataaacggaagccgaaaaccttaaatgaaaagtaaagtgaatttctgtgtcttgtcataaagtaatgagaagctagagcttttattcatagcaacccaagatgcatttactctcaatctagcttcagcagtaaacgcttccctgatgtattgctttggacttacaaagaaatatttgtgctctacataatagtatagttaggagaattactgcatggttgagaagattctataaagctttatagctggtggtgttactgtaatttaatcacaatgtagctaatgtagtactttaatatcacaggttacttttttatttaccatttattagtaactgacagagtcaatcatctctacatcataaacaaatcatggagggattctataggaaccctaaaattccgggatagatgtactatggctgttttacactaccacattccctgtaatgagctaaccatcaaattattatttagatctgtgaaatgtaaggcaggctccttgttcttagtccattggccaaagaaaacttgaggacattttatgtcaggaatacaattagcaccgcatgtcatttatgctcagaaataactcattgatccaattctagcaaaatctagaagcattttctgaaaaatgttaaggtatttagctaaaattttttctaactgttctgtaatctattcatgaacattaccataatgttaagcttaaaccaatgctttgtcattaggatttttaaatgaaaagtatgtttttatacttgaaaataaaatacaaatgcttttgtcatttctgtttacatatattgctctcttgatagattatagatagaaagatagatagacatataattagttgttacataaaccatgtcacattaatatggttgatgccagaaatattaagcaagactaataaggaatgctgctaatgtctggaaactgtgacactgtgaaaagtaggactgacgacatgtctaa

SEQ ID NO: 57755 - DNA, 2156 bp, Homo sapiens
aaatttaaggctgttagtattcaatgtatttagaagtgctcttgagattaaggcagtcacagagtgctcagaaaggtagatttcagatattatcacagcacatggtaaagagaaagatttaaataaacccctccagcttgccttgtgttaaattgtctggctcctaaagtaaaggtaactctgaaaaggattaaaatggacatctaaatgataattactgggtaattttgttttggttataatttgtggtgttatttttataactgacatgagacataatatatttttcagggttctgcaatagccaagcaacaaatggaagctgtcagaaagtatttgtaggaacagttatggaagaaagctgcgaggttgttgaaacgctacacagactacatttttttagcctatgcatgagtagaatactttcctaaaaatgtaattgactgtggacgtgtggcatacagcaagccctctgcctaggcttttgaaatcctcttattttcactgatgcaaaaccggcatggtgtctttcaaggatcttttcaactcaccctgtgtcatcacacgcacattactgagcatttgatgctgtcttacctcctgttctctagacccgtccctcttcctctttcttcctgtcttttctgttctatctgtgctctggatcactctgtggcaccaaggacactgcaggggctttagctcctggtccttaactggcggcgctcaaatctactgactttactgacctctgcccaagccatgaactgagaccgacgaatagatcacccaaactcccagcaaccagcacatggcagttgtgcagggccttttccatgcggcataatttcgtggaatttctctctctcctcatctggctctgattatttgctgatttgtaattttagttattcgtgtgcaagtcttatctcctttgccagactgtatgctcctgagcaacatgcactatgcttgatgcattttgtgcgtcttctctccttcctgggcttggcatggtgctcagcacaacgtggaaattcagtagatacattgtgagtgaattcatgacattgaagctaggaacacagaatatcctaaagataatccaggtatcaatgccagagattggtcacatcctggctaaatctgtagctatttaaactaagtttccagtttcttatttccatagctatgaaatcaagaggatatatattttaaagtttccacaatatcttgttttcagagatttgaaatcaagatgttatatcttcttccattgagtaggaaatagctctcacgccctgctgtggcagtacaaggctgaaggaattataatgatccttgaactcaagtctcctgataacacattttattaactggtaggagactagaataagacttgtgggtgaaactagtatgtctcaagcaattctaatttccaggcacagaaactgtactttgtagcagcagaattttatttgagaagtgactttactaggggaagtcctaccaattgtttaatttctttttcaccctaaatgataggaaaaggggaaatcatatagcctcaaatactcaaagatatttaactttataaacaggaagcacacgagggttgcattttgtttgcttaatggcaatttttgggaaatacacaagaaactaaacaactatgtttatgaacgtttttaacttttccaatctttcttgattctttctttctcactacatagagatttaaaataataaaatcagttattgcaatgattaaaatggtttgaaaaaactagtacttttccacttcttttgctttccagaaaaagaactcatgtgttccaaattatatttttcctcaatttctgttcagtccttcatattacattttaattgggataaaaaattttttttcaattcacaagctcatcaatccagaggagatacttctaatataagttataagagcaaacattcaagaaaactgaagttggaaacatgtttgtgtcttttttccatgactaacccatgtctattctctatgaaattgatgtcaaaaaggtattatatattttcagtaggaaatagaaggctgccctctactatccttgtcaggacgtcgtatccctttaatcatacttttcatttcagtacattgaaat

SEQ ID NO: 57756 - DNA, 1385 bp, Homo sapiens
ttatagtcccagaattgctaagtttaaatggtgtgcttagctggaaaaatctaacattctttaattttcaataagaaataagaaagaaagctttctcgcctggttttaagttagcagaggagttaaaaacttctactagaatgaagttgcttatctgacccatgttttattaatatatggagtgattcctagcttagaaacactaaggtgataactatgaagaaaacttaaagtgaaaaaagcaccattttatatcctctgttcaatgcaaacacactttccagaataaaaaaaaaattctgacatatctttatgtatctataaatttggcttgtgaatgtgtatatcctagggaagatgtattaataggtctgtaatgatataaaatttatgctgggggtgaggcaaaacttaatggttcataaatagcaaattcattatatttttaatactcaagttatattaacaccatataacatctttatggtgccattagaaccatttaaatctttgactcaacctgaaaaacaaacatttccaaatcttggccatgaaatgattagtcaaataaaatgttttaataaatattattggattagaacatggttggttgggtcataaactgtcttatgaatgttttatgtcatcggttacactgcatttttaaatgttaacaaattaatttattttaaaggccgcatcaaggtgaaaacaccttgtttccactggagcattaggcagcaggacaatacatcatggagccatttttcattcagtcataccactggcagaacagatgttaagacataaaatgtggtatggtttgttaaatattcatttataatttgcattcattattaaattatgtgttgggctaatctttaatcttaaaaatacaatgtcatgaagctctcagaatacatgatattttataatttagtgttactttaagtgttgactagaacgtacacaaatgtttgtcagtaatgatccttaattattccaaggagatttgatctgcattggtattgagttcaataattcattcaagccttcaggtcactaagagaaatatcagtttggggataccatctcttctgtgactaatgatgattcagctacttgcttctcatagccacactgtcattcattgcctaaaaccattttaacacagagtggtgactttgaggatcttattttttagtggtctcaaatgattatcacaataaacttcacttttggtttagaagctcgagagtaaaaattctctaagattcagttctttgaatagactatcctagaatacagtaaattctgggcttgagaatttcctatgctcgaatagtcaaatatttgattaagctccatagctgtgatattcaatt

SEQ ID NO: 57757 - DNA, 2050 bp, Homo sapiens
ctcaagatcaccctcttcataaataccttcaataaatttcagcacaggatgatggctcaagcccttttatcctttgcagaatgatataatcgggcattctaaagcaaataagaattcagtgaccccaaaaatgtatcggattaaaacctaccaataaaaaatgaagtgttaccagagaaaatactctgcagctgttctttgctttaggtacacataataacaacatgagtgtggggtatgatctggtttcagtgtggcatgcattaattcacattttaaaatcttttacatatgcttatcttcttatgagcatagtgcagtactacattagatctacttaaaatccattgagagtattgatttttttcttgagaaaaatcaacacagtgagatggtctctctcctcgtataaagcccattagagaaaaccagaattgtgttgacgtaaaggagaatgtttcctaatgtacatgacatatcactgtggttcacaagactcaactctcttccaaatctaattaactgattctgttaagcttatattctagcccctgttcgcatggttatcacacctctgtcaacccaaactcccctatttaggaactagaagtgactaagaaagtgactcatgaaaatataactatcttaaagatattttactaacatggtaatattaaatcaaataattacatgaactgttggaatttcatttgggcaattttttaaaagataatttttaattgctatgagactggagtttaagagtggatgatttaactgaaatgttttagtaagactgggtagataaaccaaacaccctgaattcccttaatagcagttatcattctgacatcttcttattttaaagaaattgctgaaaatttgacaaaactaatgtggatggctataattaaacttgacaatatctatatgggggaagaagtgaaatcactatatttagaaacgaatgctaccatcccaccccaactacatgttcaggttaaatgcgtgcacatcctggtagctggaacatctgtttctagcttgttgttcctcttggctgcttttcaattggatttcctcgagcaggtcccaggcttgtcactgcagccagggtctgttaaccatcaccactggttctacattaagtaggaggttcagggctaagctaataactcgcctgcctttctgactgatcacagtgatgttcgccgtggccacttatcatgcgggctcctttgggagggtgctcttctttgtctgtacctctgggtggaattggttttgtttcccctggttcctggagttacgtgtgaaagacaaggctcattgtcacttccatggagcggctgtgtaatgctttgcccatgcatccgctgcactcaaacatgaaactcgctctgccctttctgcaggacctctaaatacgatatgtggtgattctcttcttcctccactctgaaaaacaaaaaagaaactatcactgtatgtagtttacaggaaactaggttagaatgaaacagagcactttagtgttctgaatcatggttatgatttggcataaaatcacaagtgggaaatgtttgatgcttatggcatagcatcgtatgtgtggtccacatccaaggggtcaggtgggggtagggttggaagaaaagaggcaattgcaaagatgcttagacaattttctaaaggcctttagacagttcagtggcttccactttataaatgttccaggctgactgtagaaaaggggatgtccaaattcaagggcacacaaaaagcatttagaaagtttgctaactgacaagggggaattagtgaatttgcttcccatttctactttctaggtggcttctgaaacagcaaagaaagttgggtttcatctgggacctgatatcctggggttgacaccatcctgttgtgactcccacagctgataagctttgatagaaattggcggccccatctgtcaaactctgccatgacttttttttttttcttttttttggagacagtctcactctgttgcccaggctggagtgcagtg

SEQ ID NO: 57758 - DNA, 1036 bp, Homo sapiens
gcactttggaaggcagaggtgggtggatcacatgaggtcaggagttcgagatcagtatggcaaaaccccgtctctactaaaaatacaaaattagccaggtgtggtggtgggtgcctgtaatcccagctacttggaggctgaggcaggagaatctcttgaagccaggaggcagaggttgcagtgagctgggatcatgccactgcactccagcctgggcaaaaagagtgaaactccatctcaagaaaaaaaaaaaaaagatattttttatgaacgctttttgctcatagtagttgtaagatgaacttgttggctattcttggtaaagttgttattccacacctcctctgtgtatttatttagtagctaaaagtatcatcctcaatcgagtggagtatgtttcagatgaaggcagctctggtggttaatccaataatcaaaaggatggttggcttttccttctacacattccttaaaaatcagtgtatattttgagatgagagtgagccatgatgtgtagaaactctccattattactctacacacttttgaagaacagatgttccaaatcaagaaagaaatgtgttgtaggctaataatttcattaatgcataaaagaaaaaaaagcctatttcattagaacagtgtttaacattatacagaaataagctttgtcctttgtttgctgagaacaatagcacaatcctctgtgtaaagatgatttatctcttgctaaaccaccctaactgtttatgacagcaaaaagacaggtatcattaaccttaggtgttgacaatttagaattcatgggaatgagttagaaaaacgatagatgggtcccacccctgagtttgtggagagcagatgaatccctgtgaaccatcaccactcatgcctcacgttaccagaaaagagttccccttgaattttcagagaggggatttggttttatgtcccctacatctgaagttgaagtgaaaattgttttgaggaaaaatggatctatattccaatcgaagtattttccaaggccctagaa

SEQ ID NO: 57759 - DNA, 1156 bp, Homo sapiens
cagctactcgggaggctgaggcaggagaatcgcttgaacctgggaggcgaaggttgtggtgagctgagatcgtgcccctgcattccaatctgggcgacaagagtgaaactccatctcaaaaaaaaaaaaaaaaaagaaagaaagaaagaaaatatctacaatcagtggagcattcctattcggttgcttaatttttttttttaattttcaatagtttttggggaacaggtgatttttttgttccatggatcagttctttagtggtgatttctgagattttgctgcacctgtcacctgagcagtatatgctgtacccagtgtgttgttttttattcctcacctccctcacccctttccccctgaatccccaaagcccattatctcattcttacgcctttttatactcataacttagctcctacttataagtgagggggtcggtactcttcattcagccatacattcaggaagacatgtttattgggttccttctgagtgcctgttcatcatctggagcagtatcatggagttagaagacaagtcctctgactctgtgccttccagtctccacacacctcagtgaccttcacaccaccaccctcgtccaagtcactgtcttctccagcctaaatgtctgcagttgcgtcctactaactggcctactcgcttctgcttttagtcccctatagcctattctcatagctagagggataaaaaaaaaaatcagatgcccttattctcttgctcaaagctttcaaatggcttcttatcacatttagaatataattcagctcctcaaatgttacaagaccgcacccctacccacctctttattctcatctcctctaccttcatcttcccagccctgttggccttgctcatttcttcctgagggcctttgcacttcctgttccctctgcttgttttccccctcgatatcagttggtgcttacaagtctctctaaaccaagcaccctgtattagaatccatgtgtctctcacagcagccactaagatcatttgcaattaggaggtactcaataagacacttgatgatgtgaatggatacaaatataaagaaaataacatataaagaaaatgacatcttggaaaaatccttgcccaaaattctctggaacaggtaactcaaaagagc

SEQ ID NO: 57760 - DNA, 1117 bp, Homo sapiens
taaaaattaataacatgtccttatgcaatttcctttattaattttattatgaaatatatatccaaaaagtaaaagtaacatctatgtgtctttgttttcatctaagcctctggagagatttacagtaattgcaaacaataatttctatggcaaaagtggttaagacctcactctttaacggtgtgtgcagctgcttactttcctgcaaatagaaggccttgggaggccagtgggaacatggcctggtgggatctaagttgtttctctttgcctctacaagctaaaccaaacccactttgaacttgttctctcccagttggtgcccttgtcagggccatacatcaccagcatgcttcccccagatgaccacttcaactatacatcatccaagtgagctggggctctcttaacgtattgctcttatacatcaacaaagtgagctgcggctccaggaatctattagtgtaatacaccactagggtaaggcatactgatagagcaaagctggtcgatctgtgaattgtagatatctaggagttcgggtcaagagagtaatgcagatttcaggttggattgatgtggctatgaatggtattttatgatataaagtttacctctgatttagaaagtaatttaacgtgggtgacagctcaggttcgggctaagagaggtcgacatggtagatatctgtaactcttggaagatgtgtttcaggaataaattactgttcttgatacttttatttcattttgcgatatgtcacggggggcaccagaaaattggcctgggaggaaagttttgcacataaagcaaaacgggctcattctgctgcctgccaggtaaataaatatgaggggagtgtggcctttggaaggctcagttaccatctgtttcagttggtcaaagctgcattctcagggtcttgctcttgacctaatgtttatgtaacaaagcagcacagcagttacaatgcataaattgttatcagtttctgcaagactccagagatcagaagaattgtagcgtttaggcagaggaacaagggaatacagaaagtacaatgaccagaccccaatgggtggttcaaataaattaggccccacatcaggggcacata

SEQ ID NO: 57761 - DNA, 1025 bp, Homo sapiens
tacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaattgcttcgtggtctatgcttttttattttactgattttctttgtttattttactcttcattcagaatagctctgccttgataatagctaggctagtgttgcaaatcaagttaataattaggaaacactaaacaaatattaatattgccataacaactatttttttttaacattgttctgcctctctttagttgattatgcctggaatagatttatcaccatgtggtatgtgtaaagagcatgagctttggagtttgacatatttttcacacgtttggagtgtgaatcccagctggactgcttagtaactacatgaccttagacatgttactgtcttcactcccattccttcatctgcagaaagaaaagtaatacccacctcatggactatctatctatgagcacttagtgagaaaaatgtgggaataactgc

SEQ ID NO: 57762 - DNA, 1140 bp, Homo sapiens
tttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaaga

SEQ ID NO: 57763 - DNA, 1023 bp, Homo sapiens
acaattgaccctatctgcataccctcctttctctcattttctttctatagtatgacaaacctgtactttgttgttcatggtagggttttagtttatctattcttgtaagttaaaactcctttaagaacctatagaagaataaaatatccaaagaaatagaaaatgagctgaaacataaaaggcatggagctacaattttaaagctggagtcaggaaggaaaaataatttggatattcttttggaattttgtttttttttaaaccacatagagcaaatctgaattagggctagggaagctctctgtgagtaaagccaattaaacactgaaaaagaatcccctggcagaaattgagcaggaaagcaccttagggggcagcattggatagaataaaagcaaaggcttagaatttagatgtgggctcccactctagttctcagtcttaggagttaggaaccaaggtctgtttccttacctataaaatgaggtatacaatgggcagcataggactataatggagaatcaaataacaaaacatttgtaaagtttttagagtatagtatttgcttgatatgttacttacccccttccaagggaaatttagaaattttgtatctataaatatttaagtataacacaaaatttgttataacaaatattagagggtgtccatatttaatatagaaatcaatgtgcaatttattttgaaagaaattattaatgaatacaggtgaattagactgattattttcccatgtcacaggtaaatagaaaatacagactaagtatatgatcaatgtgtttaaaaggagagtaattgctatagcttgaaattttttatgtaaataaaataaatgagagagattataaagttgaactcttaaaagtgaaataaacttatttggaaagaagtcaatgtgcaatttatttttgaagaaatttcacatgtatgatttaagtactctcaagctatttaattgcaatcccagaaatagagctccaatctttgggcttctagactaga

SEQ ID NO: 57764 - DNA, 1317 bp, Homo sapiens
aagctacagtgagccatgattgcaccactgcattccagcctggatgacagagtgagaccatgtctcaataataataacaaaaagtaaactatttaaaaaaagaaaatactaagagggttagatttcacttttaaaaaaggataattagaccatgtaataaaatgttatagaacaattgaacaaattttatgttatagtgcccaccgaaagactttccacattctattattgcagtagaatttttgttgtgtcaaatacttcctgaatgggctatttactagctgggatttggaaatctttaactgatctaactagtaaacttgaaatcagatgattgtttttaatgtccgttgttctccctcaggaggattttctaggtctccccaagacttggttaggcacctgtcttatttgcttctctgataaccctaaacttcacccgttatgacttttaatataacatactatttataagcctgtacatctcaatggacagttagctctaagaaggtagaggacagtgggtgtcttttttcacaaggcaccattatgtgatagatgtttggttggatacttgttattgaattaattataaattcatatgggatgaaggatgactttggatataggtaatgaggaaataggatgactaaaacaaggggtggcggggtgggtggactgcaaacaggtgtggatgaaatagtagatgaaggagaatttctgacagcatagaatcatgaaaatgaaaggtaggattggccagagagcaaagctagagagccagaagcgaagggtctgacttaagtttgagcctagaaaaggaagcttgttgaaggatggtcagtgcttagttggctctcagattttagaggcagtactagaatagtgggagaacacacacaaaacaaaaactcactactggcacttgaaaaactgatgtttgaacccatgctaaattagttgtgcgtccttgggcaaactgcttaaatttttgagtctcctgtttctcacaggaaaataaagctggaaatgcctactgggcaggattgctgtgaggatcagatgaattaatgttataagaatgtctctcttagagtaactggtgtgtagtttctttccttcttttcattttctgagaagaacactttgaactgaacttgtgggtttcaactcatagccctgtgggaaatcttatacaaggaatcaaggatggagagaccaggcgacttggaggggaagttagattaagctcaggacagacttgtgttaagctagcaaacctgaatttagtgactacactttctactaagtatggtt

SEQ ID NO: 57765 - DNA, 1048 bp, Homo sapiens
ggataatatttcattcagtaatttttcttcttctttcaaagtgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcaggtaaattgatttgcttattatcatttgaaggattcatttaataattatttattggctttctactgtctatatcttccccaaaattagctctgtatgattttcaaaagtacattctgttttgaagttctgagactgtggttgtctgtaattgatttgttaaacaaagacttacatggctctctatgtatgagtagttctaagtgatttacaaatattaactcatttaatccttataacaaccccagcagtgggcactgttgttatcaccatcttgtagatgaggaaatggaggcacagggaaaataaatataccatccaatgttacctaactagtaaatgactgagttggatttggacccaggcagtcttgggcccagttcatgctctgccattataccatgctggccctcaataagggatactgggaagagagacagagtctttctctgggtatgggattggatttcaactcagactgaattggccacaattctgctgacatagagacaaggaaataattttgttttcctgcttatcttgtatcagataagattaggtttggctgtaagaagaagtaagatgaaagcttattctctctcacataaaatctagatgtagacacagtggctctgatccacagagtcctcaggatccaggctcctcccattggtcccatccgccatgcccaaagtgtagcccctgatttcatgacccactatggaggagccccatctgagctcagcacagcagggtggaaggagtggtgagaaggatagggcaaagtttgcctttttttttttttttttttgagctggagtctca

SEQ ID NO: 57766 - DNA, 1041 bp, Homo sapiens
ccaaaaatacaaaaaattagcccggtgtgggagcaggcacttgtactcccagctactcgggaggcttaggcaggagaatggcatgaacctgggaggcgaaacttgcagtgagctgagatcgctccactgcactccagccgctgcactccagcctgggcgacagagcgagattccgtctcaaaaaaaaaaaaaaaaaaaaaaattaccctttctcaagaacttgacatattctatgatattttcttgtaagttacagaattttaaatgcagtaaagctagtatgaactccacaaaataataaatcatagtgatagacaacttctatatatgacaaatgttgcttgttaactcaaaacataaaagacctccatagtgaataatagatgcttttcaagggaaacctagttctgcttagacctcagatgcttagattatagagaggcaaaatggtattatggaaaggctttggagccaatttagcctcatagtttggtttggtttttaagcaagtatttctttgatgactactgtctgctatgccctgaggaagcaaagatgaatacaaagtatgctctgtcctgaaagaccaggaattgaggaaagtagaggcaggagcagttgataaaaacctgaactgaggctagacagaaggattttaaatgcagtgaagaggaaagtcgagttttatacatactcaggatgcagaatcaataggatgcagagactggttgtgggactgaaggtgtgaagggtgcaaggatgactcctggttttaaattgggtgactgactaggggaaagtcgtgttgcctgagatggagcatttaagaggagtttaattttgaacatgaagaatttgagattctcaggggacatccaggtgtatatttgggtttagaactttggtggatggagctggggattttcaggatgtaagggtcaatagtatttatctgtcagcagaagcatcattgttattaagagcatttattaaatgcttactaagccttatcttacctagtacacaccacaaacctatgaa

SEQ ID NO: 57767 - DNA, 1090 bp, Homo sapiens
ttaataatttccaaattttctacaattaatatgaattgcttgtatttttagaacaacaaaagtagtatggaggtcatttgattattcttgccttgatatatactttaaaacctagtggttgaattaccctaggtttaacttacctcctactttttttttttttttttttgagacggagtctcgctctgtcgcccaggctggagtgcagtggcgcgatctcggctcactgcaagctccgcctcccgggttcacgccattctcttgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccttacctcctacttttaaccattcattgcagtttttaacttatttttctgtataattgtactatctctgaatcaagttctatgtagcattttgctagaactgtaattgttattacgttaaatatgtaaaatatagactgtaatcctgatcaatatattcgaccaggaagtgactacatcttaactttgtcagattattcttttatgtctctcctgaggattttattgtttatgtttttactattattataaatctcatttattattcctgaattatttaatgatttctattgtttttattaaaagtagatgtcttttaatatcatccctgtcatcgtgtgattgacttttaatttgatcaggaatgattttttagacttatcagataatatataatctgctaattttatggtttaaatgtaacaaaggatttaatcttttttttcttagttgctaaacattttttcaccccaaatttactgaaactatatattatatttttcttagagtaatggtagtaacaggggtgaagatgccttttgtgatcctgaagatgaatgggaacccgacattacagatgcaccagtttcttcactttctagaaggaggtaaagacaattttgttactagttttcttgcact

SEQ ID NO: 57768 - DNA, 1063 bp, Homo sapiens
tgcagtgagctgagattgtatcactacactccagcctgggcgacagagcaagactccgtctcaaaaaaaaaaaaaaaaaaaaactagttggaggaaaataaaataattttaaattattgttacatattggtatgaatcttaacaccaaaggaatagcccaagcagaattatcccatattgcctttttcttactttttagtgtgttctataattgttaactatgtgcttcttattttaacagtactatcaaaaattttggtgggacagtgagtattatcccagttggggaagcaaagacatatgtaaatggaaaacatattttggaaatcacagtattacgtcatgtaagtggatgggtgctataatataagaaactgttcgactttggataagtcatttaatttctttgagttctggttttctctataagataagggtgttgaagcagattaaggactttttcatttcaaaaattctttttcctattaattgctttcttgtgcaaagacaaaagttacatttatatgaatcagtacctgaagagctgaccactaatagcatcattatgtgtcctataaagagctaggctttagaatcagacagacagggttgaaatcctggctttgccatttgctctgtgacgtctggcaagttatttaactagatgattaaacaatgtcacccaagtcaggacacttttgagatcattattaataattacatcaagagaacaaacatcagcagtgtgttacaggcaaacccagacctattgtgactctatatatcctgcctttcagagatagtgaaggattaactgaaataataatttgtgtatatagttcttagaatagtatctgcaaatagtaagctctcaatgaatgtctcttgttattattaagctttgtgctgtttagtttcctcattcctaaaattgggatgattatatgtatctcactgagttgttgtgaatcgtaaatgagataacataaagtcttgcacttcataatgatgttttgggcaatgagggaccacatatgtaacagtggtcccataagattataat

SEQ ID NO: 57769 - DNA, 1114 bp, Homo sapiens
cggaggttgcaatgagccgagatcgtaccactgcactctagacagtgagactctgtctaaataaataaataaataaatattctgaattccagcttgaaaaatctttgatcttggctgttctgcctagtgaatagccattcttttatttctttactttttaaataaactttcactttaacaattacccttttgcctctcaaaagtgttccactttggtcagtacattatacagctttcctacttatgaacagggaaagttcattaatatgggagcatatttcaggttaagactaagtaaagatttataggttatataaagtagagctgatttctccaatattctattttatttagtaatactgtatttaaaacttcaaatgaaatagaagattggaggattatgcttactgtggaaattgttatatattaaatgttattattaatgcatctttgtataaatcttcagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaaggtagagtacagtcagtactctaaatgttaagtgtgttgctctggaatcataggaatggcagggacctcaagaggatactgagtatttttccgaccttccttatgaatagagcagcccactcccagattatcatattttaaatattactaggtagttgcctaattttcattgattgtctcttgactctcaatcttatacatctggatgtttttaactctgttattttctttgtctttggaaagagtgtggaaagaaaagtttgaacaagctgaaaaaagaaaacttcaagaaacaaaagagttacaggtattatttcaactttctaaactgattagaaaataaaagaaatatgccaagaaataaatattgccaatatgccaatgcatgtaaatttaatgtttcaaatacttactatatactgactctgtacaaagcaataccgtaaggaaaattaatataaagaaatgttaagatcaagactggttgcttagagccagccc

SEQ ID NO: 57770 - DNA, 1029 bp, Homo sapiens
ggaaaagttattaagtattaactcagctgcatttaatacatctgggattgtattgggacccatatacacccacatataaatatacctatgcatatacatatgtgttaaagtatatcttttggtattgtgacttagacttgaatattaagatgctaaggtgcttcattgtattaagaaaaatcatactttttgttaaaattaaagcattattttatttcctgtccttcaagaatggggaaaataaaagattctgggagaatcaataaaataatattcatgaattagtccattgtgatcttcagcgtaaatatgtaattgaaatgttattgttttatgagaacaagagtataatcatcagtaaaattgattttgtcttttcacttcttaaaaataggaacattgtcagttcttacgctgatatccaggtaagattgattttgttttcttttcactagatagaaagagcataatcctaaatatttataagaatattttttcttaattgctgttttacaaataaaaggttagtttccttaatttatcacaaaccgattttgttaagttttaatcaaaataattgctcttctttattaaaaatgttgaccttcatgtaagcttagagttatggaaacagccttttaaagttattatttcctgcctcagatttctatgacagaaaaaaaggcaatgggaatacaaattattaaaagataaatatttactcatttcattttataaattaattacaaatgtgtatatgttatctctcttaatttttatatcattgagttacagtctgctgatctgaattacaaatgtgtatatgttgtctctcttaatttttatatcattgagttacagtctgctgatctgatcttccttccttttttcttataagagttggctagaattgggaaataaacaaagagctactgctgctactggtatgaatgataaaagttcccgatctcattcagttttcaccctggtgatgacccagaccaaggtattttttttaaaagttcccga

SEQ ID NO: 57771 - DNA, 1014 bp, Homo sapiens
gtaatcccagctactcgggaggctgaggcaggagaatcacttgaacccgggaggcagaggctgcattgagctgacatcaggccactgcactccagcctgggcgacagaacgagactgtctcaaaaaaaagaagagccataacaaattactggttccctaaagaggtcctttcaaaaccctttccagagtggtgattatcatcatcattgtctccgattactatatagtagttataaatgcagtgatacattagatttgattttgatggcaaaaaatctctctctaaaagtggttgtgggtggggaagacacagattaaagataaggttggaaaagatggacatgacaaaatgtgaatgtgacaaaatgtaattgttttaaaatattttaatgtagttgtttaaaatattttaagggacagtgaaaaacttcacagagttagtagtgtttaacttgaagctgtgtatctaagcaagttagaagaggatttggtgaccactgcatcagggcaggaacctccagtttgaacctaaggggtcagtagttaaaggcaagttatacagtactgtagaatctttttcgtgcaaatgggttagtattaagagggagaactgagggtgagttggtttgagagaattggaatgtctaatagagcctcaagaaccatgataggaagagaaacaatagaaagagctggtagggacaaaatgcaagatggatgactatactgaacttagtaagggaccaagtgcctgattccaaactcatcagacaagccttgaaagcagggccagggtagagtacttgtcaaattgatgaggcaggtgttttttccagaataaattctgatttaaagcagtctcagagtcagggatggagcggggagggagtgtatatctggagccagacaaagagtgatgatgtttttctgtagatctaaagtaaatgaaagatttccacctaagtctcaaagggaaaaaggatatacagaaagattcatgattttaagggagag

SEQ ID NO: 57772 - DNA, 1339 bp, Homo sapiens
cactgctagtattgacatgtaccaccgaaaagaaatgagattatgaactattttggggttagtacagacagctgagtgatttgtacatactcaacattcttattgagatcacctaatacctctctgtaaatttgttgaaaagtaagtgacttgaagcttttcattatccattttaggaaaatacctacaagtctacttggaggaatccccagcattttcaacaggatgtcagaatgaccttgggctatgttggcaaagcacaatgggaagaagacaaccaattgaaggtcaaactaggccttaaaaaaaattgttcttcctaaatgaaactttatgtaagacccaagcttcctttatgtaaaaataggatactcactaggctttggggctgacaatggtttttaaatcttgctaatcttccctggaatgaaaccagcatgactcaaagagaaaaagagagtctataatattttctaatccctgagttcttttctttatatattaaaaaggattactaggctgggtgtggtggctcacgcctgtaatcccagcactttgggaggccgaggggagtggatcacctgagttcgagaccagcctaaccaacatggagaaaccctgtctctactaaaaatacaaaattagccaggcgtggtggcgcatgcctgtaatcccagctactcaggaggctgcggcaggagaattgcttgaactcgggaggcagagccaagatcgcaccactgcactccagcctgggcaacaagagtgaaactctgtctcaaaataatattaatgataataataataataataatagggattacttgcataattgttcttttaaaattattggcagtattgctgaatgtatttagattttttcaccaagtgacaacaactgaattcataaagattcatcaacaagacctgataaaaaaaaatgtaagcatattatagtggatacttccaagactcttggtctaacatgtattagaaagcagaaggagcccaggcacaggggctcccgccggtaatcccaaagctttgggaagccaaggcaggtggatcgcttgagctcaggagttagagaccagcctgggcaacatggtgaaatcccgtcaccacaaaaaaatgcaaaaattaactgggcgtggtggcatgcacctgtagtcccagctactctggaggctgaggtgaggggaatcacctgagccgggggaatcacctgagcccagggaagttgaggctgctgtgagccatggtcatgacactgccctccagcctggacaacagattgagaccctgtctcaaaaaaaaaaaaaaaaaaagaaaaaagaaa

SEQ ID NO: 57773 - DNA, 1085 bp, Homo sapiens
tttatattcatagtgcatcctggcctgctgaacatagcacagaacactggtgagtccctgtagttggtggtgagtgtgggtgtgcatggaagggcagacatttggcaataagtaagggaaaaagtgatgatatttatcacgatttcatgagcatcaagacttcatttttgtgctcattaggtctttatttcacaaaaggaagcaaaatctcataaataaatataaaaatttttatttggttgaaagagcaacaaagtagccagttaccataaagttttatgctttgttggaggagcactattttattatttcatttaaaataagtatgctaaatagtaaaatggtaattatgaaaatgaaactgtgaatttcataaaactgttaataatagcaaataatcatcagttaagtatttaggggaccagttcctatgcttttaacaatatgaaatgaaaataacaatataattatttttaaaataatgtagtcaatgaaagtagaaggtgagtaaagaaacaatcaaagatcaaagaaggtaagaccataaagcaatgaaccaaactaaatgaggatgactgatactctttttgattagtttttttactaacactaatagttagggaaaaacaaaaatatatggttagatggagctgcaatggactgatgaaggttgaagtaattgcactctcttaaatagtctctggttattatccacaatttaaagctactggagaagctaatgattaaattacttctaagacaatagacttagaattcctttcttactagttaatagacacagtttctctgacaaatgaaaaggagctattgtagatcagaaatcatttagtgattctttaaggagcaagataatagctcaaacttttaaactgtttaacaaaggtaatgaataacactgctgtaacatttcctgggtatcagacagtgttctaactccttttttttaaattttttaatttttgagatggaggctttctctgtcacccaggctggagtgcagtggcacaatctccattcactgcaacctctgcctcccagattcaggcgattctcctgcctcagcc

SEQ ID NO: 57774 - DNA, 1013 bp, Homo sapiens
gaattgcctcccttaaagccctccaggcttctccctggtattagcaatttagcagtttcttgagtgtatatacatataatatttttgtagcataaataggtatcttgttacacataatattctgtaatttgcttttttttaacctagcaatcattcattatttaataaagggctttctgatcatttttcttgacagcatagtgtcatatggatctaccataatttagcaaatcccctactgatgaatatttagaatgtatatagctttttgctactattaataatgccaataataacaatctttgtatatcattgtaaacatttagttgcacagtttataatttagtataaacatatttttccagttctcttgacattgtggtatagttttctatttaggaatttttaatttttatattgttaattatatcagtcttttttgggggtggttctgggttttaatgtcaaacaagactaactttaatacaattttattttaggctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgtgagtagtaaagcagttaactatgttttatggattgtgtttgcatttttcacagctcttaagagaatgattttgagattgaactttcagggaatttgatataggtatttactaataaattgctttacctaccctagaattctatgagaatcaaataaatagctatttgggaaaacatgttggatagatacagggttgggttttcttttccttatagaattatatttaaatatcaagattattcctaaggaatatgttctc

SEQ ID NO: 57775 - DNA, 1037 bp, Homo sapiens
accatagcaatcaaactgcctacaaggtccttcctggtgccttggtgcctgcctcagcctgccccattctccccattccttaccatttagaaacttcactggcctcccagcctcaggaatgtcacagatacttttctccttaatcactcctcaccttgctcatgcccactcatcctttaggtttgacctgtgtgttgggtaggactggataggtccctccagttatggcttagtgtatttatctcatgagtactttctggttttatctgtttcttcctttgtattacaagtttcatgagagcagagactatgtctggcttattcatcactgaattctgggtgcttaacacagtgtctggtacatattagttgctcaatcaatatggaatgaatgaatgaaaatagctattactgatttttttaatttgctttttctcttttatttaggttatcatagcaacccctgggcgacttctggatataataaagcagagctctgtagaactctgtggtgtaaagattgtggtagtagatgaagtaagtagtggtatttaaaaaacagttacatgattttacacaatttatggaaagtatagttatataatttcattgtatgttcagtaccttttctctctctcaaaaaaaacctcagggacttttaaagcattgcagcaggttcctgtgtagcactgaagctaacataatgtgtactacactaaaattaaaccagagctgtcttttcctaattgacagaaaacacaaattcaatatgtactctattctcaatggtaagttgtttttttttaagcatttgatgcttactattatttgtttacaaaaatagtcagtgtcaagtaatgagacagggtcttgctctgttgcttaggtcacccaggctggagtgcagtgacggaaacacagctcactgcagcctcaacctcccacactcaagtgatccacccacctcagcctcctgagtagctgggactacaggcacacacatcaccatgcctggctaatttggtttttgtagagat

SEQ ID NO: 57776 - DNA, 1335 bp, Homo sapiens
gctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgaggtaagtgttaataatagagttcacatgtattattcttggaaacaagtgaggtatttaccaagtttcatttttaactatattaaaattgcagactaaaactaaatatttggaattttagtcactagtgcctgtagtgattttgcttctgatagtagtttgtatgaaaacataatttcagggaatttttcttgtattatattgaaccagagatctctttattgacgatctaaaaacttgcttccttacaaaacattttctttttaacagtttttctattaacagaatgagctttggatttgagggggaaaagatccagctgaccagacgagctacagtttgtgtgtcagttttgtctccttggattttgtgttttgaagaaactgatttatactgaagttggaacacatagagtttcaaaatatactttttttttctttttctttttctttttttgggaccgagtttcactcttgtcgcccaggctggagtgcaatggcacaatctcggctcactgcaacctctgcctcccaggttcaagtgatccgtctcccaggttcaggttcaagtgattctcctgcctcagcctcctgagaa

SEQ ID NO: 57777 - DNA, 1396 bp, Homo sapiens
ggatatcaagccccttccttaggcattgtcttagctcttgccaaacttttgcctgtgtgtctggtacaagcagccagttctctgcaggagctgactgggtgcctccttctttgtgttcctctttactctggagtgctgggccctggtttagcagatgtccccctccacccttggttcaaatgactgggacaatgatgagatccttacatgggtgctggtattgataggaatacctagacagtaggaaaaaaacaaattacacagagtcctgccctcaaacaagagctgatggagacccaggaactggagaccatctcctaaacccctactacttctgccctctggtgcaccctatcttttggctttcttccctctttcgtacttcccttcttccctctcttccattcactcttccctgctcccctctggcagacccactctgtactcctcttgcttgtcactgccactaccacgaccaccagttgtctctctgtcagcagatgtgccgtgttgcctctctgcacagtaccatccctgcattccacagaagacttgggcaagggtgcctgagaggtacccagagacaaatcacgtggcagccaggcagccccagagcaaagatattcagacagatgaaagtctccttacccccatttcttccaagatcagaacagcttgacatactccttcatacacagtgatgccaggaaggcaggggaggcgtgggaagtcttccttcccagtacctgcaaaatgtctgagcattatgttgatttttttcctttattaaaatgtactgtttaatcttataagaacaatatgcctgttattttatagaatgtctctaaatttggatttgtttaaggtttctttattcaagtttgataaggttcaagttatagaagcctggtagactactgcagaagagatgttgtagtctcagtaaatcatatcaggggacacataatgtttgttccagtataggtgatgttaactttgatcacctggtcaaagtggtatctgtagttttctccattataaaattatttttccactttaaattaattagtaatttatagggaggtaattcaaaatatcctgttcattaaactgttacccaccattttagaatccagtaatgatcttgcctgaaccgattattgctgttgattactatcctttttttccatttgtttgttggtattattctaccacaagaaagagctccttttttttttttttttttttttttttgagacgaagtctggctctgtcgcccaggctggagtgcagtggcccgacctcggctcagtgcaagctctgcctcccgggttcatgccattctcctgcctcagcctcctgagtagctgggactacaggcacccgccaccaggcc

SEQ ID NO: 57778 - DNA, 1034 bp, Homo sapiens
aggttagtggatatgctttaatgaaatggaagcaacccctggactcttgtcttccaccttccacccttttgatcttggcaaatcattattatgtttgagcctgtttagcaagatggtgtagagctataattctgtgcttatcagctatgtgcccctgggcaagatgtcctttcttgagttctttatctgtaaaataaggtaagagggttgtcagaattaaatgacagaatgcatgtttaggactgtgtctgacaagatgttataaaggtcatatatgaaaatggatgtaaaagcagtaagtaaatgctaggtggatatataggtatgatagataaatttgtaatcctgataatgagcatttacttttcacagctaatatttagatgccaaataacttatattagccattttttactgatacaggaaataaaaatccattgtttatacatttgataagttatcttaaaatcaaataattttccttttacagctgttctactaatagtttctgtttatttcctacaatactaaagtgtaaatgaataccagcactatattctgcaatttaaaactgaacttcaccatcacgctgaggcagctatattaaatttaaagctggctcactactgggtagtgcatctacgaagaaaggaaagtgttttcaattattaaatgaggatgatatttttagatgtcaccaaaatcccaaattgatacatccactcttgacctctttccagagtcctatatctccagctgcttattggatatttccacttggatatttttgctattgtttcaaactcaatatgtctaaaactgagtttttgatcttgcttttagaattggtgctgcctctgattttcatttttctattaatgatatcactgtttccctcataacgtaggcttattattgatttccatcttgaccctctttctttgctttattcctgggtactttttgtttgtctttagcagttagtctcttatgtcctatactttctgttttcactactgcctttgaacttcatt

SEQ ID NO: 57779 - DNA, 1058 bp, Homo sapiens
aataactagaatattgattatccagtatgagattgtcatctttcattgatggctccaaaatcaccttatagttaccctctgactttggcatacctgctttgcatacatatcatatgtgaacagtttgcccataccagggacaagcagaatctacttaggtccttatcagtgtctcatattcatctcccccagaatcattcccctagctggacactccagcttgtgattacttctgcttccgttgtttgaaggctaagtggatagttagaaagcacatccatgactttgtgaagcagtgtttgtttagttgctgttctttcagatacagatatatatgtcatagataacctacttatccttagagtgtctatttcagatcctctaataagaatgaaacaaatttaacatgttttctacatttttttccagtgtagtttgtatgtgtgaaatacttggacaattaattttaaaatgaggggtttggtagactgctgattgtgttactcatgtttctttcacactttattgatcctgctgatagctttgaatgtattttaataatatttaaggaatggagtttaaatgacttagaatctttttttttttcttagttggagtctcactctgttgcccaggctggagtgcagtggtgcgatcttggctcacagcaacctcagccttctggtttcaagcaattcttgtgcctcagcctcccaagtagctgagattataggcgtgcatcaccatgcccagctaatttttgtacttttagtagaggctgggtttcaccatgttggccaggctggtcttgaactctagacttcaagtgatcctcccacctcagcctctcaatatgctgagattacaggtgcacggcatgggcaacatagaatctttatctctggttctaacttctatttgtggattgttagaacttgagaacttcaggctgggtgtggtagctcacgcctgtaatcccagcactttgggagacaaaggctggcggatcacctgaggtcaggagtttgagactagcctggctaacatggcgaaacccc

SEQ ID NO: 57780 - DNA, 1042 bp, Homo sapiens
agacagggtctccctctgttgctcagcttgaagtgcagtggcatcatctcggctcactgtatcctcaacctcccgggctcaggtgatcctcctacctcagcctcccaagtagctgggattacagggatgctcactatacccggctaattttttttgtattttttgtagagacagggttttgccatgttgccctggctggtttcgaactcttgggctcaagcgatcctcctgcctcggcctcccaaattaagaggattacaggtgtaaaccactgcctgtaatctcatgattacatcatgtgtactcttgatagttactgtttttttcctgcttacatgtctttgatggctcattggcaactccattattagtgaaccaggcacatgaagaaatttcctaatttatttcctttaagtgttaattgatataacattttggggggaaaacataaaaataaatgattacagtgaagtttgaagattatcttcagattttattcattattgtaataaaatgattctgtaggctaatctgatggccatacagtgactgtataatgccttaagtaataaaaacactaaaaatctttagagcattgggaaatttttagagcagtttgatatacatctcatttgatgccgtgtgtggtaagaaatgaagtattatcccacatttaacagatgaagaagatgaggctgagtgaagtccattgatgtcctaaggtcagaacttactttttaaaaaatcaactttactaaggcataatttacataaaatgtacccatttaaagtaatttgaacagttttgacaaaggtatgcactcttgtagataccactacagttgagatatagaacataataaccccccaaaattcccttgtgcctttttgcagtcagcccgcagccccaccccacttcaggcatccattaatctcagttctgtcgttgtagattaatttttgcctgttctagaatttcatatagatgaaagcaaactgcacgaactctttttttactagattcttttgctcatatttttga

SEQ ID NO: 57781 - DNA, 1038 bp, Homo sapiens
agtccaaaaactaagttcattttaggatttttttttaagttctatgtctaaatctgatacaagaatagtaaaagccatgcagtagtagatcttttatcttaatttatgaggctaaaaatttcttataacactgaaaccctttcctttctttaataggtttaaccttcatttctaatacataaatgtaatttatttttgcttagactccactggttggagatgataaaaatataacccttgtaacacagatatagaacctaatggtggcctttggatgatacttcagctctcacccagtaaagtccctgggattccacattccccaaatccttttcttttcattgaaatgccaagtagccctcctgctttttcttccataaccagccttcctgctgctgctcttagatgtcatgctatgctctgccacctggtggttgcaatgtacactgctgtttctgttgctgccgcagttgcctcctacaaggtgcagaggttgggatttaagtctgcaggtgtgatgttcagtgttgtgggctctggaggcagatttctaagtttgaatccctacatcactgcctccttgctgtgtaaccttggacaggttatacagttttcttatctgtaaaataggtagagtaatagtgcttaccctcacagggttgtttcattaaattaatacaaatgctgagaacattacatactgaaaacagtacatgacagaaaacagtaaaatgccaaaaacagtatgtgacacttaacagtgttagttattgttattattctgatctgaatgctttaggtaagcaattaaacgtgtatattttatttggagctatcatagctccaaactgattgattttagccttgagtttattttttaatgttgatcttttctaaatccattgtgtatatactttctgttatacataatttttaattatcactatcatattgtaaagttaagaagtaaaaaaaaaaaatcacactaaaatgtaagagttcttaaagtgagtgaatatcatatggaaataaccacag

SEQ ID NO: 57782 - DNA, 1050 bp, Homo sapiens
tttaactgtggcattatgactgccctaaactcccccatgatcatggatatgtctgaaatcataccttaagaacttgattcacagtgttatttattgataacaacaacattaattttagggaaaataactttcatttactagttctaaaatagattgtaaaatttttacttgatattagtttgcttcctaagcattaaaactgacattaccaagtaccttttttcccttagcgctccaaccagttcctgacatacagtgtctgctcaacaactatttgataaattaatgaattctagaatatcaaataagtacccataaactatttttttctgattgtgaagctgaaattttctttatttgagtgagactgatatttgacatcagggctctgactataggcatcttaatgtgtgttattttattgttatatttgaatgtaaattcaaaaaaagaataaaaattcaaactgatatttttatattttaaggtaaatgaacatttgaaagacataatggaacaagaacaaaaactgaaagaacatcacacagttgaagctccaggaggtcaaaaggtatttatttcaaaaacaaaaaggtgcctttatgagactgtatatatgttcacatatttgtattattttgggaaatgttaattgtgtttattaaattattttttagtggtgttaactgtaccctagaaagccatactgtaaacactaagtaaatagaagtacaaaatgaaggttaattggatgatggtgtttgtaaaaaaatatattaatgactagaactcaagttctgaggttcttttgtcaaaaataacagtttgcctttctttggtaaaatgtgtaaaacaacaaggaaacaattttaaatgttcaggctttataatgacatgcaatgcagcaagaccaacatttaaaacaaaattcccagaatttcactgggtgcgatggctcacgcctgtaataccagcactttgggaggccaaggcaggcagatcatgaggttaggagttcaagaccagcctgacaaacatgatgaagcccca

SEQ ID NO: 57783 - DNA, 1050 bp, Homo sapiens
tttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatg

SEQ ID NO: 57784 - DNA, 1049 bp, Homo sapiens
atgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccct

SEQ ID NO: 57785 - DNA, 1359 bp, Homo sapiens
ataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacat

SEQ ID NO: 57786 - DNA, 1785 bp, Homo sapiens
ttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagtttcactttgattttgctgattctacttactcagaacagagtaaagaaaaaggtgttttttaagaaaaaagagatctgataacaaaactataaaataatcgtcatgcctaattatatacctgaagaaatatctggttagtagacataaatgtggttttctagcttgggacctttttgataggttctgtaacttcagagcacagctatatttccacaatatttccagtactttaattttcagaaataaaaatatttaacccggccgggcgcggtggctcacgcctgtaat

SEQ ID NO: 57787 - DNA, 1325 bp, Homo sapiens
atgaggacctcaaggccctatcaacagaactgatgtctctgcaattcaaaattcactatttatttatttttttagagatggagtctcgctctgttgcccaggctggagtgcagcagagcgatctcagctagctgcaagctccgcctcctgggttgacgccattcttctgcctcagcctcctgagtagctaggactacaggagcccgccaccacacccggctaaagttttgtatttttagtagagacggggtttcaccgtgttaaccaggatggtctcgatctcctgacctcgtgatctgcccgcctcagcctcccaaagtgctgggattacaggcgtgagccaccgcgcccggcaaaattcagtatttaaagaattaatgtggtatcctgttggctgacaacgtaagatagtctttttttttttccatacagcaagtcttttcatttttattactcaaaaaagcttcattttttatttagctttctgactctgcttgtgccttcaacactttcacaacaattttctgctccttgataaggaaagcacgcttgatcctgtcacaaacacatttagcacacatggaaccaacataggccctgctgacatgtttctttgttttggacaacctcataagaactttaggtcttacagcacaaacccttcaaagtctgcctgggcacacgccacacgcagattttgatgctttcccaaccttcttggtataaaggtaaacaattctattaccaggggttcgcgtagttttgttagaggctgtattgtaggaaagcctatgacagtatgtcaaatgctggaccattctgagtgcctgtagacaagttccccaggaagagcagtcttaagttctttatagagttagttttagtagagttagtaccctataaagtacatgaattctcttgatggacaagaggctcttactgttgacaagacaagggcgcatctgtcctttactttcggttccatacctctaatacagcacacggtatatccgttgtttgtaaaggtctaatggcatccacttcaagagttccttgatggaagagaacttacctttgtgacctacctagcccctttcatctaataactgtttcctagataattctgattaacctattatcagaatttgttttcaccacttttgcagtttttccattctctcatctttatgaatctagatattaaacagcaggtgagcgtaacaggctgattttagctgttgtgttgatgatggttaacagtcttgggcaagagaacaaaatccactttaaccacaagttctgagttttctaccaatggtgaatac

SEQ ID NO: 57788 - DNA, 1084 bp, Homo sapiens
atgaaatacctccggggagggcaggccgcagggaggctcggggggagggaagatggcctggacaaacaggtcctgaagctgcgaggctggagtggagggcgcaggggcaggcgggcggcgccagagctccatgggacaggtaagcgggaaaacttcggggcacccagtgcgggtgaactggggcgggggatcgggcccctgaacccacggtcttcagccttagcggagggtgccctacagggaatggggtaattttttcaaaggggcaggaattctgagttcctaccaaaaatgcacatttccagtccctcaacctttctccttcgaccttcttcgtgcctgtggatcttcctggccaggttccgggaagccagaaagcagccaaacaaaaggagcaaagtctcgggccagcctggatgtggagggcgcagtgggggaggggagcagggtggacaggacaaaggggctttttagagaaagcctagaggtctcatttcagggcgcattccaagctggcttggagttcccctgtcccagcccacttcacctttgcttagtggaggcgaacacctttcctagtgagcagggagcagacgcgagtaagaaaacagtgaaggaaccatctcctacccctcttgcctggagggtcccgggctatttcacttcttccttttttcactgttgtctctagcgctggccattgattccttaattcttgaagtaagattttagcagtgcctgagactactttgctgggggctgttggggatgtgaagatggtaggacgaggcccttgctttaaagaacttccaatctggtgttatcagaagaccctaaaagaaggaacttttttttaaaaaaaatggagagtggatggctacagcgctggggaagagttttctgactcgggacttttcctcaggaaacgaaaacactgaagaggtccagtttctcttccctggggaagggctcttgtctgcaaagatcagattccaagtactataatgttttgcaaggaaataccacttcctcaccaactggtggtctggacggcactctggggtttggggctggggcatcagtc

SEQ ID NO: 57789 - DNA, 1052 bp, Homo sapiens
caggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaa

SEQ ID NO: 57790 - DNA, 1020 bp, Homo sapiens
tgggtccttccatcaggtcctctaccttaggccaagacggcatcatttctcttgttagaatttccgggcgggctgggtgtggtggctcatgcctgtaatcccagcactttgggagtctgaggcaagaggattttgtgagcccaggagttcaagaccagcctggacaacatggcgagaccctatctctacagaaaaaaaatttttaattatccggctatggtggcacgtgcctgtagtctcagctgctcgaggaggctgaggtgaggggatcgcatgagcctaggaagttgaggctgcagtgagccatgtttgcaccactgtctcaaaaaaaaaaaaatagaatttcccctggctcccctttatgtgccatgcaatttgggcaagttgatccaccctgttcttcttttcccagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttgtaaggatgggagcaggaatgtgggttggagtggaggtggagttgggtctgggcctcactggactcttctgttgtagccctaggcaatctcgagccacagagacgtccccgctgacgagaaggaagtcctacgaccgagggcagcccattaggtgagatcatgttctagaatctgctccagagtcaccaccagtctagttcttggttacatgagtggctatgatgttctgctctgttgatcatcttgtacacagtgtaacctgggccagcttgactgagccattcaggttcacccagtggtcccttccccaccctgtcaggtgtggactgaagaaatgggccaggcgtgatggctcacacctgtaatcccagcactttgggaggctgagatggccagatcac

SEQ ID NO: 57791 - DNA, 1055 bp, Homo sapiens
ccctcacttccccagaaccacccctaacccccaccaggagccctggtctgattccagtgggtgagatataggagggagaccatcatccctcccccgacacttggacagggcttctcaacccctttccctccctcccgccctcccacagagaatggctacgccagcacagatgaggagatctcagagttctctgagggcaggtgagtttgcaagctgggagtgagaggctggctcacagcatgtacctggggctggtgggaggagttgccataggtcccagggctgagcctgaatttgggggctcctcaggatcctgaactctctctgcttcttcctcagcttctcccagtcattcaccatgaaaggctccaccagccatgacgatttcaagttcaaggtgagccccgccggaagtcaggcagtgggtgcagcagggccagcctccacacagcctgttcaccgcttactgtggctctgctccaccctcagccacaacacaatgttgtccccagctgggagggaggtgccaagaaaatttagtctggaattgggggttgtccagatatgtaacctgttgcagcccattccttctgaggtgggtggaaggtgggagaagtggctggagccaccgctagcctctgttgccaccctgctagcaacagcaccataaccaggggccctgctttcaaaaatatcccctttcccccacccatgattctgcctcacactctaagtcaaaacctacctctaaatgtctggttatcttacgtgcacacagtcaattcaaccatatgggagtcaaaaataaggaagtttacctaataatgagggatcagtttcattagactgaagcaagatgcagggtttattaaggagacaaggagggaaaaagcttcagactgggaatagcaaattatgcatagttttgaggtaaactgattagctggtgaccagcaaagaagtcaggctgggcattctgtgtttacatagtccaactaagggccgtgaaaccatttcagttgctctggattctccagaaaccataagagtttagc

SEQ ID NO: 57792 - DNA, 1008 bp, Homo sapiens
agactactttttctatgtatgagattatatatattgctctaagacttccctttttcatttagcattatgttttataaatctttccatattaaacctacttctggttcacgcctgtaatcccagcactttgggaggccacggcaggagaatcacttgaacccaggagtttgagaccagcctgggcaacatagggacgcctagtctctacaaaaaatacaaaaattagccagatgtggtggcacatgcctgtagttcatgttacttgggaggctgagatggaaggattgcctgagcccgggaggctgaggctgcagtcagctgtgactctagcctgggcgacagagcaagaccttggctctaaccaaaaaataaaaatttaaaaaaacctacttctcttcatcttctgccatggtgtcccatatgtgacaatgatgaataaatttattatagtagccttctagtgatgggcatttaggttgtttccagtttcttgctattgccaacagtgcttgtatacctctgtgcaaagtattttttctatagatttctttttggaaaaggcccatatgagctgccctattagaggcacagatataagagcagtagtatcagtggtgttgaagacccttgctgctatttatcttttttttttttttttttctgagacggagtttcgctcttgttgcccaggctggagtgcaatggtgtgatcttggctcaccgcaacctccacctcccaggttcaagcgattctcctgcctcagcgtcccgagtagctgggattagaggcatgcgccaccacgcccggctaattttgtatttttagtagagacggggtttctccatgttggtcaggctagtctcgaactcccagcctcaggtgatccgcccgccttggcctcccaaagtgctggaattataggtctgagccaccgcgctggcctatttatcttctttatcgcacccttcttcccgccgtcccactccaggcgatggcaatgaggccat

SEQ ID NO: 57793 - DNA, 1153 bp, Homo sapiens
ggttacaacaggggagacctgctcagagcagggaataacatgttggacacagaggtggaactggatcatgaaaggtttagataaactcatgtatgccacatatggctttttgggagaacagagtcctttagagcacatcccattcttaatccaacacatggtctttatatcacacacccttgatgcttctgccagaaacccagccctgtagctcagaagggagctatgcttgactcttgcaggactcctgtcagagctggaagggccttttaaagattatccggtgcaaccgctttatctcaaagagaagagaacgggcccagggtatagacacttggtggcagagccaggacagagcccaggtgcattgcagcatgacacctgcttcacctctgcacacctccaaggggtttggatttttccattggtagtaatgaaggtgcattctgtagagttttttgctttgtcagtgtggtccctgaaccaaacaggttggaaccatgctgatctgaggaaggctgggaatgagaggcctgagacaagccaggtaccagcccaggccccactgaggctgagtcagaagtaaagacctgtggctgagggtctagatttgggttctggcctcactaccactatggagatgccactttgcctcctaagcctctttccctgtttttagatgtggaacctatgatctttatcccaccttacgcaagagtgctgttagatgaaagtgggtctactcttcctttgggaatcatgtagttactaagcctgctctggccagcacccagctaggtactgggaatatggagatgtataagacataaccctgtgttcaaggaacgtacatctcctggggagacagcacgaataaagattggattacaatgcagtgcattggcggggggttggggggagctggctattgggcacaggtggctaagctgagagttaaaagatgaggtggcaaagccatgccctcctggtgagagtgtgggtgtggctccttcagagagcagcctggcagatccgtgtggctggaggttgggaaagtgggtgagggaggcgtagcaagagatggaactggagtgaggtgggttgggacccctggcagagcaattgagttagcattggccctaggggctctgtg

SEQ ID NO: 57794 - DNA, 1101 bp, Homo sapiens
aatgatccactttttcttattcaccctcgccctttatgtttccccaatcctacctaagaagttggagaaggaatgtggggaagagggtggctgccaagtccactggacagaggtgcacacacaagtgtggggtctggggtagaggacacacacacacacacacacacacacccatttcccctcatccctctccccgcattcctctaagtacctgctttgggactggcaggcctagacaactttctgtgagtctcatttgccatctggacatttttctatctttaggacccggtgctgcagcttgcttcctacagtggcagtccttgctggatttgaacttggggatggagaaagctcaagagcatagatatggttcacctaacaggatggggaacagaaagttgacaaccttgctagagcctgaaccccctgaaccccaggcagggtctctgcatacttgacatgtgctttcttttccagagttctgaagatatccggtgcaaatgcatctgtccaccttatagaaacatcagtgggcacatttacaaccagaatgtatcccagaaggactggtaaggcattacacgcaggcccctggctgctatacccagttgaagttatgggtgtttactagagttcttggaccctggaggataagcatgctctcccattcctatggagagcctttcaaaggagtaattattcatgtcacagaaccaatttcatagttgtcaactgtctgtggaaacaggatccaggtgtctgaattccagctgagtggtccctggctagaggagtggattttgttgttttgctttgaatattggtctttagtgatgcatacagaatagtagtagagaagttggcaaaggtaggtattctgaccacatgctgtaggatacctaatgcttttgcaaagctgtgttacatgtgttattctgtgccagtcttatagcatccttgtaaagtaggtgggatggattttgctcccattttataatagcagagacagaggcccaaagaaataatttagagtgttgaattcatttctgggtacctcacttttaaaaagagaagaataacccagaattcattcagaga

SEQ ID NO: 57795 - DNA, 1087 bp, Homo sapiens
agcgggcttgtaggttcgtggacgcggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaaggtgagggaggtgagcctgcagcacctggtcacgaccacagtgcacggccaccctgtctacagggctgactcagaggtagccagctgctccttaagcctgcctctcactcacctatgggccatacttcttttagtggtcttccttcaggttcaaggctgctggcctccctaaggatagtgcgggtgaggagtgaggaagggtggggcacagagcactggctcactctgatcagacagatcagtggtggacttccagcaaggaagtttggagaagttatctaagttctccataccttcctttgctttggaccaaagtatgttttgtttcagatatttttggatttgggagtatttgcacataaaaaatgagctatcttggggaggggacctaagtctaaacctgaagttcgtttatgtttcatatatgctgtatatacatagcccgaaggtaattttatacaatattttcaataattgtgtgcatgaaa

SEQ ID NO: 57796 - DNA, 1039 bp, Homo sapiens
gaggtgggtagatcacttgaggccaggaattcgagagcagcctgtccaacaaggtgaaaccccgtctgtaccaaagatacaaaaattagccaggcatggtggtgagtgcctgtaatcccaactactcaggaggctgaggcaggagaatcgcttgaactccagaggcagaggttgcagtgagccaagatagtgccactgcactccagcctgggtgacagagcgagattccatctcaataaaataaaataaaataaaaataataataaaataaatccttatcctgagtgacttggaatggtagctgggcagtactagcattttgttgaaaggtaattgtgggtcagtactctgttaggtgcattgcatgatttagtaaataattcatataataaagacagggaaggaacaaggatgggatggggattatcaagatagaagatggaaactgagctttttcaggcaggcaatggcaggaagcagggtgcggaggcaccttgattaacaatgggacccagcagcctggaaggatccagaacaaatcctggcacatgtctggccattgtggagtgggaggaaggtatcaaaacctgccactccaggagatgggctggagtgtgagcctcgtccctctggcctggccctgatgaaccatgatctgcccctcccccaagccacaacacaaagacaatagtcccagcgagcctccttgggacaggacagatcgtgccaggctgcccagcaggacaaggggcccttgtgcaggcctcagcttcagatcctgctccaccctctctgcgttggggggtggtcggaagttcagatcttgtgatgggagggaggctgagagtctttctacagggccagtgctggggccagggtcacccagaggtctccagggagccaggggtgaggctgggtagcaagttttgggtttctggagtctgggggaggcaggagattggctgctctgggtggcttcttgtggagcttgagaagtggccttctttgaatagaaaggaacagaagtttcctgaccttt

SEQ ID NO: 57797 - DNA, 1002 bp, Homo sapiens
gcaggagaattgcttgaacctgggaggcagaggttacagtgagctgagatggcaccactgcactccagcctaggtgacaaagcagcaagacgcagtctcaaaacaacaacaacaaaaaaaacgggaaaacaggtacagacaatagctgcctggagttgtacagaaacttgattgggtaaccctggacctttccaggctgtggccagcagttgaccctgcctgcctttcctccattgttttcccatgtctgaccttccctgttgcaaagcagtggcctactacagggtctctctggagggagcaaggaggctcagtggccccattcagcaattcgaagtccctttaattgttttgtgcttccaacctgttttgttcccgttcagatttctctcgccttccaataaaaacttccctgtcctgtgccccagtccctcagagtccacaagaggttcaacttgctcatctgatgtgtgaattacatcacacagttgaatgagaatttgttaattacaacagaacttttataaatatgtcacttactgtatccaattgtacaattgtccatgggtggcttaatcccaccatggcaaataagcgtctgtttatgcaaccctaatcagtgctgagaaagatcagagctcaactagaatgctgtgatcaattggtgatgcctgccatgggctttggaagaaaggtggggagaatggcggcattatctgggggggtgggcgtggctggagagaagagggttgccatcctatataacagcagcttctaaatagcctctaaaatagaatctttgggcggggcgcggtggctcacgcctgtaaccccagcactgtgggaggccgaggcaggcggatcacgaggtcaggagaccaacctggctaacacggtgaaaccccatctctactaaaaatacaaaaaaagttagccgggcgtagtggcaggcacctatagtcctagctactcgggaggctgagacaggagaatggcgtgaac

SEQ ID NO: 57798 - DNA, 1090 bp, Homo sapiens
gtataaggcagaccccctgtgctgaggattgatccacattgatccctcaggtcttgggggcctgggaggaagcagattcctttaccacagtacgtatgcaaaaaatgttttccatgtttatggaaaaggctgggaagtgctggtgtaaaatgcccaagctcataatagatactcctttctccattgttgcccctgctctaactgctgttctttcttgccagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctacgcatcttccccccactgcggtgttcggcctgaaggtggtgggggtgagggggggtttggccattagcatttcatgtctttccccaaatgaagatgccctgcaaagggcagtaaccacacagtttgctgagtgaaattctttgcccacaaagacccagggcttggagcatctctctctttatccttaatctcccaatttgcaacccattctgaagtctccagcctggataggcagagacactaaaaccccagtagacagggccttggtggtcctaggaaggagggcccatagattctggaccg

SEQ ID NO: 57799 - DNA, 1979 bp, Homo sapiens
atccagacagtgcgggcccggcagagcctcgggaccgggaccctcgtgtcctaaaccaccgggcgcaccatctttccttcatgctacccaccacctcagtgctgaggtcaaggcaggtaagcccccgggggactgggccctcttctctccttccctcccttctctttcccctacagagagaatgaggactagcattctacttcagagccggacatcttaggggggaggttcctggggccaactgagggcatgggaggcttgggccagtggccaacccagcagatccggactttcccctgaggcaccaggttggccggtccagaatgtgatccaggtgtgtgagaggaagatggaagccctgggagggggatacctgggtgagatgagccttctttcaagttggttcagccctgactcaggtggaaggaagtagagggaggttggcctgcacattgccccaggctgtgggcctctgctttccacgcagagcagggctcctggacttcggctttctggcagctgaggacaaccgagggtggggacgcggatcgtggaggccgaccctctttccctctaggttgaatgcttgtcataaagtttgagcattgaattgatgtagaaagacagtatctcccagatggcgaaggcaccatcaagggttgcaaatagagccaaggagtccggctcccaaggtggggcctcagtggaaggtggggcctcagtgggccgccttggctggactgggcctgagggatccagctcctcctctacatatgtgtgtgtgtgtgtgtgtgtgtgtgtgtgtgtgtgtgtgtgtatggtttgttgttgttgttgttgttgtttgagacagagtctcgctgtgtcacccaggctggagtacagtcgtgtgatcttggctcattgcaacctctacctcctgggctcaagcaaatctcctgcttcagcttccagaacagctgggattacaggtgcctgccaccacaccctgctaatttttgtatttttagtagagatggggtttcgccatgttggccaggctggtcttgaactcctgacctcaggtgatctgcctgcctcggcctccccaagtgctgggattacaggtgtgagccactgcacccagcctatatatatatttttgagacaggatctctacctgtcgcccagactggtgcagtagcatagtcatggctcactgcagcctcaacagcttcaacctcttgggctcaagcgatcctcccacctcagcctccaggtagctgggactacaggcacacgccaccatgcctggctaatttttttttttgtagatttggggtttccccacgttgcccatgctggtttcgaactcctgagctcaagcaatctgcccaccttggcctcccaaagtgctaagattacaggtgtaagccaccacacctggtccccattcttgacagtgggttttgagccctagggctcactgttaggagagcaagggagctgaaggataggcaactgcgccagaggctgggccactgatgccaaggggtgggggcctagctgtctacctgcccctgagtgccagtcaggcctggctgggccagggaaggagaagctggaggagggcatggggcactggggcagggtgggtgggtgcagcaggatggggtcatgagttgttatttgtgatgtcttaatcctctatgagcagtagggcagggagtggggggcggatttgtggtcaggaaggcccaggggaggggccaggaatagaatctggaagccctggctctcagccctgtgccctcttccccagatgccactcccttcttgtgagaagtaggagtagggctgagaaaggatttagccttccttctagccttaatttttccagtggaaacctagatccttctctccccactaccacctcctaggcgaccttacccgcctgcagatgtcttcaacagtagagagtcctagtgagcctggggccc

SEQ ID NO: 57800 - DNA, 1072 bp, Homo sapiens
ctgacgcctaacatgcaactggtgccactgcgcgttcgccaagcaagcccacccccttgctagcagcgcgctctccaatcgaggagatgcgccttccccctcccttccccgccatctcccccttcattcaaggcctgggggagctgcggttccgagaagcggcagacggcagccagaaggcttgggctgttgagtaagcagccccctctcagtcccggccctccccgccccgcgccctgcgcctccagtgagtgactgagcccccgctgcggccccgcccccggggccctgccggagctggtgcgcggcgcggaggggagggccggccagggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggt

SEQ ID NO: 57801 - DNA, 1120 bp, Homo sapiens
gagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaactctggtgtccaatcctgtgtctgtggagctgggagggaactcaatgggagcaatcaaattagcaggggctttgggaggccgaggcaggcggatcacctgaggtcaggagtttgagaccagcctggctaacatggtgaaattctgactcaactaaaaatacaaaaaatgagccaggcatggtggtgggtgcctgtaatcccagctacttgggaggctgaggcaggagaatcgcttgaacccgggaggcagaggttgcagtgagctgagatcacaccattgtactccagcctaggcaacaaatgtgaaactctgtctcaaaaaaaaagcaggcagcctggtggaaatgaatcaaagtggattcgttcctgctttttctaaggaccaattacttctcagtatcaatgccaactgaaccacactgtctgaagtgacccgaccagccaaacaccactggcttgtcctgtctggtctccacccccaaatctgggcctgggaattgcatggactttggacttggaggggctcagc

SEQ ID NO: 57802 - DNA, 2816 bp, Homo sapiens
tttctcctgtaaagaatctgataatagaccagctgcaggaatgaggggcagaggagggcaattcttagcaaatggggtgttaaatgattctggggttaactgggtgaccgagggaagtatgatgttacaatggaaataacattgtgctgaggcttggtttgtccatctgtaaaatgggagatgaccctagaggccctagcctttgtgactttggcagagagaattgcgcgctgctctggcatgagatgaaggtagggtcatgccctctcagtgccagccccacctgtacttacagtgtaagtcacctcaccccatgcccttctccatgcagagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaattcatagggagtggcaatgatcaatctgtatctctaatataggagaacagaaagtaagggtacgtggatgggctgcagagggtccacaaagccctgaagattatatacaaagtttcatgggaacctgtctgtttcttagaagaagatccatagcttttattaaattttcaaaggatttgtgatcccaaaaatatacattctgtttcatgggatgtggactcccaaaaacccatccaaatacccccagggcagagattttcaaggttcagacctaccagagcctcctaggaggcttttttcacactgtttagaattgccgcacatgcccttcccccatgatattctgacagtagcccccaatcaccaatgcacagtgagaatcactgtagcaaatcaacagttcccaattgagctgatcacttccttcagataggctgcagtagagaagaggcagaactcttgcccctggggtttgcagtgtcagattagcagtcagaaaatcacagaagagatgtctttcagctgtggggccagagaggaattctggagcatcacgtgaggcctgagatagaaaagtgacttggccaagatcacacaacaaggttatggaatgtctgggcctggagcccatcttcatctcttctggattcaggttttggctttcaaggctttttgaccttgaggaatgggataggggaattgatcaagaaatgttaaacaattaacacttaggccagtgttagaatctctactctcacagtcatggttggacagagatggggattagtatccctgttgtacagatgaagaaactgggagtcaggaggattacataatttgcccagatccgctagctaggaaggggctaagccagactcaagcccaggtttgtctgactccgaagcccttgctcttactgctgttactactgttaatgctactttgggccatttagcctcttcaaacccatttccaaggctgcaaaatgggaggggatcctagcacggtgattaagagcttggactctagacagcctgctttgaatcctagttttgccatttattggctgagcgaacttgggaaaatttagccttcctaagcctcagttcttcagctctaaagtgggcctggatggtggaggaaatgcaaagtggaccaagtaatggcccctgacaaataaggcagtttttttttgtttgtttgtttttgtttttgttttcttttggcagaatttcacacttgtcacctaggctggagtacagtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggagg

SEQ ID NO: 57803 - DNA, 1042 bp, Homo sapiens
agctgtacccagctccctgctggggaaggtgggttaagcagccagccctgaggaaagaagaactctgtgatggtggccgatggaacagggccccacaggttggccctgggctgttccctagaatccaagagcacaggggaagctcacggaagccttgcacactttctgacaccagcgtctcctcacctgcaggctgagacttactgacacttttcaccctcttggccccacatgtgtggcccactggaggggagcaatggctggcagaaaaccaccaggtctggaggtcaggggctgggttctggcctggccctgcatctggccaacacgtgatctggaactgttttgtgggcctcggttttccttccagaagcagagaatcattctctatttctgagtggggcaagggggctctgacctctcccctggggctgccttttccctttatttccaagcagtatcacaagggcccaccaaagtggcatctggaagtatgtgtttccaacaaatccagtcttttttttttcttttccccttattggcttaccatgatatggtagaaatttattcaggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttgggagctggtcccggggggaaa

SEQ ID NO: 57804 - DNA, 1061 bp, Homo sapiens
agcgcctgccgcccctgcgccgccgagccagctgccaggtgagtgcgccctgagtcgcgcggctctgcccgccgcggaggggcgcctgggcacgcactcagcgcctcccggtcttgccagccccgccgcagccccggggctgtcgcaggcggggaactgtgagaagtgaccgcagttagcccgggcagtgctgctcttttctggaggcactaggtccgtccccatcccgggccttcctgggcttcctggacacagttgacttccgcgtgtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcaggtgtgagttttccctcttgtgaaataactgcatggaaacctctccactccaaatcttggtgctaggtggtgatggttactgaaacctgaaagagcctgcagtcagtgttttgtggcctcagtccttgaaagctgggaagtgataaaggggctggtattgagcacatttaaagcaaatcacaatgtgttagctaacaatcagccctctgaggcaggtattgtatctactggtacagactagagaatattttgcatgcttctggttctggtgctgttgtgaactaaccaggacccaggaatcggctggagcaatagtgggctcaggctctgcctagagccctgggctccagccacccaccagctgctccctgagagtgaatgaatgggcaggctctccccacgctgggatactatcacagtggcaccgaggaaatccactgggccctggtagaaagtatatcagtatatcatgaagaggtggcttggagtcttggtgggattgtttggaaggcagagttttgactcttggatttgccacttaacgcgcaggtttccttggacaaactatttaacttctc

SEQ ID NO: 57805 - DNA, 1047 bp, Homo sapiens
gcaggtcctgcgaggccgagaccaagtctcggggtaggggaggttggtgcccgagggaggctgtgggctgggctcgggagaggcgctggaataaataacaaccaagatgctcgcggcttcccgggaaggtgtgtgccctttcgacccctatgggactgactgcgcgtttgattctagagttgactctccgggggggctgcctaacttcagtccctctgagcctcagtttccttgttgtgaaatacccacaatttaaagtgcgttgagatcttatcatgagacaccaggtgctgcgttcttatactcgcacccacacggcaagcacacaccctacccgcacctctgcctttcgttgaagcaagagttaactcctcccatcccagcaggagccagaggaacagctggggcaggtgacctcgcgggccgttccagaaaacgttccccgcacccccgggatgcgccgggaagcgccctcccgccaatctcccggaggccgtcctctctggcgcccgcccagtgcgtctgggagcggagaaagtggtcccggaggagaggggagagaggagaacgcagaaattgggtgatcacggggagctcacctgagcgctcccgaggcttgggctctggtccctgctaatccccagagccgataaaaactggtcataggataaagaagcagctaagtttgcagcgggcagaggggaggcaggaactggagaggacgcgagtggcgggtggcgggggcggtgtgtaggggtgacgtccacccggcagagagggttccttgtcccctggagccgaacacaggaaaatcagctggtgagtcaatgggactttgttaggatagtcacagggcgcagctggcgccggcttaagggaagagctggatccccccttgataacatgctgtttatctggcttcctgtttcaatgattgggataccattggctcgttcaaattcaatgctgagaagcctgtgggcacgttcgttcactgtgcaaaagcagagggcttgcctgggttttcatctgtgggctagctcttgt

SEQ ID NO: 57806 - DNA, 1049 bp, Homo sapiens
acagaaacatattagggtcaagacagctatctctgtgatggaagcatctatcaacttttcgagtctctggaacatggagagctaagaaatgtggcaatacttggcaaacacttcgtctttctggcccctagtcacacacaaaaaataataattaaaaacacttttagttccttcttcaacttaaaaatacccctccaactagtctagcgaaaaacaccctccacagtaaaccgtttcctgggcctcatctgttcccttaacctcctgggaaggctgactcaggcctgatttcctccgagaggcctgcgattttgcttcccagcatcctgtgactcttgagacgtgaagcgaggcaggatggctgagacccaggccactctgacctgcctgtggatgtggttcaggttcttacacatgtcctgtgcagttcacactaccaccccatcaaatctatttgctctacttaattttaatatgagatgcactaatatgcatataaaattaaaggctctgatgcatgtgcctctgccaaggaccgttactaacaagatgattccacttcaaaagactgcaagactgttctgatatccaatcctcagatgctctgaaagctttcataaatggaattgtttcttaatttcctttttggcttgtgtattactggtgtgtagaaacacagctgatttttgtgtgttgatcttgtcccttgcaattttgctgaatttattagctctagtagcttttttgtttctggattctttgggattttctatacataggatcatgtcaactgtgaatagaaatagttttacgtctttctttccaatttgaatgatttttatttatttttcttgcctaattgctctggctagaactttcagtataatgttgagtggcagtggtgaaagcagacatccttctcttgttcttgatcttagggggatttcttgattttagcctttcaccagtgagcgtgatgttagctgtgggcttttcataaatgtcctttgtgttgaggaaatcatcttctatttctagttttctaatca

SEQ ID NO: 57807 - DNA, 1063 bp, Homo sapiens
ccataagacagaatgttattctttaatctgaattgagctgacacgtgttgacagacaggggtgtctggccctgcatgtgggaaacacaggtccacgtgcaagactggagcctgtggtggggagacactggtgacccggagccaagaagtgacatgatgaagctgttttaccagcaggacggccctaatggcagggaccacgtctgttctgttcaccgatgggaagccagcacatagcacagaacctagcaagcagtgggcattccataaagaggtgtgggaccaactaatggcttggaagagggagagttgggccagcagatgtactgtcacgttcctgacatgcaaagtctgggctagggcggccctgctggggaaggaaaggaagagccgtgggagagactttttacaaaggaaaaccgaacaggactggatgactgtggaacatgggagggacacaacagagagcagaatccaaaagtcgtgcagtctttttggaagagcactggactgaaagttgagtccctcctgcaccttttggcatataacctgggtaactcatttaacctgtctcagtcttagagtccttatccatcaaatgatcagtttgctagggctgccataacaaagtaccactaagtgggtggcttaatgaaacagaaatctatagtgtcagttctggagggtagaagtctgaaatcgaggtgttggcagggtcatactccctctgaaattagtggagaatttttccttgcctcttctagtgtccggtgctttccgacaatccttgtcatcccttggtgtagagacacatcactccgatttctgccttcaccgctgcatggccatctcctccctgtggccttcacatcctcttccctctgtgtatgtctatgtccaaatttccctctccttataaatacagcagtcataccagattaggagctcactctactccagtatgacctcatcttcactaattacttcttcaatgaccctatttccaaataaggtcacattcggagacactgggaattagtacttcaattatcttttttggtgac

SEQ ID NO: 57808 - DNA, 1053 bp, Homo sapiens
agtggctcatgcctgtcactttagaaggccaaggtgggtagattgtttgagcccaggagtttgagaccaccctggacaacatacagagtccccatctctacaaaaaataaaaataaaaaaattagtcgggcatggtggtgggtgtctgtagtcccagctactcgggaggctgaggcaggagactttcttgaacctgggaggcagaggttgcaatgagctgagatcgcaccactgcactccagcctgggggacagaggaagaccctgtctcaaaaaagaaaaaaaaaaaaaggtctggtaagcaaaccagtgattacaccccagttgtaatagctcaggacagtggggggacagtggagggactgtaacccctggaggggcaggaagggcctcttgggaggtgaattcctcctcctgggcttgcaggaattaagtcaggcaaagactgggttggaggggagggaactggggggccttccaggcaaggggagaaaaatacttggactcttcccctctgctgtcctagccccaaccttagtccaacctgggccagcagcagaggtctaaggaccagccctgccccctccatagaggcttgccaccagtccttggggccctctctggagaaatgcccctctcctcaccagcaaagagcaccatcctccaaatgcctgtgtggaaaacgggtctcaagtgacctctcaatggagagccctagaaaatcattagtgttccccctgtaaaaacaggggcttaattctacgggcaaatatctcaggcaaaagctcagaccagtagactcgtctctggtgcaaaggaggaagatgagtcagccagggtcccgggaaccctgactccatgatcctgccagaccacagggcccccacttaaggcttggagggggctgagatgaaaatgatctactgtttctcttaggaagccctagggaagtccagtttggtgtcaagttgaagatttctatgcattcccacggcaccaactgtgatggtgaaatgccacatttcagccccaatcattcagccagattggattg

SEQ ID NO: 57809 - DNA, 1994 bp, Homo sapiens
gcagtcctgcactgtgcgggaagccaggcagggtagggcggccgaggaagttcagaggatgggaagagcagaaccgtatctgtctctctgtgttgtgtttgcctctgccttgctgggtggtatcaaaaaactctcctattcttgatttaggttccatcttctataaaccacacccctcctcaacaaaaaccaagattcttgctttctctcatgtaactttcatttttttcaggatgtaaaacccattaaggatcttgggtgatagagtatgggacaggctagaatgctatttgatggcaagagcaaaaggtcaataatttttcagcctggctgctgcttcttatggaatcttcttccctttgggttatggaccccttagccagcgccagcttcccctccaccatcagcatatccctcctgccaggccagaacaacttgccccattgaagatcccaaactactagtggtctagccttggccatcctggtgtggtgaccaacaggcaagagcccagtgaccctgcatccggggtgtttggggtgccagagagaagcagaggaggagctggaattggcaatggaccctaggttccttgccagagctcttgccccacagcaggccctgagaaacaggatatttaatgaaatcctgtctcccagtccttcaatgcccaagtcactgttcccgtggaaagacactgatgtttgtacagatgtgcatctctgttgctgcgtggcagcatttttatctcctgtctctgcagagccccttccctgggactgaggagccacagaaggctttgggatctgtggatccttgccatgagccgagacctcccagagctccagcacaatgacgggaaggccaggctgctattccaggccagccctgggtgccacaaagcagacagtgggctcagggaacatagtcagcatttccgttgcatttgccaccaccacaggctttccagtggcgtgcagcagtcgctactctttccacaggtaccagggagtgtgttcatccagtgactggcttgggaccaacctggggtggggctttgatttctgaaccttttctccatgagaccccaagaagcccctgccttgaccacagcttgcctctgtggtgggtgggaccccttgctagtggaggatgggagctcctttgtgagtccttctcttcattttaaagggacagagtcggcagtccctcttgctgctgggacagtgggatattgtcagtcaatgaagtagtcctaagtgtagtaatttttagtgttgtgagaatggtgatttgcaacaggaaacaagaactagctcccagcctaaagggtgatgtgggaaaagaaggtaaacgaatctgccccatcacacatggtgttacgcaaaaacaggatgtgggagctgcacagatctgagttcaaatcctgattctgttacttacttacttactagctgggtaactaaccagggtgctttagtttccttgactgtaaatgaggtaattgtgagaattaaagaagattaaatctgtatagtagctggcatatgctagacattcaataaaagttagtttccttcacttccattatccatgtttctagatttttcttctgagtcctttttttctggacattggaagctccccacagatacagaagtttttccctattaggcagtaggcttcctgggggcagggttctgtctcttccattagtgtaggatctggttaaggacaaggctgtgtttggctgtgttccctactcagcctggggcctccatgagattaggaactgtgccttgcccatcagcctgggaactccctgcaggctggggctctgttcctccatcagatcccccatgttcagggcccttaggcagtaagcttggtcacagcatgagactatcaatggttggaacaaaggcacccagttaggtttaggtttgagaatcaaccaaggagaccaaggaggttctgaaggtattttttattta

SEQ ID NO: 57810 - DNA, 1012 bp, Homo sapiens
ggctccattgcaagggtctctcggtcttcaggctgctcaccgactccctcttctttcccagggtgtctgtttagtctaaaagttcagatgtgcctcatgcatgcgcagaagtttgcgggggtcctctaggtcagtgggcttgaatggcaggtcctagggaggaaggtcagactgggaaggtcagactgtgtggtccaggagcctgaacctctgtgcaaggtggggccttctcagctccccactcctcccggctgcttcctgttagcaggacacccagggagaagcgtgtttccttcctgctctgggcaaacccaggccactcccccagcccctagaacttctgttcagaaccaccagcagccctgaggacagtacagagctgaccaaagtctcatccaggtgtgaaaagccacccccctccagaggtgctcaggcccatgaaggtctgggctgatcttgggctggatcctgtggcagcttcactccagtgcaagtcagcctggccacctcctggtaggcaaccagcagctgcagcagttcacggctatagcatgaactcccctgatgccagggcagcccagagctagcttcgatttatgaatgattttaatgtccgaaattaacatcatcttcagctcttgaaacaaatgactccagggatgtcaaagcacactggtttacccagcaccagggacactggaaaggtgtcatggaccctgaggctgatccttgcatccttcatctcttcactttagaggttctcaaagccatctttctgccatccttcccagctgacatcatataagatgctccaggttgtcaagggtatgtctgcctttaaaaaatgatctagggaaggtacagtgattctgggagtgcccatctctctgcatcactttgctggggctgcacacagagaggggccctgtgatcatgggactgcaggagctcaggaggaagcagttagtaaccccctcatgaggaagcccctcgcagtatccgctggtccagt

SEQ ID NO: 57811 - DNA, 1045 bp, Homo sapiens
actggaagcctggctaggcgttctgttttgcctagaattgcttattatgacctttttttcttttgcagcaaatttcccttcctaatttggttctgtttatcccattattaaagtgggattacataggaatttaactgaagtaaatgatcatcaatgtgtacaaagatctagctgcaagaatgttcttggcaaaattgtttatcacaggggaagggcacaaacaatttgagtgggtaaaagtaccacatatgttaatgatactctggtataaccatctattaatagcggaaaggggaatacctaatgtgcctaatgcacccataaggaattattaacacttcactcactcagtcattcactcatctgatcgctcattccactcacagtcactgagcaccttccagacaaaaggtcctatatgagagagtgttttactcaggttcctcagagatgaggatgtgatcacagattaagggagaagttatgggattcatcatgggatagcgaggaaactgggcagcggggtttttggtcctccaggctgaggcatgtgacaagcatggtgggcttctgcaggggccacagcatctccaggctacagaaccctggatcctaagctggcttccatagttccctgagagcagcattgtgtggtaggccaagttcaagatttggagtcaggagacttggattctaatttcttttctttctttctttcttttttttttttttttgagacagagtcttgctctgtcacccaggctggagtgcagtggtgcaatcttggctcactgcaacctccacctccccggttcaagcaattcttctgcctcagcctcccgagtagctgggactacaggcacgcaccaccatgcccggctaatttttgtatttttaggagagacgggggtttcaccatattggccaggctggtctcaaactcctgacctcatgatccacccgcctcagcctcccaaagtgctgggattacaggcgtgagccaccgcgcctggccagattctaatttcttttagcctttatcacc

SEQ ID NO: 57812 - DNA, 1057 bp, Homo sapiens
ccttctggcaacaaagtctcttagtttctcttcatctgagaatgttcttgatttcccctttattcctgaagaatatttttactgggtataggattatgagttgacagttctttttattttccccccagcacttgaaaaatattgtgccacttccttctgtcctccgtggtttccaatgagaaatctactgtcatttgaaccctttccacctgtagattaaggtttcctgtttctcttcctgctttcaagattgtttctttgtctttaactcgcagatgcttaatttgtgatttctttaggtctatcttgtttggcatttgctcagattcttgaatctgtgggtttatgtctcttgccaactttgcaaagttttcaactattttttcttggagtactttttcagcaccatcctctttcttttctcttaccagaacttcaataacacgaaagttagatcttttgttatagtcccacaggcccctaagaatctgctctgctttttgttttggtctattttctttctgttgttcatattggttaatttctattgttctatcttccagttctctgattgttctccttaattctactgttgatcccatccactgagatcaacacttcagttactgtatttttcagtttaaaattttccatttggttcttctttatagcttctgttctttgttcttcattacccctgggctaggggtaggagttccagctccctgcttggtttccaggggaactgagctgagggtggcttatctctgggtaatgatgaaagttctgtctctccactaggcctcctcttataccacactgtgggaagcaggaagggtgccttattactgctaggtgggggtggaagtccaggctccgcatatgggctccactgataatgaatggcctcattaccaggaggaggggatggaactttgggcttgctactcagccttctctgacaccaccctagtggggttgttgggcacttcatcatggcctggtgaaggtgaactctaggctccccacttgcccttcgctgccctggatgaaagtg

SEQ ID NO: 57813 - DNA, 1045 bp, Homo sapiens
gcaaacaaatagatcaataccatccaagtatttagaacatgaggttttcagccaggagtgatggctcatgcctgtaatcccaccactttgggaggctgaggcgggtggatcacttgacgtcaggagttcgagaccagcctggccaacatggtgaaaccccgtctctgctaaaaatacaaaaaatagctgggcgtggtggcgcacgcctgtaatcctagctattcaggatgctgaggcaggagattgcttgaacccaggaagcagagattgcagtgagccgagatcccaccactgcactccagcctaggtgacagagcaagactgtcttaaaaaagaaaaaaaaaagaatatgagatattctggaggcttaaaggaggtgggagtcatcgccctacttgggatggggttgggggaagaatggtttcttagaggaggtaggttatgcttgagctaaactttgaaagataaatggatttctggatggacacgatggtaaagggcatcccaccaggcaacacagcagctacaaaggcatagaggcatcagacaacaggaggggcagagtactcactgcaggttgttcgtgggggccggtgcatggcatagggaaaggaagacaaaacaggagaagttagcagaggtagggaatggggtagagactggatcatagaaggagttgtttgccatgcttacccttaaaggctttctgagcagtcatcctgggatggacagggcagggagtggagagaccagcgagcaggtttttgttacggttcgagtgagggttgaacacaggcagtggtggtggagatgggttgcagggataatcttgagagagatttaggagacaagattcacaggttggaatggatgtgggagaaaggaggagcttaacgccttggcttagtagccccatctgagaaaatgagcatcagattttgagagggaaagaaagaaacggagtttagctgtgttgactgtgcggagtctgtgagcatcccagtaaggatgtcaggtggacaagtgtctcagtggagaagttaag

SEQ ID NO: 57814 - DNA, 1060 bp, Homo sapiens
tgaacgataaaatgagagaagaggcaaggagcaccaggttggggtgacatggccattagaaagacatctcactgtctgcgatcctcagtcatcgacaagctggttaacaggaccagaggtacagtccgcccttctaacacctatcccaccccattccacacagccactccttcccatctgcttttctgggctggaaaatggggcaaaaagagttctcagacgggcaagaggcctggccgactcggctaagccagcccactggctcctggcctagatgctctgactcctggccccgcgcgcaagcctcacccacccaaacagcagcttcccctgcagcccttcctcagctgggcctgggcacctcgcagcatgcagtcattaacacctgtgtccgaaaaagaaagccaggggttgccagggaccaggaagcagaggattgatggaaactttctggagagaggaaatgttctaaatcataattgtgatggtagttaaacgactgtatacatgtgtcaaaactcattgaatttcatttcatgtaaattatacctagataaagctgccaaaaaaaggaaaaaagtaaggcaggaactacctagctggggagattttggaatggaactgagaggcgggtgggaccctggaaggggataggctgagatcagagggccctggttacatttcctaccccatcgcttactagtggcatggccttgggtgcttaccattcacctgattacctcactttctgcttctgtgaaatggagatactgtcttccctgggcgggcatggtggctcatgcctgtaatcccagtactttgggaggccgaggcagatggaccacttgaggtcaggagtttgagaacagcctggccaatagggtgaaatcccatctccactaaaaatacaaaaattggctgggtatgatggtgcgcacctgtaatcccagccactctggaggctgaggcaggagaattgcttgaacctgggagccgaaggttgcagtgagctgagatcgtgccactgcactccaaccagggtgacaaagcgagaatccat

SEQ ID NO: 57815 - DNA, 1013 bp, Homo sapiens
gccccaggtgctcccagccaggtattgtcctgcctgggctgcaggggctgagcaggcctggcatatagaaggagggtgtgaggagctaggttggcactgggacagaaaataagtgtgtgtaaatgtatgcagatgtatgcaaatctctgcagttctgcagcctgctggctggctctctgggtaggagacccatcgctccaccctgggccccaccccagctgcaacatctccttctggcctgtgaattgctgctgcttgcatctccctctcaagagcatcttctccctctcagcggcattgtccctcttctgtgccccccaagaggtctgggaaggtgagaaagctgaatcgtgagacagggaaaggaagggacatggactcaaactgaggaggacagcacccgaaatgacagaagagggccaccaaacccggagctcttgattgcagcccctactcagccttagatatcaaaattgccacctggatagagcaaccctgctcagggtctggaacaatctaaggaagggcttagcgatgtctttgatgaggcagcctgtgcaggctgcaggctagacaatgcgaggacagtctgcagaggtgtcttctctccctcccctctcaagcccccactctcctctcttcctgaagcagggcttctgtggtgtgggaagctgccccacctgcatgggaagcaccagccacacctgcatgggccattagcattttaaaaagctgcctgtctctcctctcactgcctcccgctagcacacacatccacccatttgccatcagcaagtctttgtggaatcagcaacagcagacacaatcctgaagcagagagggaaagacagtccctgccctgggaaagctcatagtctgctggcaaagggtggggtgggacaacagctgacagaacaagcagaactccatcacccacaggctcctagcaccacccctcattttgttgaagaaacagattcagagcatgcaggtgatttctctagagtcacaca

SEQ ID NO: 57816 - DNA, 1088 bp, Homo sapiens
tgaattcattctttgggaaaagtgtctaggcattaaattgtttaagattttacattatctaccttacaagtcccttggtatattcagaacctgacattttccaaagagctcagaattcttcattcaaatattttaatgcagcttaaacagaaccatgtttccttcattcagcaaacatttattgcatgtttgcattttaaacagaaatggaaatgtgtcacaccaccctacctcctagaccctgcccctttcagtctctggattagggttggagagagggtcatggcacaaagacctgactcatcaccatggtggttagaagttagttcaagacagatttgaggctcaagggtgcgattaggaccaaggacactccgagatgctgcacgccaatgggcaggcacccagcacactctgcagggcctagagctgctgccatggcagctctgccaagggccaggctgggccacccttcaaagcttcatagccaaggaggtgccatctgcttcctagaatccacagacattgtgtttttgtggaaatctctcctccctccctgccacccgccccagcacctcagccttctgcaaagccccagtggaatgcagaagcagaggtcacctgcttccctccccatctccagcctggtcatgcctgacctgcttctccagggaatgaatcttgcagccatcttctcccctgccccatcctccacagccctctcttttcaagggccttggtgtggccttcccagtgaagcttgtctcctctcatccatcacttccctttggacccagagaaggtgcaatcccctgtccgctctcaggagaccctggtctcacacatctaattccatcacatcctcaacctcatccctctctgctatcctggaagagagccacagcagcttcaccacagcccttgctgacttttcccaactgccagtgcaccctttaccacctccctaacccccaacagttctcttcttcctgcattgggtgggccttgggttggacttcaattggaactatggttaatggtatcaggagcgtagggttactggtgtcactactgcaattttcttctct

SEQ ID NO: 57817 - DNA, 1038 bp, Homo sapiens
tcctgggaaatgggtagactgtagaatgtcaaggggtgacaagcatcgggcatcccagtatcctctggggctccctgcctggcgcagctttgcacagaaggcctgctgcctgctggagggcaggcatgtgcacatacccatcagggaggggctggccctgagtggtgcagggcactatcagagaagaagaaccaagttctaagagggttttcttagccccatggaggggcttagagaccaggacatctctaccatgagtgactaccctttcttggtcccacaggttgcaaactgaccagaaacctggccccctctcccagggcagctggccccttgatggctatgctgagcccctccatgagactgaggagagcttctcctgcatgggtaagtgatctgggggagacttcctcctagggtcgggaggccactgtgctagagctgcctagatggaagaagaagtgacctaggctggatgggtccatctcttgacaaggagacatcaacctgtgaattgcactttgagttttcatcatgcttgactcaacccagggttggtccatcaaacccaggagccttttaggggcagcatagggaagtggccaggggatgcccaggctatgggagtcactgcatgtgtgtgtcatgtgagaagtcctgacacaaaggtaacaagctgggagtgagagccaggttctgagtggtgcccaggttgaaaaatgaaggtgctggaattagggaggcaggccagagccatctggcttgctgcctgacaacacttccccttccaggaccacttttaacaggccactcccacacatgtccccttccccgtgtcatcctgtagtcatgagatatcacctgaggctcaggcatgtgagattcaccaggaagatccctaaatttcaaatacagcaatattcaataagggcagagaccctgacagtctcagatgcatcttcaggtgctcagtgtctctgaataaatgaatgatgcatggatgagtgagtgtcttgggtaccataggtcaggccctaa

SEQ ID NO: 57818 - DNA, 1048 bp, Homo sapiens
tcacacggtgggcaggctcatccctgctctatccttgccctgttggtgtagaaatttgtgtccaggcagctgtgagctccaaggaatgtgagttgtagcttagaatttctcggcattcccacccttctggaagctcccccgagacggttgagctagagggcagaccgaggcccatgacctctggctccactcccagcctctagttttctctgcctcattttccccaatagacaggaagacaataaatctctctctggagcccacacacctgatctgtagcccagaggaaaaatccccaaccactgaactcagggagtcttctggggccagagagggtgagccggggacctgcagtgtccacagaaatatctcaactaccaatgccctggagaagcaaaggcagtggctgggctaatggaccaatctaggaagtcttcctggatgaggtcctggaggtgtgagccactcagagcatccatattggaccactgtgtctagtgtctccttttttttcagcaagtgggagtgggggatggggctgaagtcccagctgggattactgcctgggctgtgaggataccttgcccacttttccccctgtctcccagaagtgtggtgaaactatccccatgcctctggacagagcagagatttaggggcagaagagggtctcagccctgaatgccccaaggtcattcctctgaagaactggagcttccttcaaaggagcaaggcaagggtctactggcctcactctggcccagggcttcagggaagggagaaaagatgctgctgggccaccatcccagaagcttggcttccattccacacaccagctgcactgtgtcttgccacggggtattaagaggtcactgctgtttacaattccctacacatctgttccgagtcacgcattcattcatttaatcaatcgtcattcaccaaatatttttgagagcccactgtgtgcacagagctgggatgggttttgagaaaaagttcaactgaagatgaatccttgggaagcaccaataggtgaatgacgaat

SEQ ID NO: 57819 - DNA, 1076 bp, Homo sapiens
cacgggccctcttggggccacggaacaaggacggtggggcctggtgcccaggcgagctgctttggctgcgcggacttgttgcggtggctgggttgtgggtcctccggcgccgagggacccgagcttcctgggtacccggcaggctgcccgcccgctgggggctgggaaggggcgtgccaatgcgcgtgtgaaagggcggggccgagtgacgggcttggcgggtggggaacatgcaagagctcgccgggcggccctggagaatgcgaagccggaggagaccggttcggcctgctgcagtcttcctaggaaccctcgactcctgtgtgggctaggatgagggtcctctgacaggggcaaggatttgggcctttggagaaccgatccttacgcaggaggccgcaaatgggctttgcaggggcaatcaggagactggacaagggcaaaagaagagcagccttttcccctgggagcccctcctgaaggtggggatggctgggtgggtgcggaagctgaccaggcagcctcactctgcaaagggaatgtgccacccggtcctcagtgtggggctgagcctgtcaaaggccctgcctcagtgaatggggcaagagagacaataagggaaaaaattaataaatttttggcaggcaccatggcaggcaccaaggagggatatggacaaaatgcaactggcccatgtgatagagagccctgctgagggactgaaagcagggtgagagaggaagggaccgtgtgtgtgtgtgtgtgtgtgtgtgtgtgtgtgtgtgtcagactgagagagggacttggcgagggagggcaagggagtatcggggcacagaatagcagaaggcacagaacccttttcagggtcaaggctttacttgttggggataacttagctggtctgggtcctctccagacctggatgccctcacactgtcccagaagctgactgcccattgaagccctcttagttgctcctcaagaggagccaaacaggtctgagctggctagggagatgggaggaggggcaggagtggggaggagggcaggtgcagggagggcgagagaggagg

SEQ ID NO: 57820 - DNA, 1052 bp, Homo sapiens
aactagaaaaggaagggaggaggaactgtgggcttaatggcaggtagtgatgagtcctgtctggcttagagagatggaaaaggtggtgaaagaggagatgagatcagaaaaacaggttggggtgggatcatggctgatccgacatggagtgcactgggactcaactgtaggctctgagcagatatttgagtggaagagaccaatcaaagttcgtccccaaaggatccccaaaagagtcctgtgcccgctggtccttggagatgttgctgatcgatgagatcagccagccagggcctctcaagtttcacatctgtctgctccagggaagattattcttgcagcctatgcagtgcccacatgggatggatggagggagaggactccttcagcctccatgcccagaggttggccctctgagagggtaggggcaccccttatcctaactcttagcctaaactcaagtcttcatcttcctctgttcctttggtatgccaccaggctgttccagttgccatgccctgggaattgattaggccctactgtgtgaggtgcagtgctctgccctgaccaagagttgttcctccactgccccagccctgggaagtgctctgctgaaaacagtcccacaacccacagcaaagcttgaaccagactacctatagcagaaccaagacattaaaccaatttgggactagacaggggagcttttcaactgcacgctattcagtggcaggcataagtggtgtggtgccacgtactagctctagctttattgtttgatccaagaagccttcctgaaggagccggaagttggggaggaatttaaaggagttttaaaggaatatttataggaatcagaggctgagcacagtggctcacacctgtaatcccagcactttgggaggccgaggtcgtagaatcgcttgagcccaggaattcaagaccagtgtgggcaacaaagcaagactacatccgtacaaaagaggtttttaaaaattatctgggcatggtggcttgtgcctatagccctagctgctcaggaggcttaggtg

SEQ ID NO: 57821 - DNA, 1005 bp, Homo sapiens
tcccacactctgcatagagattggatttcctgttgaaattgtatctttggattacaatcgtaaagttcccagcttctcaactcaagctgtttgcagcagctctgtgtagcctaagtcatcgtcattactctattgggttctgggagggaagatccggagtatagtggccaaatgcacaagctatggggtcagagagacccgaattcaaatcctgattctgtttgagaccagcctggccaagatggtgagacctcgtctctactaaaaatacaaaaatttgctgggcgtggtggtgcgcgtcttataatcccagctactcgggaggctgaggcaggagaattgcttgaacccaggaggtgaaggttgcagtgagctgagatcgcgtcactgcactccagcccagggacagagcgagaccatgtctcaaaacaaataaacaaacaaatcaaatcctggctctatattaactagccatgagattccgagtcaattaacctccctgagcttcaggttcctcatctattaaatgggtcaaataatatctgtctcataggattgctatgaagattaaatgagataatgcatgtaacacactgagcacagtgcctagcaaatgaaaagcgccccaaaattgattgttttatattactatctcattgttatctacccactccactatgtgggtttatagaggaaggagtcatggcctctgcccttggcagctccctgtcctgatggaggagacacagtgctgcactcgacaacccactggttggttggaggaaacatgggtcttgcctcagggagctcccattttagtggaggagatgagccccagcctgttcttcctgagtcctctattttcctggatccttgctcatgagccgtggtatgccctcagcctgcccctctgccaccagtccacccatctcctcccttttcccctgcagccaggcctgccatctctagaaagcccccatctctcctttctgtgtccttgggccc

SEQ ID NO: 57822 - DNA, 1050 bp, Homo sapiens
accccctcccaagtcatgaaagtcaaaaatgtctccagacatcaccaaatgtcccctgaggggcaacatctctgttgagaaccactataatagaggcaccgtagtatgctgagcctcagcggaaggtgtggtcatttctgggtggaaggaccagagaagcctccctggaagaagtggtctgaggtttaggaagcaaaccaaaaggcagacttttttattttgttttggtcagctttttatccctagagtctaatatggtgtttggcacatagaaagtgcagagaatgctcatcaagtacgtaaacaaacaaatgaatgaggaagggttgaacatgcagaaaatggaaagggaaatgcattccagattaaaggactagcatcagcaaaagctcagaggtggaatgaacaggtgtctctagggaatcacaggcagcccagtccctgttccatggataaggaacagaatagcggcttgtatgaccctggcttaggacgccgtggaatcgccttttctggagatgcttaagaaaagttctgcctgaaggaaaggaaaaggagtggtttatagaactgcccactaattgatcacaactccgtcctgataaacatggccatggtcttggaatatttctcaacacagccctctaagaagttactaccagtcatttggagttggaatgccagttgcacctgtttaactccctgactgtggtctagagacctcatgtcagaactgggggctgctgttctgcttgaagccagcccagaaagggaggcattagcctctcttggtcattcttcacgctttgtgtgtggctccattttccaggccatatctcttttccctttaccctgccccattccttctctgctgttgagctgccttgtggctgagttctcgtctccctgctgtctcacccgttattcaacgagcctgtgttatgtgccctggagatacagccatggacacaccagagttgctgcttgtcaggtgtggatatagagaagcaggcaggcaattacattacaacgtggtgaatgctgagttgt

SEQ ID NO: 57823 - DNA, 1064 bp, Homo sapiens
caagactctgctcacgcctgtccccaggagcaaagccttggcccgctgttcccatggcaaccgccagtcagtgctgagcaaaggagggtgccagaacacggagagctggaggggaccagcagccccctagtcatcacagtcatcactgagaactcccccagttggggtgtagaggcataggggaagtcaaagcaatggctgggaaaccttgagggcaaagggactccctttgttctttgaaggagggaaaggaagtgctgaatggagccaggcagctgatttcccatcgcttctctcatccctccttctgagcctagggtgccccctttgcgtcctctggctcattaaagatagatgaccctggggagggtgagggccggggtcaccagctgctggggcttcttgccctgagttaggctggggatcatttgcagggagaatgcagccaggaccaccagccctggctgcagagggaggagggtaagtctgggaagctggccccagtgggtgatcagcaacatgtccctaagaataggtacatgctattgacaaagatgagaagtgaaccgggagccgtaaatagccaggagcctgtgttctctgggctctgtgttctgtcggttgcttattcattgaaagtcagggatgggcgagatgcagtctccagagtgacgcagtgggacgagccctggagctggagacagagaagctgggttctaatcccagccctgctgctttgtaactgagacctaaatcaaattgcttatcagtctcttcagctgccaaacgaaccaagaagctgcctcacaggattactgaaaggctcacacagcaggaggaatgtgaaagaagctggcacacagtaggcatttgcctccttgcttccaaatgtagagggacagtagagatcgtctgccaaaagggttcatatatccaaaaggcagggttggccagaccctgagtgctcatgtcgcttgtccactgcctcctctggagagcctctggctaagcctagctttggcccagctcttaagttgccccgggaccagcctcttccatgctca

SEQ ID NO: 57824 - DNA, 1095 bp, Homo sapiens
gtcaaacagataacgtatcacaaaggtaacacacaaccagaggcctcatggaggaggtggagcttgggcaggtggggaggaggtgacagggcctgtgggtggaggggaggcattgctggggtgcatgtgaggggacagggcacacggcggctgtgccaaggactaagtagtgccttctgctctccacccagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccgggtaagcgcaggggcttcttggatggcgggggaggatggtggaaagaccactgggatgcgacgccttaaaagtggagtggaacccaaaacgggttttggtttgctgtgctgctatgaaagtacacaaaagtgtgctgtgtacactttgtgattgcctctgaaattcgatgtggtttattctagacttgggtgtggtgtaggcagggcctacatccaaggagctgattggtcaatgaaggcgcctccctctcattggtctctgtggctgtcattctgtcaccctcctccctggctctttgccctcaataaactggctcaaagagccttggaaaagcattttattcccagctcttatgcgaactctgtgtagaccctggacaactaaatctgctttcccatttgcaaaaaaaaaaaaaaccaaaaaggttattaacatcgtatctgtctacctaagaagagaaaatgagagcttgtgggtgaaatcgctagtcaaacagtgagtagcagcagtagctccacttcctttgccaggggttcgt

SEQ ID NO: 57825 - DNA, 1034 bp, Homo sapiens
ctgggaggctgagacaagaggatcacttgagcccaggagttggggcgggggggctacagtgagctatgattgtgccactgcactccagcccgggtgacagagcaagactccgtctcttaaaaaaaaaaacatgaataagtgggctaggcgcagtggcttatgtctgtaatcccagcactttgggagtccagggagagaggatcgcttgagaccaggagttcaagactaggcctgggcaacatagcaagacactgtttctacaaaaaaaattaaaacttaactgggcatggtggcatgtgcctgtggtcccagctactcaggaggctgaagagggagaatcccttgagcccaggagttgaggttgcagtgagctatgatcacacccctgcacaccagcctgggcgacaaagaccctgtctctagaaagttaaataaattttaaaaattaaaataaaatagaaaggtagggtacttattgggtccacagtaaaggaagcagtatgtagttgaagtagatgatagctgttgcttcattgaagataatatctaacaattagaatgctgactccagattcatacacatagccttggctgatgcttctttgtggtgtagggaagaagcactgggctaattctgagatctggagttcaatcctaagcacggctctaacttgctgtggcactgagaaagccacctagcctctctgagtcttagtttgttcatttgtaaaaaaggtaatcatttttgccttaagaggatcaaatggaaaagaatagtaagagtgctttgaaaagtataaagagctgtcagtttgaaatctattattctggttgggtgtggtggcttatgcctgtaatcccagcactttgggaggccgaggtgggtagatgtcctgaggtcaggagttcaagaccagcctgaccaacaacaacatgatgaaaccccatctctactaaaaatacaaaattagccagtgtggtggtgcacacctgtaatcccagctgctcaggaggctgaggcaggagaattgctt

SEQ ID NO: 57826 - DNA, 1015 bp, Homo sapiens
agtcccagctacttgggaggctgaggcaggagaatggcatgaacctgggaggcagagcttgcagtgagccgagattgagccactgcactccagcctgggtgacagagcgagactccttctcaaaaaagaaaaaagaaagtaatggcagtgctcgctttggcagcacatatactaaaattggaacaatacagagaagattagcatgtgcaaggatgacacccaaatctgtgaagccttctatatttaaaatatatatattaaattaaaaaaagagagaaaaagaaatggcaaacaagccaacagataaacatgcaataggttaggtggtgctgtgtgtcataaggaaaaataaagcagggtaaggggcagagagtgatggggtagcgggtatttgagagtggatagtcagggaaggcttctttgataaactgtgcagataactggggagagagctgtccaggcagacagaagagtatatgcaaaggcccagaggcaggaatcggcataagttcaaggaactgcagggaggtcagtgtggctgaagcagagttagcaagggggcaagtggccagaaatgaggtcacaggtagccagaggccatgtgtgccatgctgaggactttggcttttcttccaagagagaggaagctactggaggacttcagggagagggacgatgtgatccaacatgttttgcaaagggtctgtctggctactatgaggagagcagaccacagggacaccaggggaaccaggaagcatggaagggagactgctgcagttagctaagtgagaatggatggtggctcacaccagggatagaagtggaggtggggagaaggttttgaggattaaagaagataacattggccaggtgtgatggctcacacctctcatcctagccctttggaaggcttaggcgggcggattgcttgagcccaggagttcgagaccagcctgggcaacacagcaagactccttctgtacaaaaaattttaaaattagctggcgatgat

SEQ ID NO: 57827 - DNA, 1079 bp, Homo sapiens
gccctgtctgggcctaattttctcctctgtgaaaatgagcggtttgaactagatgctctctaaagtcctttttggctcaaacgttctggattttctgaccacatgaactgggtctgatccagggtacctggcatttcctgcaggaagggcctggaggttgaggaggaaagacagcagccatgctggtctaggaaaggagagaagcgccccacattcatgcatgaggaactctggaagacacaggcattgctaatggtaaagaaatccattgcctggacctggacccaatgtcactgtggcttctaaacctgtggccaaacaaggccactctattattaatctttcttgctgttaatgttctaaagcaagtataatagtacctgcctcaccttagatcactaggttatttgaaaatagaataaactcatggatgtgaaaatgctttgaaaacttctacacagagactggaaattattttcttagacatctgtcaaggtcacgacagatgattccctcaggattcagtagggtcattgggggatctgggagcaggtttttgaaagctgggattaaggatgtggccaggtaattccccattgatcctgccacagtatggaaagggttaattcactgaagtccctctcccaattcctttctctttcctttccctgcccctccattctggtttaattctttctctttttaatcactctgctgtaaaatgcccattgtcctgcttctgccactatgctatcaactaggcctggctaggatgcagaggagtcacaggcccagctatcacccacaggcccagagggacattctctgactggccaaaacttgttcaaggacaggcttttccatctgaggaatgaaatagccttatgattgatgggaacgagaagacatgagggcaggtcagtggacagagttgtggatacctaccttgggaccctaatcctctcaagggtctcatttctggggctcaccaggaaatcgggtatgtgatcaggccccagacaggtgaccctggaacccagaaacccacaagcaagcaacactggaatttagagcacacc

SEQ ID NO: 57828 - DNA, 1095 bp, Homo sapiens
caacaggctgctctcaaatgtgcctgcatccttctgctccaccaatcaagttgaatgctttcctagaattgcatttgctcccaaacctgtttatgccagttgaacttggataatataattattacataaattgatgaaatatgagcataaaaagaaagttgtttccataaagactatattggaagtttcaaaagggaaattgctagcctgggcaacatggcaagacccagtctctccagaaaagaaaaagcaaaattagccaggcatggtgacacatacctgtggtcctggctactcaggaggctgaggttggaggatcacttgagcctaggacgtcgaggctgctgcattgagccatgttcacgccactgcactccagctgagcaacagagcaattctctctccaaaatgaaaagaaaaaagaaaagaaagaaaaggcatgttgctgagttatatgtaggacttgaaaggttagaggagattataaaactctagaggattttgctttcagattgctttatgttgttaaaattttgctccaccttaaagaaactgacattagacttgataatgcactgtaggtatgggtgtgaagactcaagttggaaaagcagaagtgtatcaggaaaaattctattggtcctagtactttgaatgacactgaggttcactggcaactttctgtgtaattttttataacaaagacctaccgctgcaaggattttacatgtaatgagtgcctaaggaaggtatgaaaaacccttccctggaagtctcccaaagcagaaaaacacccatttgcgtggatgacttggtgcatcagtgataggggagaaatgactgaggtaaactgttcatggtatgagagttgaccaagtcagggtggggaggggaggaagaggggcaggtggacttggtgactctgcctccctttcaaacagagcagccctgtgtttacctgtttcatacattgaggacttctggttaaaatgttagtaaaaacgattgctcttcttaaaaaagggcttgcaagccaccagattaggtcttttccatgtctttctttctccaaatctatatgagatctaaataagc

SEQ ID NO: 57829 - DNA, 1038 bp, Homo sapiens
agtggcacaatccataaatcatagctcactgtgacctcttaacttctgggctcaagctgtcttcctttctcacttcctgaacagctgggactataggtgcttgccaccacgcccggctaattttttagtagcgatgaggtctcactaaggctggtcttgaactcctggcctcgagcgattcttctgcttttgctggaattacaggcatgagctgctgcattctgccttctttcagtttctatatttgatattctgtcttgatatagattgcacactattatagttcataccatactctacatctccagtgctgtcatcaaatgacattcccccaaatcagctgaccaggggcatctgccattaacctgggaaactattctgagttcattttcatccagcgaggcacaagagggttgaccccaaagcctaagctgtggggcatcagagcactgacgtctttgactcggaagactaacccaagtctgaaaagaaagacagggctgtccaaagcaaaagcatcactgttgctacctggccagcctagttgcggtggaatgagacatcatgaggatgatgcagctggttcccaggtggttgtggaaagctgttggctgcacccacgcataggacccctcttggcccatccaacgcccccaagagccacagggcctcctgcccccatccatatgtctcagtatggtggccccacttgtggggactcatccggcattttttttcttgtcctcaccatgagggattgatgttttggattcttgcccacgagttgcatagacttcctttacaaagtaaggtctttggggccagatagggtccttgataagttttcctaaagaggaaagatgctagaatgggcagtccaaaaagagtgcctgtcccaccacatgtgaagtcagttaaattatcagtagctgctcttcagctgacaccctgacatcgatttcttttcttcccattctactgcaggcatatgatgttgacattttatttggtggtgatcatatttaaggaagtacactg

SEQ ID NO: 57830 - DNA, 1040 bp, Homo sapiens
atttaaagattttgttgactgaataaggagaccgtgaacagaaaaaagatgacctcctcagcttttgtagaaacactaaagaagacgttggaaagtggacttcttatttaataaagaaaaaaagaaggtgataatggaaggccagggattctggagtgagaaaactgaatatgatacaaagaagtcaaaaagcggggaataatgtgttcagagggaacgcctggcaattcatttggtttgtggtgggaagcttcattccgcgaagagagagtagctcagtggctggaggtgtttatagccagatcagcgtttcacaccagcagtctggcctgggtcttttagagctgccagaaactgctcagagttgcacagatttctcagcctagtagtatgaatttggggcctgattcctatccctttttcctctttcagtactcactttgcgctcacagggtgatctgagatctgaagatgaatggcaacgtcttcgtttaataaagtagacttttatttgttgctttatgcatcaggaacatatacaggccatatacgttctatatcacttcttccaacctgtgtagaagaatttgtgcttctgaccaaaaatggtttttgcttctgtcaaccctacataagtcattccatcccactttaaggcatcgcctacttccagaatggaggattggcaatgacgtacaagcagtacgaatgcttctttttttctttttcttctctattcttttccaacctcttcctttttttctgagtcaaaactaaatcagaggccatgctcagtgattcatgcctgtaatcctagcactttggtaagccaaggcgggaggataacttgaggacaggagttcaagaccagcctaggcgacatagtgagaacttgtctctacaaaaaaattaaaaaaaaaaaattatctgggcatggtggcacccgcatgtagtcccacctactcaggaagctgaggtgcgaggatcccttgagctctggagcttgaggctgcaatgagctgtgtttgcaccactgcatt

SEQ ID NO: 57831 - DNA, 1147 bp, Homo sapiens
ctcactgtgtcctcacatggccttaactgtgcacacacagaaagagagctctctggtgtctcctttttcttataaggacacgagtcctatcagatgagagctccactcttataagatcatttaatcttaattacctccctgaacgccccatctccaaatacagtcactgggagttacagctgtaacacatacacttggggggaacataatttattccataacaatggtctaaatttaagaaactctcttaaccttagggcaaaaattcaatgccagaatcaagaaagcaatgcctaaagcagggtgttaggaggcaagatgataatttaaagaaaattttctgagtcatagacacatttgagaatctgaaagtatgatcagataccagaagattgcacatgcatagaattttatgtataactgcaagggcattcggttctccagaccagttacttttcttttgccactggcaagatggcgtctgtgaagaacaagcacagaaatgcatggctttattctgactgagtggggttctgcctaggtctggacctatggccctattgccaccattaaaaacacttgaacctttatcagaaaggagagtgagctaaagtgggtatgctgaaggtggctagaacttcagcaaggaagccttgaggtgaactagatttagaaccaagcagacaagttttcacacttttccattatattaagaatcatcagaaataacagaagtcctttctctatgggcacattagggtggccttttatattcttggaggtgccatgtccctgtgtttatttgctttaactcctttctaagtgccatacagaactctgtcagtcactataactgagtgacttaaaagaaaaaggcaatggtggaaatctattatttcagcatcgaacagaatgatcaaggtacagtagagcattggagtataattttcttggatgggtttgatcttcaggaaatattcttttttttttttttttttttttcttttttttgagacagactcttgctctttcacccaggctggaatgtagtggtgccatctcagcttactgcaacctctgcctcccaatctcaagcaattcttgtgcctcagcctcctgagtagctgggacgacaggcgcgtgccac

SEQ ID NO: 57832 - DNA, 1011 bp, Homo sapiens
ggtgattaggcttctgattatattcagtgcatgttagagggagggaggagtagaactgataagaagtctttcacagtggctcaagtgagaggacattaggctctgaaccagagcaaaggcaggggaaagttaaaggaagagacagatttgaaaggaaagtggtaatacaatcaatgatgtgttacagtcttgatgaggagggggaggaaaaaggagttgaagacatacctaagtttttgatagagcaatgaggggaaaaggtgatgctttttagtggaaatagggaatgagacgtgtaaattttggagggtagactagatgatatgaggagaatagtaagtgggaaaataagtatcccatggagaaagttctttaatttacctctataatctgttatagctcccttgaaatatccgttgacaaggttcttcatcttcattgtcctgttatatctgactcaatctctcatatgctcattcagactcatttcctctctgttctgggggtagatgaaaatgacaaagtgccattgttcttataagaactcgccccaaataaaaacttttgacaccatttctgtcgtacatcagtagcctgttggtggttgtttggatttgtagattagattatacagggttattgaggtctctgcattctttgttgttttcacctcctcgtgaatttaggcctagcttgttgttgcccagctctcttttctgtacttgagatctatgtgagaaacaaatataaagagaaatgggagggagacagcaaaatccagcttagagtgagcaaagaaattctttctgccaaacaacagatgcagtagccctgcataactctgagccctgtcctctttactttattctttttgatgccatatttaagctgccttcctttctccctgctatcttgagtgaccaggcagttgctttgcagtactctgactgatgaactgtaaaatttgcaaactcttctaaagacattctattcttacacctcaaccagtca

SEQ ID NO: 57833 - DNA, 1086 bp, Homo sapiens
taacagaagactggagacattttctggagagagtaaaacaggtagtctctggactggtggactcctgacacaagtgagggcatagattttaaactaaaacaagggagaggggaataaataaaactttgcatattgaatgttgaaagctccaggctcttctctaactcagctcgtagaatgctggtcttacatgctgcaggctggagtttggaagactcacctctaggaaatctgaccaacccatgagaaaaaacttaaatgaatcagtccaatctcatctccctatactgaagccatagttgacaagtcctactgcatgtgcacaaaggttctcaataacttataatgagtgtcccagtcttccatataagcaaacagccaagcttcatcacacatctcagaaggtctataacacgaagtcccgccagtacaaacagaacaaagcaacttggaaccagaaactatgcaaggacattggaaacctgcccctccaaatgaatgagtgaatgaatgtctccgagagttgaaaaagagattgtatccttgaaagaaagaacagtatgctgtttaaaattttttaaagaagccttggaaatttaaaatatggtagaagcctgggcgcagtggctcgcaactgtaatcccagcactttgggaggctgaggagggaagattgcttgaagccaggagtttgagaccagcctgaacaacatagtgagaccctggctctacaaaaattttaaagttagctgggcatggtagcacacgcctataatcccagctactcgggaaactgaagcagaaagatcacttgagcccaggagtttgaggctgcagtgaactatggtgcatcaccacactctagcctgggtaagaatacaagatcccgtctctaaaatatacatatacatatatacaatacccatacatacatttatgtgtatatatatgtatgtctatatatttatatgtgtgtgtacctatatatgtatgtgtgatagaagaaatgaaaaacttaatagaaaggatggaagataaaattgaggccattgctcaaaaagtagagtttagcagccaggctggctca

SEQ ID NO: 57834 - DNA, 1043 bp, Homo sapiens
cttctttctcccaagttagtcactcaaggcacttattttcataggatacagcttgacatctcaggaagatcctaagaaaacaataaataaaatggctacagcaagagaattatagtgcccccaaagttggccccttgggtaacttttagccttaatcaacattttcctgtagtctctaattactaagagatattgtcatactctattccatttgcttccccaccttttttttcccttccacaactagttgttagatggatattcttgatcatctttgtgtttgcctctgcctttttaatcaaaatggaccattctactctgggagcaaaacaaaaaaaattcctagcctccccacccctcccagccagagtctttcagacaagaaactttatcagcttatcttgtacctgtttacccaaatttaggcctctaaaagtctacaatacatggacaatgttcccttctcccatggagggaaagaaaagggtgggtttttaagatactggtcagtttcagctcttttctcatttcccgtcctcttgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaagg

SEQ ID NO: 57835 - DNA, 1083 bp, Homo sapiens
ccatctgaaaaatttctattctttcagtactcagacatctcctttgttaaccccttcctcccctgttgtagaaaagtaagattattttttgtgccatcacaaaccttctcagaaagcaaagattttctacccaccagatgagaaaactgaagctctttcaggtggaatgcagggtacatggctagtgatgtatttggctagtatatggctagttcttggccttggaccaccagatagctaagtattgctagaaaaatcatgaaaaatggtaggttgatatctccataaaactgtagagggctggctttagttaagtccttagactgattcaagctgagtccatgactccatgctaacttctggttcttgagaaaaggaatcatttcttatttaattcttaccttttgcactttttctatgttgaaacatgattgggactcaataaatgtttgctgaatgaatgatccaaaaaaatgaataatgtgattgaggagttggttggttctcctttctcttatcttctgccactagacttgcctgaagtctcacatcctctctaaatctgttctatgtttttcccacttgtacttggccctagaacttcggatcaagagacaaaactcctcagatagcatctcaagcctcaacagcatcactagccattccagcatcggcagcagcaaggatgctgatgcgaaaaagaagaaaaaaaagagttgggtaggtaaaggtttggggggtgggaagtaggtagaaccgtggtggaccgccttcacctcagcatagggatcgaatccttccaggattaaccaaggtgtagtcccgtctaacactgagccctagtgtgatgtccgctcagagcatggtctcccagattctcccttccctcaatcatttcctacttgtccccaaggccacccctctgacctttatatgcatctgctttctttgggctctccatactggttaggccaagatgtatttggcaacagaaggatgctgaggatatactcagaaggaaacatcttatcagttctgtccccaccaccccccattcccttctatactatggagagattttat

SEQ ID NO: 57836 - DNA, 1077 bp, Homo sapiens
aaccactagccacataacaccaaacatctcggaacagttctggctttgggaatactgaactacacatattctcacttaggatcttattgatcttaggggcatatgcttcaggcagcttgtcataggatctctttacacacacacacacagcatcccatgaggcagtgctatggagaaaacttcactggattgaaaattaggaagcctgagttctagtcctaagtcttacgtcaattatgcaatttcaagcaagtcaactctctggccttttcaggcttggttcttcatctctacagagaaatgagctttatggtacttttgagccctgactgctcagtgataagaagtcacctggagccagccagctgcacacatactcactcattcatgtctccaccacagccaagttggtcctcctttacatcttgcctggtggaaaccccaagatgcaccacccaccagctccatccatcacctgacggccttcctatgttccaggagagacgcttagaaagcgtaccctcaaatttttccttcttttttctcaccgtcccaaagatctggtttgcctttgtcccctataacctttgacccctcctttactctctgcctcttgctgccatttcatatctgtgtccctgtgtgtgtgtgtgtatgtgtgtgtgtggtgtgtggtgtgtgcatgctgtatggatgcatgtggatgggtatgggacaggaccctggtttgcatctctagctcacatccctaacacccaagctcatcaacaccaagatcaaacaagctatggtcagattataatgccccaagtactctaaagaaatgctgggaaatagcccttcttctaggacattggaaatcatagaaaatgctgtctggctgttttaaccattctgtgatgtcctgggcacaagaaatactaaaagaagcttgagcccactgccttctcgtgttctccacagaatcatattgtcagtttctggttgacagatgactagatgaacagattctgggctgatgagccctagtcagaggcatcatgaggtggcctctgaggcccacagtgagccaggttc

SEQ ID NO: 57837 - DNA, 1005 bp, Homo sapiens
caagcatgtgccaccatgcatggcttctcacaggatattaaaccgtccaggcactgggatcctggggacctttgaggctttatggagaaatgctacctaggaaaagcatatgctctgcactttctccatctatttctgtttcctctgatagacattctttgttgtggcttttacacctgtgtttgtatattttcttcttcttctgcctgtcttttctgtcaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtcagtctttgtctcttggggtgaggtggtgtggcatgaaggcagggacaggatcatcaaataatccatcatgcattcattcaccaagaactcactgagaaggtataatatgaagatgcttaagtaatgtgagatataaaaagatgagtaagacccagtcctaactttggctcccagggacacttttgctaagccttggcttcttgcttcactcctcacccccagctcacagcatgtccctaaaaagaagatctaagttttcaaaactaggggttaagggactcttatggaaccatggggcaagtggctctgagtttcttcagggggctcctagataaagaaagaaaagccctttaggatcccttgctatcctcaagaccctggtcaatactcatgctttctggggtgggggttcaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagc

SEQ ID NO: 57838 - DNA, 1580 bp, Homo sapiens
tcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggacc

SEQ ID NO: 57839 - DNA, 1050 bp, Homo sapiens
acctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagata

SEQ ID NO: 57840 - DNA, 1052 bp, Homo sapiens
ctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactggttctctagctccctctctgcctggtttctgtctccatttatcttgtggcccattccttgattggcaaggccagactgcttgtggtcatttgcctaacccagaagtaacctgaaaccctaagctagagtctcctgactcccatggttgggggtgggaggaacccctgctcgcacattatggacatagaatccttcaccggatctcaaaacatccagcccaaacatcaaggct

SEQ ID NO: 57841 - DNA, 1060 bp, Homo sapiens
ctctgtcatccaggctggagtgcagtggtgtgatcatagctcactgcagcctcaaactcctgggctcaagtgatccttccatgttagcctccttagtagctgggactacaggtgtgcatcaccacacccagctaattttgcatcggttttatagcacggagtttaccatcaacatcatactccttggaaacaattatttatatagcttttaagtaaactaaagtattatgggtatgacactcttaaatggtgagtgatatccttgtatttctagtaggtatgtggtctagacagaataaattgggttaagtaaaagaattttgtattttccctctttcatccccctataacctaatgcaaataagctctttgtctttgaatttttgaggctttgaaacatgtggtcatgttggacatgtggtcataatttttgaaactgtaggggtctgtagagaaggaaatctgttcatctattttattttaaaatttgtctttagttaacaatgatgatgttatttgaagattttctttgccattatatatctgcttttgagcaaatatatgttacttgaactttaatgctgcttctttcatgcgtgaaagaaattagcttttagaaggagtccatcttaaaatacttgttgtaggtacagatcccttggctaacttgggtttttggcccctacgttggtcttaatcttctgatgatctcttattctcaccatcccttccagtctcagtgatgtgtgaagcaaggtggttagtggaattttgtatatgatctttgataggttaccagacatgattaacttattactgtattagagtgaagagcttctagctactgtgatcatcactggagtgcatccttctggcagggatatggaaaaaatatattcatgctaagcttttctctgaagagaaaagacttggaattctctggttgatgagaaaggacccttaagctgtgataggacctatgtgtaaagtttgcctggtcttcatgctctaatgactcctgtgatcagtgccagagtgaactgatggaaaatgtgtggtt

SEQ ID NO: 57842 - DNA, 1082 bp, Homo sapiens
aacaatagctactagctgcatatggctgttgagcacttaaaatggggctagtgcaactgaggaactgaattttaaattttttaaaatgttaatagctatgtatagctagtggctactgtaatggactgcataagtttagagatcacagatgaaccctccaaatgaattgtcaagtttgtgtataggagttttctgtagacatgcagtaccttgtactcattgtttttccaacacagttcccaattgaactgggctctgccagtcacttttaacctgatctaatagcaggtggacttttatcccttacaggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacaggtaccagaagcccttttccctggtattggtacttggatctcaagcgacaggagtattaccagaagctatgtgatataatggcctggaccagtaggaattgctgctgatgttattcctccctcctagtttttatctctccatctaccctccagctctattgtttttttctagggaattaagtttgtatagtattacttctactcccaaacctaccacttacagatacagtattagcatagtgatggagtattcagattttggatttttgtagtggcttcaccttgatccttcacttaccttctttgagcctgagtttccttttatataaaattaagatgatagtagtgtctgcatcaaaggagcttttggtatagtttaaatgttagctaatctatctttattgacttgttcagtaaagtttagttactatgattatcattattactatatattatttgtccacttagttcaaccaaggcaaagttaagaattgtaaaatggatttttatagaagtatttaaaaagaagataaaaacagtatagccatgtaatcctgaccttcatttagcca

SEQ ID NO: 57843 - DNA, 1016 bp, Homo sapiens
ttaggtcaataaaatctgagaagagtaacatatacaaagaggagttgaggcctagtaagtctgtacatattttattacatgcatcaaaccagcttgccaagcgaaagtactgaaaacagaagcaaaggtaagaaacctcgaagtgtaactgaatgttgacagatgggcacaagataaattaatacagaattttcccaagttgacctcacaaggacttttatgcagttctattacagattttctttcagtatttatattaaagttttcttttttaatctcttgtatttttctttatttccatattattctttctccttctaacaaataatcagtaactcttgctacttttgctttcacagaatgagaccaccaggccagtgtctttacctgtgtgctgtctgtttgggaactgccacctagaagcagttcagaaaatatcacacttaatatctttatgaagcagtattttttttttaacagtactacttttttctttgtagaattcactcgtgaagtaacagacacacagatgccacttgttgctcctgtcattctcccagagatgtataagatcttcaccatggctgaggtatgaaatctcagctccaagattatagtgagttcaggctctcttcagcccccagcctttcaggtgggagattatggtgtttgcaactgatctcaatacctaaaaactagaactgacaaagatctggatctgaatctgcattaaccttagacctttcactcaactacaagggcaagcctttgataaaagtgtgaaatagctgaaatatttcttcacatatcgtacttcctggcatccagtagcccctaagtagataaatagtgccttccttcatgctacttccagcctcttactgagttatcccacctacgcttgcctacctcagctaagtaatgggaagcaatctatcactgcattgcacataatagacccttaatatattgcatatatatttgattagtgtgtatatgaatgataactcatttat

SEQ ID NO: 57844 - DNA, 1245 bp, Homo sapiens
gctttcaattagcaaaaaatagaattgtgctgtaaatgtagcagcattaaaaaatagagtacctatttctgtaacacttactctctagtaaggacttagggataaagataataaataaagggctaataagcaagagacataattcagaactttgatgatagaataggaaattgggcaaatgaaaagcctcctaaaagaaaagggctaggactataatttagaaaaggagatactaaagaaagatatatggaaaagtttataaacaaaggtattcactagatattttttacagtagtaaaaatttggaaattataaaaagacattagttaattatatccataaaatgaaatactgtgcagccattaaaaatcaagcttaaaaggaatatctgaaaccatgggaaagagcttacattataataaatgaaaagatacttttcccaaaaaatccatagaatatgatcccaagttttgatttttcttttagaaaagcatgtatgtatagataggtatgttttaaaaaaaaatacatcaaaatgttgagtgtttaggtagtggaattacaggtgttttcattattacttttctgcattttaagttttttttttcctgtagtgaatgtatttattaataccttattactagtaaaatattaaggattctttttttaaagagagagctccaatattgaagctcagaaagatgtacaggataaggattatttatataatgtgatatactgaacatgttatttgatagctttttcactgaaaaatgtgtactgaggagctttccacattgtgttcttggatatatctcattcttttcagccattactaatgttccataaaatgggtatatcataatttacccattctgttaatggacatctagggtattcccaatttttttctattacaaacaatgctgcagtgatcttttaaggtatactttaatgcacattgcctatatttttccatactaaatagaggaggatgttttgttctatagataaagaagattgagctaaagttccctttcttcataaggctctgctttttaggagttttgccttttgccccagaagtagctttgagagttcttcatgtctaccgtggctaccccataggagatatgtatgatttctctcatgcatcaaagccagtgttttggcaatttttgcagctttcatgtcttcttaaagtatcagttgggctttttttttttttttaagcatttggtttta

SEQ ID NO: 57845 - DNA, 2610 bp, Homo sapiens
gagaatcacttgaacccaggaggcagaggttgcagtgagtggagatcgtgccactgcactccagcctgggtgacagagcgagactgcctcaaaaagaaagaaagaaagaaaatggctcttcttgttccagaggtaccctcagtgaattgaacagagtgccacctttacacagtgccactaagtatgtcacctggttatccaatccactaccatgtactactgcccacccctatggctaatcaattagtaagctattatgagaaggctgagagtactacccatttaattattccttttattttggaaacttgcctttcattaataagctttctctgggttgctatgtaatacccatccagtaaggatcttggttgttgggcaacccccaccccagaggcaattctgacttttctttttcttctctctttcagacagccattgatatcctgacaacagtagtacgaaatacaaagcctcccctttcccagcttctcatctgccaagctttccctgctgtggcacagtgtacccttcacacagatgacaatgccaccatgcaggtatctgagacatggagagtagaagagggaagatagctccccagccatgggcttatactatgctgagaaatctgacatggttttatgcttttgaaatacggaattctcaactccatatttacttagcagattcaggaagggttcagtctgcaaaagccaagcatttctggtgctttggagcatgttacagtttttaaaaatatggataccaagcaccctgcccatctgtattgggtattgctactgtgaaagaggttacagacatctagacttggggccataagaaagtctttctgcatatttcttctagtaataaagtcagcagagtgatgggcctctagagaggggagacatgcctgaatattttttctctttttgtttcttgggtgaattggttaccttttcaggtgtctgctactgtgattgattagaaaggttataggaacttgccagtgaatattgatcagcttggaaatccctaggcaactagtggtttgtgtaagacctatataaagacctacagtatccccagttattccaagattgtaagcatatttttttagtaccagaggtagacctttatgattaaaattcattttgcttggccattgtcccttgtgattaaaaaaatatatatacacatttgtgagatagctgattaggtaaagggggaattatgtaatgcacgtctatgtctgtaacagtaaatgtcttaactccagtggtatgagcccaccacaaacattatagactcaccgcttttatgaggcataggcctctgggaacatttgtttatacagactgagggccttctggcatctgtccctcgattactaatcttgcttgccacccctgtctccccagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcaggtaagagagcagtggggagtgggcttcctactccctggctgatagaaatgaaaattcgtattttggtcctgagttattttattttaccctcttactagccttgtaggacagttaagtaaaatgggacctgtctgatctgtttggcctaagaaacatggacaaggaaatctcccatgttttcttgtcctgtggataataccctcagtgtagactgtatttcttatctgactggccagttccctctcatctcctatgtctctgaaattgatttccctgaagcaaatgtccttattttctcctagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcaggtagaacctcatctttcttttctgggcattctgccaccactcatatttcttttttttttttttttttttttttttttttgagacagtctcgctctgtcgcccaggctggagtgcagtggcacaatcttggctcactgcaacctccacctcctaggttcaagcaattctcctgctcctgcctcagccgtccgaatattacacacatgcaccaccatacccagtgaattctttgtgtgtgtgtttttagtagagagagggtttcaccatgttggccaggctggtcttgaactcctgacctcaagtgatccacccacttcggcctcccacagtgctgggattacaggtgtgagccactgctcctgacacatatttcttttttttcctgatttgctccattgatttttgtttgacatttcaaatggctctctgtattcccttttc

SEQ ID NO: 57846 - DNA, 2416 bp, Homo sapiens
tcattgagactaaccaggagggtttggccatttctgattctctttcactggggactacaagccacattgcagaagcctttggggcccttctattctggcctatttggatttggggagggaaaatgcatgaatgtgctctagctctagctgcttttcatctccaagtagatgactccaatgatatgtgggaggaccaggaggaggaagaggaggaggaggaggatggtttagctggccaacttttatctgacattcttgctacaagtaaatatggtaagctgtttgataagaggacagccatggtaaataccttttctttgcacactgatcccaacagtggggtacccaagaaaggggagaggtgggcccacagggacatttcttgggcttttgcaccttccgcctcagtcatgtggtagtatatcaccactcagggcctgatcatgggcctttgtcctgacccgccctgtgttggctatgtctaacagaggaggattactacgaggatgatgaggaagatgaccctgatgccctgaaggatcctctctatcagattgatctgcaggtgagggtgtccagagatatcttgcaaatgacaatgtcccaggccatggaaacaggaatatgggctcaaatccatttatagccaggcatggtggctcatgcctgtaatcccaacactttgggaggtcaaggcgggaggattgcttaagcccaggagttcaagaccagtctgagcaatgcagggacaccctgtctctacaaataatttaaaaattatctgggcatagtggcacacccccgtggtcccagctactcgggaggctgaggtgggaggatcgcttgaggccaagaggtcaaggctgcagtgagctgtgatcataccactgcactcgagcctgggcgacaaagcaagaccctgtgttcaaaaaaaaaaaaaaatccatttataatttaacatgggagcctcatgggaaagagttcctgtcttgttgagtggtccagggttttgggtgggctggaactttgcacttgatgtgttgtaattcatcttctagaggctatgttgtgaaggtccttggggtgatacagccttggaaaaatgttgtttccctgtggattacctaaactagatccaagaacatgaaagaccatccctcagggagctggcatttgtctaaaaaccagcattccctgtgccatttgattgtggttcttgctccactgcaaatgggtgacttgcaatgtctcactaatgccactcttgctctttcctccaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggtataaggtgtctcagcacctgtttgccttctattccctttagaaggtaagtaaaagtaatgggggaaaggattaggtggagcctgtctaaacattctagtgtgt

SEQ ID NO: 57847 - DNA, 1038 bp, Homo sapiens
cacagagtggatattcccattctgttgatgagaaaaagagtggagagactgtgtccagtgtcagcaggaagaaaaaagatctgttggaggccagtacatgttgacagaaactctagaccatattttgtctcctgtctttggccaaagagaactagcttcagtctgaaaagggcagggctaagtggttacaaggaactaaaaagttcaaggtaagacaaatgaggtaaaaataaaaaagagcacttagctgctctgagacattttagtctcctgactggtaaacagcagctggggcaccaaggggctcccaggagtttgtcgagcttttattggagtgaactgaaaggaaaatggaaggaatgctataagactgaaaagaagttaaagccctaggaaggaagctgataacacaagttacagacgtatatgtgacattgatttgggagaatgaacctacaacaaatgacccaaaagcacctaaataagagtgacgagagtttaacagacattcattatggacttcagagaaaatgatgctaaactggtcttagaatcttctttaattttgttaactaggtaaataatctggacattttagtcaaagcattagacagacagagaagttggtaactgaccactaactaacaaactataaattcacccattgtgggttgacctggtaagttcccccagggctgtgtccttggcccctcctttgatattagtgacagatgactttttttatgccttacccattccacaaaagaatttgaagccatttacacaagagatagtactagtaaattaggagtgctgatcaaatttttagataataagaaacccttaggaaggatgacaatttagaatccaaatttaggatccaaacaaataccattacaaactataaaaatgagcagaatctaaatgtaacatttcaataaatgcagattgataataacatctgtgcagagttgaggactatagagtactgtgctgtcactaacagtattgtgtgctactaagagtttaatggctggg

SEQ ID NO: 57848 - DNA, 1138 bp, Homo sapiens
ggaggccgaggcaggcggaccacgacatcaagagttcaagagcagcctggccagcatggtgaaaccccgtctctactaaaaatacaaaaaaattagctgggcatggtggcgcatgcctataatcctagctactcaggcagctgaagcaggagaattgcttgaacccgggaggcagaggttgcagtgagccaagatcatgccactacactccagcctgggcgacagagcgacactctgcctcaaaaaaaaaaaaaaacaaaaaaaaaaacaagttttgtgaatttaagtttccctaatggatggtacaggtcaacatttgccatctaatgacacttacattccagttttttccttttttgagtaactgggaaaagggtggcattactgctggcttcctaaaattgaaaagtatactagggtttttaaacctgtgtagaatacatgatatggtagcaaatgtgctgtaggaagaaaagcaatgaggaactactggcctgactaggaggcctagaagtccctcccaggcttgagttgttctgacttggcatgattacatagctgcggcaagtgacgtttccttcaagccttggttccctcatctgtaaaatagggaactaatacctacctcacaggattgtagttagaattaaggatgacttcattaaagcacctctagtggtggaagatgtcccatcctatcccccacccatagctgggagctatgtttggctcattcttcctgactcactggattacactgtgactcagttcaatttcacacatgctgctgctaaattagggtcttggtgagcctttgggaggacagctctgaggaatgaattgtagcactgcagccctgcctgaggaacatgatagaaacaggtggtaggcccagctcttgccttccacctactaagcagtttttctgtggttagctgtgtgacataaactatcggtgtattaatttgctttcactagattcccccccccccaacaacttagtccaagaacatacctgaattctttgcatttccttgccttagttgcttttgtagggtggacagcaggactgcatgagaatagctgtgcttctggaccctatggtgaaagctctagtgaactgcaattaggcccaggg

SEQ ID NO: 57849 - DNA, 1030 bp, Homo sapiens
caagggtacacatgggagattcagctctgggcaggaaagacagtcccttatctgaagatgattcaaccaacaatgacaacactgatggctagggctggatggccacattgaacacagccacgtggtccctgcagtcatggagcttttagtgtaggaaagaggagatggatggcaatgggcacactgagtaggtggtgctggattcagaggcgtttctctttgtccctgctgctgcatttatgactgtgtcctgcgtgaggacatactcttgcccatcaggctaccagcaactttctggggcaggagcctatcctctcctattccagctctcttgggtaggtgtgccagcacccacaggggcccaggatggggtagctcctctttcggctgtccttccctaacctactaagattctactgggccttccatggacctgtcctgattctctcaccccagaacacaagaaatactcactgtctacactgtctgctgttgcggctggggatcaaccctgatttagatttgggtcttcctgatgcctctaccatttactggctgtattaccttgaacaagttctttaacctccatgagtcctagtttctcagtctgtgaaatgcgattgataacactgatgaaccttgcttagttcatggagttgtggaaagattccagtgaggtagatgtggaagcccagaagtgtgtgaaagggtgtacatggcaggggattaaggtaggcttttgatgatctccctggcttaatttgcagttcctcggagggtacctcatgtagcatggggcatagtcactggcactcagtataaacctgtgaagactgacctctcccatcctaaaacactgtctccacctggaattaactgttgcccacctgaaattaactgttgccctccctatgctccggtggctattgcagtacaggcttgctctgtgaagggctttcactgtgaagagtgtttaactggatgggccccaggtggccccagcagcctgccttccctgctagtgaggcca

SEQ ID NO: 57850 - DNA, 1143 bp, Homo sapiens
accaagaactggggctctggcccactccctccagccacctagggacttcctgataccaggcactgcagctgccagtctcatctatctttacaagggagggcagggaagagctgactatgggctggagggcctgtcaaaggtcccctgggacagcagatgccttacagggctggtgtgcagggcagggcaggcagcagggcccagggctggaagggaccgggggagttcacccactgcagtctcctgccgcattccatgtggagtgccaaatcttttattgttttccaccaaaaagaaagattctagagtctctggaaaagaagtttaaggaggggccaggcacagtggctgacccctgtaatcctgtcactttgggaggctgaggcaggaggactgcttgagcccagaagttcaggactagcctgggcaacatagtgagtgagactctgtctctatttaaaataaataaataaatatatagacaagtttaagggaggtccattgtcctatggggaaagttggattcctggcaccagctgtcctgggtaggggccgtaatgcctgtttcccttggtggaatgtggagcaggagtcctctactgaggctaggcccagctcattagacatcaaagattcagatcttgtaacaactgatattgcccctagaaaactacaggttccctttacggctgccaggaaaactgggggctgttccggaaaagttctgcccatagtggcatatgagcccactgggtctttagacagttggcctatgtgcaaatcccagctctgcccctaactagctctgtgaccttggctgagacacttagcacctctgaacctgttgtctcatatgtacaatgggactgatccctctggggatcctcactgggttgtaagtggtagaaccaggactcaaacctagatcccgatgacaagaaagccttgaataggagataggctgtaaaaatctgggtccttctgagaagtgattaagcctcgagggcaggcagtagggccccaacctcctcctatctgagcccctgccccctttgcttagtatcttggtattgtttagcagggtgaaatttgttcttacccagaatggaactacattgtgtgcttttccatggaaaatgaaat

SEQ ID NO: 57851 - DNA, 2334 bp, Homo sapiens
gctccgcccagcttgcccggcatcactcgcggcattggagtcaagatggaggagtacgcgcgagagccttggtgagcttcaccgctgtctttgcatttctcttgcccccctgcccactgccctccttctcccttgtccaggctcccaaggtgcaagccagactcaaccgcagcctcgtcgacttgggcctggtaactgggcaatgcggtctttcgcggccagtcggcttcttagccctgtacttagtacctccccggccgcgtgagcctccctctcccaacccagcacccgtgtgaccttgtgatggatggtaaggaggtccagacttgagtttgatagaacctcggaacctcctcccaacgcagggcgtaatcgactttatgcggggccagttataatcccccctgttcgtcgaggtgaccttgggcgcgtccctccgtctcgccttgctcagttcctgcgttgaggaactgaagaataggcatttgagggagtgtcattcttgaggttttacttgtatcatgatatgtgtccacagagtgaagcattttaaatgaatggaacatagattttagccaaggggtctggataagcttctttattgcgtggggccttgttttccttcttggaattctttcttgagggtagagggggacaaaaattacctgggaaataggaagaggtaatagcatgtgttctctgaaaagccatggacagaaattcattgttacatccagcgtttattgagtatgaataaaccagacacatagataattataaaacgatgtaattgctgtcagaagtctcaggttgccagagtttaaagtttctagggtcataggtaaaaaatcaaatcttgatatttcggttaatcatttgttttattgtgtaagagcaacaaccaagatgtcctcaatttgtgaaagtgcccaggaccttaaattactactctggtatcctagccttgttgcatgttttatgttcccctctcccataaatggcatacaaaatataagttttagggtctcctggctcttcaaacttatcttcttcaaagcagttatcctccattctggattgtgctcagatatgtaggactcagcacactgtaaatagctgtttgatgtactataatgacacaggttagcagagagttaaaatatttaactatgttgagttaaagatcttagaaaaataaggccgggtgtggtggctcacgcctgtaatcccagcactttggaaggccgaggcggatcacgaggtcaggagttcaagaccagcctggccagtatggtgaaaccccgtctctactaaaaatacaaatattagccgggcgtggtggcacgcgcctgtagtcccagctacttgggaggctgaggcaggagaatcacttgaacccaggagacggaggttgcagtgagccaagattgcgccattgcactccagcctgggtgacagagtgagactccatctcaaaaaaaaaaaaaaaaacaacttagaaaaataatgggttttcatttactaaatcattaggtagcccctttgctttctcttagtacgtatgccctgaaacaatataatcagttacctggttatctttgtagtcaaaactgctttgattttttgactgccctgtttgattacagcatttcctcaagtcattttataggccaaatatttattggttgcagtgggccctgcagtataatctgttccattataatccttactgtattggcaaagaagattttatggtttgtgaatgagaaatatggtcttttttttccccctgttcttagcccatggcgaattgtggatgactgtggtggggcctttacgatgggtaccattggtggtggtatctttcaagcaatcaaaggttttcgcaattctccagtggtaagtgggtgaatggtcttattttatcatcacttgcaacttgggtttgatgatattactggtggtcccatcagtggcttagaaatgtacttctaatatattttttgttgcttccttttttttgttatagggagtaaaccacagactacgagggagtttgacagctattaaaaccagggctccacagttaggaggtaagcagaattttcattttaactgaactatttttttctgttcctttgaagatggagctatttttatttttagattacaacaattagtgattttagtttggtctaacggtttgtcacaaacatatatccctatagtttcttcttgatttgtagtttgtttgaaaaattaacctgaattatgatacccatttgaaaatcttgtctctgtccttcagacactcggtgattttttttttttttc

SEQ ID NO: 57852 - DNA, 1046 bp, Homo sapiens
cctccgcctcctgggttcaagcgattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtagctttgcagtttggggagggctgttttccatgattgactgtagtatggttcaagtcagaggaaaggaagatccctggaactccatcacaagtggtgccttaacgggagccatactggcagcaagaagtaagtagtcattacagacatactagtagaagccacacttttaggaaaacctcatctgcctcaattgaatgacatctgtaatatataaaactgattattgaccaggcacattggctcatgactataattccatcacttgggaggctgaggcaggtagattgcacaagtccaggagcttgagatcagatatagggagacctggtctctacaaaaaaaaaaatttaattagctgggtgtgttggtgcatgcctatagtcccagctactcatgaggccgaggcaggaggatcacttgagccaccgcactctcacctgggcaacagagtgagaccctgcttcaaaaaaaataataattataaaactgagcattgtttaatttggcatagcataaatatacagtatatggtgatttgaaaaaaaagtaaggggatctatttatttggaatatttgagaatgaa

SEQ ID NO: 57853 - DNA, 1254 bp, Homo sapiens
aaaacatgactaggatacttatactttgtgaaaataattttaaatagctactgaaaaatatgacaagaagtgggagaaactcttctaatcttgatatatggcagcttgttacagcaattgctttaaaaacttgaagtttgcttcttgctataattaatccgtctgactttcctagcatagtgtttgaaaactgttcattctggagcatagcaagccagtctgtcatatgttataccaaatttgaaggttctccagtactcttatgggaattaggcagatctataaagaaatttagggttatagctttaatttagcacatttttttgttgttgattgatttactctctatagagatttgttctttttaataatataatattcaggtgatttttaaatcctttttatttctcacttgcaggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttag

SEQ ID NO: 57854 - DNA, 1087 bp, Homo sapiens
aatgtgtaattaactaacatcatgcctcctatagggccacatgtcacttccaatatcaggaaaatgacctgttctgaagtgctcatccattttccaggcccaaccagaccccaaaatacatcgtttatgcagaggacttggaacacattcaaaacagtacatactttattttcaagcatacaagaaacactaaactcttccagtgccagtacactctccatgaattcttcatatagaattgggtatattggaagcaagttgtttctggtgaaatttctgatgatcaggaatcaagactcagtagccctaaaggaagagagttttgtatccaatatcctcaaaaccaagacatagtatattttactttcaaagtaaactataaacattttaccatatccttcaatccataaagcatctcactgtgaaatgatccatgttgactctgcataattctcagaagtcacttcaagtgatgagggactaactataaaacatgcattatttgaagtacatgagcatgaaacatcgaagtctacaacttatcttaaaagaaagagtaagttccaccagctttttattgtttgaataacagaacacacaaaaccaggcagagaagtccgcaaggagatgatgatcatatttcactgttttttggccttttggtccttcatctttcaagcacttactgtattttcctttagcgatttaaacatttattttgatcacaaatgcaattcaagtgtgaataaataaacgtattatcttttagcacccttccccgcttgttcctttaaatagaaaaaagtgctaaatgtctctttatagcctattggccatagctgtcccacctatggttttaaaaacagactgtaacttgatcttctgaaatccttctcgaaccacaactcgttctgttaaagaaatcctaggaaagaagtcctactgatattgtcgatagtctccaaaaggtgaggaaggtaactgagttgaaggcaactgggaggggtcttctgcaaactgaggacctgcaagtgagaaataaaaaggatttaaaaatcacctgaatattatattattaaaaagaaca

SEQ ID NO: 57855 - DNA, 1055 bp, Homo sapiens
tggcacaatctcagctcactgcaacctccgcctcccgggttcatgtgattctcctgcctcagcctcctgagtagctgggattaccgccaccacaccgggctaatttttatatttttagtaaagatggggtttcaccatgttggccaggctggtctcaaactcctgatctcaggtgatctgcccacatcagcttcccaaagtgctgggattacaggtgtgagccactgtgcccggccaagttttttgctttttttttttaaactacatatttccccatttattggcttatgagttatatactgtcttcaatttatattacttaagtggtttcctttaaaactttaatacagatacttaagatctcacatttatccctactctccatctgataatacaaggagcttagaatgctttaacttcctgcagccaattaagccgactgagttcctttcctcatgggggcccagtgtgcaatggctgtaaatagcagcttccttggtagtgtatgcagcctgtttgttgtatgggttgctctaagggaccttggagacagtcctttcagatggatgttcatgtttctgaccttacactaccccaatgtaggctccaaactggcatgcgaggtgcctttggaaagccccagggcactgtggccagggttcacattggccaagttatgtccatccacaccaagctgcagaacaaggagcatgtgattgaggccctgcgcagggccaagttcaagttttctggccgccagaagatccacatctcaaagaaatggggcttcaccaagttcaatgccaattaatttgaagacatggtggctgagaagcggctcatcccagatgggtcaagtacattcccaatcatggccctctggacaagtggcgggtcctgcactcatgagggcttccactgtgctgccccctcttaatactcaccaataaattctactttctgtccacctaaaaaaaaaaatgctttaacttcagttacccctctctcttatgtacttttagtctgttattttagttttatcctgattccctcac

SEQ ID NO: 57856 - DNA, 1008 bp, Homo sapiens
ctgggattacaggcgtgagccactgtgccaggccaggaattatttcaagaaggaaaggaatcactgaaggaaagaatgagatgcaaaaaggaacagtgagcaaaaaaagtagataaatttaaacaactgtataaaacaacactaataatatactaataatgtttatgtgagggaatcaggataaaactaaaataacagactaaaagtacataagagagaggggtaactgaagttaaagcatttttttttttaggtggacagaaagtagaatttattggtgagtattaagagggggcagcacagtggaagccctcatgagtgcaggacccgccacttgtccagagggccatgattgggaatgtacttgacccatctgggatgagccgcttctcagccaccatgtcttcaaattaattggcattgaacttggtgaagccccatttctttgagatgtggatcttctggcggccagaaaacttgaacttggccctgcgcagggcctcaatcacatgctccttgttctgcagcttggtgtggatggacataacttggccaatgtgaaccctggccacagtgccctggggctttccaaaggcacctcgcatgccagtttggagcctacattggggtagtgtaaggtcagaaacatgaacatccatctgaaaggactgtctccaaggtcccttagagcaacccatacaacaaacaggctgcatacactaccaaggaagctgctatttacagccattgcacactgggcccccatgaggaaaggaactcagtcggcttaattggctgcaggaagttaaagcattctaagctccttgtattatcagatggagagtagggataaatgtgagatcttaagtatctgtattaaagttttaaaggaaaccacttaagtaatataaattgaagacagtatataactcataagccaataaatggggaaatatgtagtttaaaaaaaaaaagcaaaaaacttggccgggcacagtggctcacacc

SEQ ID NO: 57857 - DNA, 1041 bp, Homo sapiens
gaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcag

SEQ ID NO: 57858 - DNA, 2775 bp, Homo sapiens
agacctgagggagcgggatggggagggagctcggctgggaagtcactgggagcaggtaaaagccaggcatggtaggggcgcagagaggaaacgggacccaggaggccagctcaccacccagacaacctgggcacggctgccctagacctcatcctcaccctcccttctccgtaggtcttagtcctgggtaacaagcgagaccttccgggagcattggatgagaaggagctgattgagaaaatgtgagttgggtgactctatattactttctgctctcccaattccccaaccaccagaccaacagcctaggcttgctgctgttcttagtattagccacacggtggcagcagagccgaccttttcaggcacctcaccctcccctttgtagcctcttaggtaagaaaaaggccccgctgtcccctagccccaggccccctggacgttcgtagcctcagcggactctactctggtttcccccaggaatctgtctgccatccaggaccgagagatctgctgctactccatctcttgcaaagaaaaggacaacattggtgcgtaggatgggggaaagggaggagaggggagaggcatttctgagtgttttagtggctctcaggttctcgctccacaactttccctgaagtccaaagccctgtggctcttgggtagaaaaggcagccaggtggcccagattctgggcactatcccagcttgtcgccaagcggttgtgtgatctcgggcaaatcgatccccgctctgggcttcacctcctcgtttctaagattccagggctggacccggtgattctcaggtccctgctggctctgacatgctgtggctctgtctctttcccagcacctgaattccgctactactcattcagggccatgtggcgcttgccagctctggacttcttgtttgtttttgagaaagtgtctcgctctgtcacccaggctggagttcagtggcgtgaccatagctcactgcagcctccaactccactcctgggttcaagcaatcctctcacctgagcttcccatgtagctgagactccaggtgtgcgccacccctcctggcatctctggacttctgatacccttaggtttggtttcttgggcctctctgctgccccagcacggccagtacttgcaggccttataagctgttctcttttctcctatcagacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgt

SEQ ID NO: 57859 - DNA, 1028 bp, Homo sapiens
accccatttcccaagcgcctctcgacgccagctgccggtcaacccccgccgctgaagcctgcggattccctgctcaccccacctgcggattccctgctcaccccacctgcgggtgcggcccctggccccccggctccagcgagggaggagcgcgcgctcgggtgcgagcaggacacggcccggccgcgagggagggcggcggcggcggcggaggaggagggcgcggaagccacacccatcggcgagccgattccggggcagcgagtcgtcggcagccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcggtacgagggcgtcgggcgcggggtccccgggcgcgggccgcgggtcgggcctgtccccgcccgcgccgcgccctgctgagccggggtcgccgcctggcatagccgggcacggccgggcgccgggcgggggaggagccggccccgagcgcttggggcctagtacggcccgtgccgtgggggaccggggcggcgcgcgacccgctctctcacccgggccggtactgcacggctgggggcaggggaagggggacgaacagacagggccggtgccacggggcaggcggcaccgaggggctctcgaagcaggagggacccgctgccggctgagacgggccccctctggcccccgcgcaagggggcatgacggggcgaaagtgcacgggccttcctgtcccgcgggtagagggtcacgggacggggcggccgagaggcttgaggagggggtttgggcaagcccagccccacccagagggcttaacccctccttgccggaagag

SEQ ID NO: 57860 - DNA, 1039 bp, Homo sapiens
ggagaggggggagccagagatttagtgtagatcgtttctcccttttctccacaccctccacatcttgctctcctcgcaggcccgcttgcccctcctctggtaaatgtgacgagtgaaggtcccacccagctctgggcatcctgggtccatgcccccaggggccgagacagctacccggtgaccctgtaccgggcaggcaccagcgccgtcggagccaaggtggccagcacaagcttttcaagtctgactccaggcacgaagtacaaggtggaggttgtcacgcaggctgggccccaccacattgcagcagccaacacctctggctggacccatgaggcatggggaaggcagcgatgcaggagaggtgagcaaggctgcctcagagagccccgggtcttccctcagtggtgccccctttagcccattttccatctccacaccccagggccctgcaggggtcagcaggccctggcatcaagcatggggctctgaggactggggctggcggcctggctgattgttcttcctccctccttccctccttctgtagccctgcacacacccagtgagttggtgtccatgcatgcgagcaccgctgtggtcaacctggcctgggccagcagccccttggggcaggggatgtgctacacccaactctcagaggcggggcacctctcctgggagcaccctctggtgccaggccaagcccacctcatcctgaggggcctcacacctggatgcaacctctccctgtcagtgctgtgccaggcagggccgctgcaggcgtccactcagcgcgtggtactgcttgttggtatgctgacgtcagcggcggggaggacgaaggtgccctgagatgcaggtctgattcaggtgggcagcactgcccgctcgactctgagccactgctctctccagatggatgctgcacccactctgctcggggttatgccccttacgcttctccaggtgggcagtcatgtccaaaggagatgtttttccgcctggctgatatccctttccatgggcataaatgtcc

SEQ ID NO: 57861 - DNA, 1060 bp, Homo sapiens
ggaattgccttcgttttaatatcccacctttgatctattgagaggctgacagtgaggggaaggatcttattagatggcataaatcaaagctgatgaaatcactttcctccaacaagcttttcccctgggtgaggagagagagaaaagtgctgctctagctcccacctcccctctctcctcaattgtaagtgggtatggaaaggttaattcaaggctccatgcaccatcacccccaccccacctctgcagggaagtggagttctcactccagcttctggtggctcagttgacctcctctgctccccatgctctctgtcaccatgggactgtcccaccaggagtactcaggctccgactccccagagttgtcacttttgggctcttcagggcttgtgtgctctgtgagggcctggtgatgggttccagatggggagaggcactgctgggatgcaagggatgagccccaagtgttggatgctgccaaggaatggttctcagagaccagggtcttcatagttcctcaaccagtgacctgggaagtgtctctgggggccccccattgcactgtatgtgggggtgggcaggaatcggtgaacaccttcttcttctcccaagaggacaagggcaggagagaggtgaacagtgaactcaaagaacaccggactcaaaaccaatgccttctctggctttgccatctctttactctgtgaccttggacaaatcactcagtccctcagagtcccctttcctccctggttaagtggggtccctgttagctgtcacttccactgctgtgatctccccatcaagcaatcatctgaacaatgctgaaagtgcccataactggatcaataaaaaacacagactgaatatccatggtgggcaagtttcagggaaagaggggacatagcccgcgtcttcaggggtcttcccatgtaatgggggagaaaagtgaccaaagtgggcacttgggtaaagttgttcaaagctctgaagttggccttttactatctcccacctctatcgaccatctttcccagctcctcatctctctggtcca

SEQ ID NO: 57862 - DNA, 1051 bp, Homo sapiens
tacttgtacccaggtggcagagattgcaatgagcggagattgtaccactgtactccagcctgggtgacaaagtgagactctgtctcaaaaaaaaaaaaaaaaaaaagtctgagtgagaaactattggaatttctccattgccagagtcaccaaggtctaacttttttcctttgatctggggcatgagagaagcatgagatttgatctatcaagagggcatggagggagcaggatgtgcaaaagcattgagccgggaaataataaaacattagggaagagcgaggagacctaagttagcagggacaaaaatatatgggagggggtgtacctgtctatctccatctctctctctctcatctattgagagaaagctgcttgaggacagggcccctgtcttagaaacttctaaatccctcagagcttggcccaacattagacacaaagatggtgtttaagaaaaacataatgagcagatgagaggaataaattaatgaacaaacaggcctgggtgggtggcactggctggaggtgtctgagcgtgaagctgtgagtgagacagcatgaaggtggaagtcacgatggggatggcaggaggaagacagaggtgagcagagtccagggggacagagaagccagaaacttccaaagaaaaagagagggaaggaaaggagcctgctccgcacaggttatgtacttttcagtccaacatgttatttattttgaaatgtttttcccaactaaccaaacacataattctggcttccagactcccagactctcagctgggtgcctcagtcctcattttcccatagtgccatccacagtcattcagcggcccattccgcaccttatccccctggctgcgtgctgttgacacttctgtttctttattttagggccttgaggccaagccagcctccatttgaggaacatccctcacttgggatcccctggaagctgtgtcttttctgtatcttccttttcctctcacacacccttggcttcctctgtggggacccaccagggctctcacgacaaatgactaaggaga

SEQ ID NO: 57863 - DNA, 1110 bp, Homo sapiens
cagtagatgtttcataacagttgtcacctattgggcaacactagacggcaggcagcatctggttaattttttttatattgcaggtagcagggatagtggagtggtgtctcagattctttttttctaagttgtccttttaacactgagaagaatctatatttgcagggactagttgcagagatgggggaaacttttcttaggggaccattcatggaagaaagttaaaggaaaaacttcaggttgatagaatttcctcatttagcaaaattcaaattacaggaacatggaaagtagcacatcatagttcttgctgagttatgccatctttcagattgagttaaatagcagtggtgttacttgtaaaaagaaataaaaattaaaacaaaaaaattgaggaagatgtctttgagagaatatcgtatgcataatactgtatttaaatcttgcaacaaagaagtacatggaaataatattacagagcttcatttttctccatcctggcatttgtgtgaaccttactgtgtttcaccctgtctcctctttaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgagtatgtgtttatcctgaatgtgtgtctgggagtaaactggccagagagctatataatcagaatgttaaaatatttggaattgttgtcctttagtttgccaacttaccagcatcactagggatattgaatgtttgacacagatgtaaaatagctgtagaaacaattcaattacccttacactttcaggggtgatagcttttctgaggtcttaaaataatgtgggaagaagataatagatccttttgcaaatttgtttttttg

SEQ ID NO: 57864 - DNA, 1063 bp, Homo sapiens
ttgtgctttcttaacattaagctccccccggctttttcttttaacatttattttaggttccggggtacatgtgcaagtttgttatataggtaaactcatgatatcacggggatttgttgtacagattattttgtcacccaggtactaagcctagtatccagtagttttgcccttctctgtcctcccaccctccaccctcaggtaggccccagtgtctgtcgttcccctctttgtgtccatatgttctcatcatttagctcccacttataaatgagagcatgtggtatttggctttctgttcctgcaaagaccatgatctcgttctttttatggttaaggccccttttaattcaagtctcctttaaggctctcatcaggtgagttacagttgtagttttgtacagaacggggaagggaagaaatgactatctgacagttgaaacatagacatctaatcactaggtcagatcctggccaaacttgttaaagtcttgggagaacagcttaataatcatgtggtgcatcagttctaaaaatagactgggaactttgcaaggtcggtgtctcactaaagatacataataaccaaatgcaacgtatgaattgtaattgggtcctgttttgaaaaacccagcaataaaaaaaaaaaactggggagaacaactgaaatctgaacagtaaatgatattagggaattagttcttaaatttttcaaaggggtaatagtattgcatttatatgggagaatgttcttattcttagaagatatgctggagtatttagaggtaaagtggcttgaatccaggtggtagatatatggatgttttcaatactgttatttcaaactgatttattttaaattttcatagtgaaaatttaggaagagagaaagtttgcctcccaaaggcagtctccctgacatttctataataccaaaattattgtgaccaagaaactatttaaatgtatttagaagcaaaattatgtaatgaaaattatctgttgtcttattctttcataggtacccatttgaacctcctcagatccgatttctcactccaat

SEQ ID NO: 57865 - DNA, 1024 bp, Homo sapiens
aaaatagtgtttttgaaaagatagcaaaaatataaatacttagaaatcagtctaacaaaaattagataaagctttatagagaaaattataaaacctttggaaagcatcaaaaaaaagactgaaacagcgtgttcatggatcttaggattcaatatcataaagatatcagttatctccaaattgatctatagcatcaataaaattacaatccaaaccacagaaccctgttatgatttggattataatttcagatatacatatttatgtatatatttatggacttatgaactgattctcaaatttatatggaagagcaaagagtcaagaataatcaagtcattcctgaagaaaaagaccaggtggataagctatagtaaaacatcacattgtacaccttaaatatatacaatttgtatttgccagttatacctcagtaaagctgggaaaaaatttaaataataaaaaatgaataagctatagtaattcaaacagtggagtattgtctcagaaataatccacttgaccagtggaacaaattcaagagtcccaaaacaaatccacacatatagaaatttaatttatagtaatatcagcagggaaaggatggactgattcagtaaatgatgttagaacaattgactattcatatggggaaaaactttaaattggacccccacctcactcactatacataaaattcaattcctagtggattcaatatttaaatttgaatagcaaaattataaaatatttgaaggctatgtaggaatatctctacatttgggggtaaggaaaaatttaatacacaaagtataaatgtaaagaaagagattttaagattgattatgttaagagtatgtgtttattgaaagacaccatgtacaacatggaaagataagcacaaactgggggatatttgtaacacattaaaggattggtgttggctgggcgcggtggctcacgcctgtaatcctagcactttgggaggctgaggtgggtggatcacgaggtcaggagttcaaga

SEQ ID NO: 57866 - DNA, 1054 bp, Homo sapiens
tagggcaggcctcttactacgagtcccgtgatgacccgaggccgggcagcgcctgcgtattgaagccgagggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggtaactcctttcttggtcttagaggcgtccagtctcctacagatgagcctttgaccctgcgagccaccccatggggagtatcagtgttgccgccgactccttctgcatggacactgcccttttgggctaatcggtttcattcttggccagcttcctccactaatcaagtctttttctgaccccagggtcttaggaatagcgtcaccccgctgcttggtcagtgtttgtatttccctccacctacttgtgttgtcatggttactggtgatttttgtccctggtcttatccctgtagattagttatcttcacttatgtctggttggcgtgcctgcacaccgcgtcactcataggcacagtgtcatttgtttgatgccctttcagaaaattcagttgttgtgtgtccccgttatagaatatcttatatcacttaaagagtaaagccctttactgggtaaagacaagcaggtctgaaaccacacctcttgttttgttgatttgtagtacttcaaaacagtttgtgttgcct

SEQ ID NO: 57867 - DNA, 1120 bp, Homo sapiens
tttgcctatacagcatcttacaacatcctccattctgttctgaaatttctcctctacctctgtcctacataacagttgttcagagtttgggcttgaggacactctataaatgagacagttgagacagattgaaagcaaggtaacacacactctttccttaaccttcagtgcctctgcaacagcatctgaaattttctgtcttggcaagcttcacctaattctgagcaccctgctagtgaagtgctctgggaggctgggatttgactgcagataagtaagcacttaccatcaaaggagacagggggcgtttctcattttcatttccataaagggatgccattgctttgccaggctatgtggaaagtctttgccttaacagtgaatcttgagtcctctttcaggtttttacctgtccatattctacttttggaacatgaggtttctacctttttgctattcctgatcttttcctggacttaggaatgacttctcttaccaacaaatcacggaagcttttcttgttaccttggtactaccagtaagctagtcggggagagtggaatctaactcttctatttgtgatctcaagggatgtttgtgttattcattggtttgtatttttcattctacttcccttcttctaggacatagcagtctgaagtttggactacaggctatgttttgttgtatcattatgcttgatgctttcaggaaaaaaccaagttgttcagatttctcaagtcttaatctctagtgtgtgttctgttttcagcctcaatagtgaatttatattatcagatatacaaaattgattatacccagatttggactgttaaggcctagcagaaacaagacgcagctttaagagaggtcaactatgtttctgctcatagccagcatttccttggcctcggacagtgctgaggtcagagcaatgtagaaaaacaattttctgtccaaggggtcagatgcctgagagatgcaactcaaacacctacagtgaggggtaacatatacagacatttgtcaaaacttagtgaatgtatacctaagattcgtgcttttcactgtatgtaaattttacttcaaaagaaaaataatactgtaaagaggtatttaa

SEQ ID NO: 57868 - DNA, 1015 bp, Homo sapiens
tgtgatctgtttacatgtacaggaacttacatagagcttatattcatatttaagtataacattacttatatagaactatatttatgtttaagtatatcatttttgctcttgtgtagaaaggagggtcccttgttaactctggagataatacaagggtaatataataatagcagctaacacgtaacatttaactgtgtgccaggcttgaagtgtttttatgtacattagctcatttaatcctaattgtaactccatgaagtagttcttatgattggtatgataatttaacagatgaggaacctgaagcagacagaaataactcgtcccaagaacacaaaactacttaaccagtagacctgggatttgaactcaggaagtcttatttcatagtctgtgctcttaactgtatgctgtactgcttagggttatataactgctttctctcgtgtcttctaccatgtagtactctacctgtgggaggacatgacaataagtgttatggactaataatatattattagctttgactatataaaacgcttgatgaaaatatgctgggaaaataataaccttttatttaatatctccttttacggataatatttggtgtgctgatttatactttctgcagatttaaactgcctgtaatttctttgtggcattcactccttactcaactcagatcccaggattgtcttccttcttttccccaggcttacttgacagctatgaagcattgcccatgccatagctttcaggctgtgctcttgtgtcttgtgaaacacttgtttatgggcacagagtgatctggagttaaatagaaaaatccctctccatgggacaacaatttactctacatgccaacttggcagcagggtagaccactggggggctgtgattaagacaggtagccaagagaggaaggaggtttctaatccagactcatgctaataaacagagtggtaaccaaagcactttaatgagatctttgtgttttgcatttagtctagttagg

SEQ ID NO: 57869 - DNA, 1031 bp, Homo sapiens
ccagaatcttgctagttcaaagacatttttaaccaaacttctttcctcctataaggtactgggggtgggaggggagggctgtgatcattgaggactaagtactttttgttttttttttttccccttgaggcagttgctgtgtgttacactgttgccttaacaacaacaaagtcaggaacaattccaagggcttatctcctttaatctttacaaaaccttatgaggtaggtggtactcccaatgctatagatgagtacatatgcttatagttaagttagataccccactctaggttgtacacatcagcagagctggtttgcaagccctggtctgtctgactccaaagctggtgcttttatttattttacaaatagagatggggtctcactgtgttgcacaggttctcctgtactcaagcgatcctcccacctcggcctctcaaagtgctgggactacaggtgtgagccaccatgcctagccaaaactgttttaaacaacataccatccttcactttgtggagggtatggggaatgatttagacagttggcctcctttattttctgtaagatggttcttcacagattgatgatcgccaaattacatttttagattaggctagttttgttgttcttgttgttctgtcaaacttccttacagtgtcattcccgtaaaattttgtatcaaactggctgtagtggcatgtagctgtagtcccagctacttggaaggctgagacagaggctttttgagcccaagagttaatgaccagccctggcaacagagcaagaccctgtctcaaaaatgttttttatatcaaggatttgggatttataagacacaatatcacaaaatttaaaagaagagaactgaagtagtgatgaggtgaaggagattaagaaaaggagaggagaagtaagaggggaggaaagagaaaagacaagttttctcccgtttgatacctggactagctgggcttattttagggcctctggaatgtggctgctgttgtctttaaaggccaaagaatgat

SEQ ID NO: 57870 - DNA, 1023 bp, Homo sapiens
gtatttatgtttatgatgtgctttaatctaaggaaaatatcctgtcaaacttaagtggagctttagtaatcctggctgtctggtatctggtttctgtaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcaggtattgtccatttacatcaatcaggagtggttcactgggagaagatggaataggttttggaagcagaggctgaattagattttccgctatgacgtgtttccttttttgttggtttcctctctgattgtgcagtcttttctcacattttgctggtattcatccatggattgtctccctccctcctaccattcctctagcttctcactaacatgtatgatgtgaaacagagttgaggtacatggtcctaggaggggacttcttccagttctctgatttgtcattaatatccctgcaacgacctcttcttgtgacctgtaatacttgtgatcatttgttccgttttgacttatataatttcttttgtgtcattagattaattatatagatcttgagtatgcgatgtccagctggcacaggatagccaaacttatatgagggatttggactctactactctgtctgttccatttttccttacatccatacatgcttcttgtagctcttggtacttaatgttcacaggctttcccaaatacatgggttgccaaaggcattatatgtgcagttgttaactggactcttccagtatttcatatttcacctaatgcagggtttttaataggtatagcagtgttttggtgctccatttctgcctgatagcgctatccataagggccccaatgtggtttgggtcttcaggagtcaaatcttttctcttccatgcatacaagttaaattatagctttatagttagcaaaaaattg

SEQ ID NO: 57871 - DNA, 1069 bp, Homo sapiens
cttcaagaagctgaaagttaaaaacagccacaaaaaactaataattacccttgagttctagaaaatgaatgtgatatgttcaaatcagatgtttttccaaatagaaagtaccagagtggaggatacctcatagcttttctttttcttattgactaaaagactatctttatttaagcacatttattacagagaagaatatatttcttaaaaaataagtaaatacacataatactaaaactgtcatttcatataggagagtatttggtcagtgattcatacttactccagttttatgaaacatctagaattcagtcctcctttctctgctcctcattttgaatcttttattgtttggtcatgcatgtctttggcttaattagtgctatacaggagaactacataagtacggtatttttgttcagactgcagaatggaaaacccaccccatatacagatgaagagtgaataagccatattttttactcataaagcagatgaataatttgagtggggagaataaagattaatgacattagggtgggacattaggggccaaaaaaatcaatgactttttttgtttttgtttcttttgcacgtgctgtcactcaggtaatgtaaactaaagtttaggacaaatgtggaaaacagcagttctgaatcaaagaactatatagctcaatgatgggacagatcaaccatacctaatctctgttgtgttcagcattatgtctggtatggtaaagtgaagattctggttattttaaggctcagtggaaaagtcacatacataaaactcatacaaacacaacttaaagttcattttgttctctttgttgagcagtcaggatcactgaaactaggattttcaaatgcagtgtcaatgctgttatttagcagcaacagccttcctgattataagttgtatactttgcagagttaggttcttttaattttaaaaacttttactgaaataagtttagactcacatggaagttgcaaaaatagagagttcctgtgtattctgtacctagcatggtaaggtttttgaacatcaatagtattattcatg

SEQ ID NO: 57872 - DNA, 1668 bp, Homo sapiens
gctctagctgacctttccaatgctgtacatagataaggacatattttggccaaactggactgcttaatttcctcaaacctgccctgagctttcctgcttctgaacatttgtaccatttaagccgaaattcatttcaggccatcaatgctcattgagtgatttctgtagaaaactataggatctagcaggttgaaaaagtctttctttaggtttttctaatataggaagctgaaaggaaatgggccacctcactgttcttctaccccacgactgttctctgtttatgtccctctagcactgcctacttaactctgctgtagcactcatcattttggctgggaactctgggtttattattgaactcccaggtctcagctcaatgcctggtacataacaggcattcacattcattaaatgttttttgttgaatatatccagtcagggaatagaaaggtgtatacatgaataaactacatgtcacatgagagatataagtgtagtcaataggattcactagtaagacacactgtatctagttcagggaattacaataaaactttacatttgtatagtgctttttactttgcaccacacttaaacatttttctttaatcctcacaaccatactctgaggtatgtattattatcactactttttagaatgggaaattgacactgtaggaggttaggtgaattaggtttcatagctggcaagtggtgtgcctaagatctggactttgatctgggactccccagagtagtagtagggacccagtggaaattatctgcataagaagtgaaaggtaaaactgtagaaaaggatgagatccccaaaggacagattatagatggattttatatatgatataataatgtggagatagttttcagtttttatctgaaagttggagttggagcctaccaagatgggaataacattgagtttatttttttctgccaacagttgcaagagtttacaagttgttagtttatatccaagcattacagggccttaataatctgttttgataatgggcaaatcttttctattagcagaaaaggacatagacacaaagataagatttttatactagtacttgttaattctcttgtcttaaataacagataaaaagccagaagcctttgtcaatcattccaactctgaaagcaagagtagtatcacagagcagataccagcaccagctcaaaataccttctctgcctcttctgctaggagggtgagtactttttacttaatttgggaattagatttcaccctactgcagtagcacacatctagaaaggccttaaaggtacattcttgcaaaataataaaaatacatttttcctgtcataatctgctcccataacaaaaaacacaggctgggtggcttaaacaacagacatttatttctcacagttctggaggctgggaagtctcagatcaaggtaccagccagttcagttcctggtgagggccctctttcttgacgtgaatataaccaccttctcgccatgtcctaacatggcagagagaaggagctctggtgtctctttctcttcttataaggtaaccagccctatcagattagggccccaccctattaacctcatttaagcttcatcactcctcacagacccttatctccaaatatagtcacattggga

SEQ ID NO: 57873 - DNA, 1034 bp, Homo sapiens
taatttgtgctgctgttttctttatttactcatcctgactttcccatgagaattatttcccttcatactgttttttaatggaagaaagttaggaataagcttttgaaagctaaccttttgtaaataccactcaaaatagaattagtgttggatccagaaataagatgatataggtatattaagttctgcttttttactcaaaatgttttatgctgtgccagtattgtacctttcttgtgctttacttgtttttattttacaggagagagaaaacaaaagctatattagttcactagcaccccggaagctcaacagcacaagtgatattgaagaaaaggagaacaggtaatcctaaaaccagccaaaagatggtcctcatcctcttaggtctactggacatagtcatctcctgggcattactcttctgcatttttccctcaggtgtccttaccacattatgaattgtttattccttctgcttagaacacctctcaactcttatatccttgctttgctggttctttatttttcaaattctaactccaggttagacattaccttctttaggaagtcttccctgatttttccacacatgcattagttttattctaccagcaggctctgtaaaggtagggtctgagtctgtctggtttcttaaggacccctagttcctagcacagtgcctaacacatagtaaacactaaaataatgttatttaattaaattgaccaacttctaatttgtcagaaggtaaaattaaagtcttcctaattagttaaaataaatatagggattttgaagtattgctgcatctcagggcaaatgtgatctcaaaccttagccagcggtattggcatcacccgggtacattttatttttattaaaaataattttctttaatagaagcagggttttgctatgtttcccaggatggtctcaaactccagacctcgagtggtcctcctgacttgccctcccaaagtgctgggattgtaggtgtgagccactgctcctggcctgggtgcatgttagga

SEQ ID NO: 57874 - DNA, 1049 bp, Homo sapiens
agcgattctcgtgcctcagcctcccgagtacaggcatgtgccaccatgcctggctaatttttttgtatttttagtagagatggggtttcaccatgttggccaggctggtcttgaactcctgacctcaagtggtctgcctgcctcagcctcccaaagtgctggaattatagatgtgagtcactatgcccagctgcaaagcactttttaagtgaggatcaaaagtgacttcttattacaaaagggttagagacctttgacatgaggaatttggtacctgttgaaattaattggttcaaagttgataaaagaaagcaggcagtaatacttctcttctgtacagaaaactggtatataaaacagaataacctgaagaatgtgtctattagccatgttatagtttgcctgtctggctcttctctctctgcattgtatcatggacaaaaactggtggtaggaatcagtgttttgttttcctttcatgcttctacagagaatcagctgttaatctagtgaggagtggctcctatacccggcagctatggagggatgaagcaaaaggaaatgaaatcccacagacaattgctccctccacctatgtatcaacttacttgaaaaggtaccaggctcaaagggggtgggagatgtttctttcactctagccatgggaaatgggtaatgattgtatgcctttttatgtccaattaacaccgcagaaatgaatcaaaatgaattactttcaggtttcttagaattaacatcttgaataatttaaaatttattatcttaataattgaattaaagtaagctaatttcagattctcactacagatctggctttatactttatcctctccatcctattaaaactttcaatcagaagtggctttcagtaatctctgggcaagactgaatttaagttatccttgtccagtagctggttctccttatctgaaacagagtagttctcatcccatgtgctatttttggggggaggaagggagggacactataaagtggtggggggtgggaaatggggacagttttctatt

SEQ ID NO: 57875 - DNA, 1042 bp, Homo sapiens
attctactttcctgctttccctcattcagtatcatctctcttcctccacgttccttcactcttttggatgattgaccaaaaagaccatccttcaaagagtgatgattccttcattcttttggatgattgcctgcttgctgccagtgactcagctctagctggagttgatcacttcacttcccagttgtcataccctttctttggtctatattcatttcaagtgcacaatctgggtgggaaggtggtgctgggaaatggtgggtgagcagcatgtcctgaagaaagtgactgtgtgctgttttgcagtgcttcatttggtagaagtagtgaccccacaagtccctacatttcagccaatcgcaattcatctcctgctacctcacccattaccattggttcatctacctctcggggcagccagtggcaacctgcctcttcttgccctgcaccaatcagtgcaaacactactgcatctgtacatcatggcaggtaaggcttcttgaagccatttgagttgcattcatcaaagttaatggctctgaaaacacatatgaaatttgaaccaaagagactttatcactataaaaacaagttagaactcctgagaaaatgtctgaatttaatgaagatgcttttgctttgacttgtattaaccagtcaacagttgcatattgaataatcaaagggtatgtataattgtacttggtgtttggacatcagcttaatgtgactgatttcatccctcaacaacctaaccagttgtgattacaatttaaggatcatactattgtggtaaattaaatattgaaaacattttcatattttacttctattaattttccagtaattataataggaatctcttgtatttagtcttttaaatgacatgcaaacccaaatcagaaagaaagctaactcattttccaaaagcctatgataaccttctgaaaactcccagccaatgagagtattttgctggaaacattgtgagaagggacagatttgtgtttgtctaaactgtgttgtgggggcagtatcttct

SEQ ID NO: 57876 - DNA, 1019 bp, Homo sapiens
ccttcacctcccgggctcgagcaattcttctgcctcagcctcccgagtagctgggactacaggcgcatgccaccatacccggctaattttttgtatttttagtagagacggggtttcaccgtgttatccaggatgaggatgatctctatctcctgacctcatgatccgcccacttcggcctcccaaagtgctaagattacaggcgagagccactgcacccggccgtattactatattttacatatataatattatatattatataataatactatattgctattactataactattaagagctgcaactgagagaaaataattacagctgccatttgttggaccccattatgtgacaggcatttggttggctattatactgggatttagtttgctcatatgtaacgataaatctaaatagtagtggcttaaataaggtaaaggtttttttttttttcttgcacttaagaaagtccagaaatatgcagagctggcttagtagctccacagtcattaaaggatccaggttctttcgctccacagttcttgcatcatggctgccatttccatgggttgcctgatggtccagaataactgctgaagctatagctatcatggctgtactctagggaagaaggaagaggaaagaaggaagcagacaaagaaaaaatgcttctgaactgagaattttcccagaagtactagttgtctgcatatgtctcattggatacctctagtggccaggagactttgagaagtgtggacttttaactaggtatattgctgccctcaatgatatagggattcagttcataaagaagaaagggacaatggatatgggttagacaactagctgtctcatgcatacatatatcatctattctcttataatgagccccctattatatgaagtattattttatagacgaggaaactcagaccaaatggttaatcatctgcccaaggtcacacagctagtgagggcctgagataggatttgaactcagatttgtacatttc

SEQ ID NO: 57877 - DNA, 1009 bp, Homo sapiens
gattacaggcgtgagccaccgctcccggctgtcgttatggatttaagcatatcttttttctgtttgtcttgtgatagagacaattgttaggcattatttcaccattttgtaatggagaacctgtgaagcacagagaaggatcttttgttttgttatggatagtctacgttgacttctctggcagcaaagaaaggaaacagtatgacacaaggctcaaagaaatagaactaggatataaacttttgattaatttgagaagaataccagaaaaagaaatgaataatatgtgatgatatggtagaagaatagtgactagatattctgtaatttctttagagagaagttatgagagaatattgtgaattgacatagaagagatttaaggtagaagctaagaaaaactttttgattgccagcattaagagaaacattagaaaatgtgaccgagcaagaatgggtcattttctcctacttgaggaagtattaaaaatagaatgtactgcatttgggagtttcaaatgtacttaaagactaaggctataattatcccttgttaagattagaccaggtgaaatcttatcaaaatttagatttcagtttgacttcatattattttgaatatccaaaggaaggagcttttatatttgtgtgtattaagagattgtcttttctccaatgtatgttcttggcacctttgtcaaaaatgagttcactgtagatgtatggatttatttctgagttctctactctgttccactggtctatatgtctgtttttatgtcagcactatgctattttggttataatagctttgtggtatcatctgaagtcaggtaatgttattccagttttgttctttttgcttagggtggctttgctattctgggtcttttgtagttccatatgaattttaggattattttttctatttctgtcaagaatagcattggtattttgatagggattgtattgaatctgtagattgctttgggtagtatggacgttttaa

SEQ ID NO: 57878 - DNA, 1050 bp, Homo sapiens
gtaatcccagctactcaggaggctgaggcagtagaatcgcttgagcctgggaaatggaggttgcagtgagccgagattgtaccagtgcactccagcctgggcgacagagcaagaatccgtctcaaaaaaaaaaaagaaagaaagaaagaaagaaagaaatgtgaatggtttgaaaatacgtttaggaggataattccgacatggtagatggaacttataaggctcccttgcccattataaacagaaattcatagttgaattcagaagaataatagggaactctcagatgacaaaagtgaagagtactcaaaagccagagtagtttgagtgacccagggttggtgtcagacctatatgtagaccataaggtctggacactcagattttaatgccgtgtgtgtagaacgcatggctgtggacctactaaggctgcaagttgtaactaagaaactatatcaagctagaaatctcaaagggttcatgaaaagggtactttgcccatagctcaaaggagtggcaaggaaggaaatctatacaagcgtcagggtagggcagatgactcacttgtgagaaattttcactattcgtatagtttagaaatcccaaaagtcaaggatttaatacagaaactgtgtctgtactcttgaaactctggggccctggcacaagtaaattcaaaaccaccttgaaggaacacatctgcaatccagagtaaaagactgtaaactgtaaaaacagtttcaaccaaagatgaattcacataaaacataaacactgaaggtcaccatgagggaagagttctatgacaaactcatagatgcagactaacatgtaataaaagttttaaatgcagaaagaaacctcaaactattattggaataggtaacaagaattacagttgaccagctgtattgaagatagacacacgtataggaacagtttggtaaatgaatcaggaatggtttttaaagtataagattttgcaaaatagtattatctatatagaatcttgtttaaatgggaacccacatatataaagcacctaacaac

SEQ ID NO: 57879 - DNA, 2351 bp, Homo sapiens
taggcactccataacaatagccatttctggctgttactttatctccttatttcttatttcctttatttatctatttaaagtattgttataggcatgtatttctgtaagaattctcaagtcctctttagaaagagggaataagccaacaggtaaaccaaatctttctttcctctagccttaaaaaggcaagagaaagtctttgttctcacttttttttttagaaatctctgctaattgtcttacatgtcacccaactgagaacttggaaatcaaactagaaggcttttcattctttacttctcatatttagtctgtcaccaagtcttgtctgtcattctccttaagaatccttcaattccatcttctcctctctttctgttaactcaggccctcctaactgggccttcctctcccctgccccacccaccattccaccatctacagtgcagcattagtgatctttcttatatgcaaatctcatccaatcactgactcctgcttaaaatctgagaatggtcctgcaagcaatgctgtcctcccttgttttgtaggatgtctctctctttttttttttttttaattatactttaagttttagggtacatgtgcagaacgtacaggttagttacatatgtatacatgtgccatgttggtgtgctgcacccattaattcgtcatttagcattaggtatatctcctaatgctatccctccccgctccccccaccccacaacaggccccagtgtgtgatgttccccttcctgtgtccatgtgttctcattgttcaattcccacctatgagtgagaacatgcggtgtttggttttttgtccttgtgatagtttgctgagaatgatgatttccagcttcatccacgtccctacaaaggacatgaactcatcctttttatggctgcatagtattccatggtgtatatgcgccacattttcttaatccagtctatcattgttggacatttgggttggttccaagtctttgctattgtgaatagtgcttcaataaacatatgtgtgcatgtgtctttatagcagcatgatttataatcctttgggtatatacccagtaatgggatggctgggtcaaatggtatttctagttctagatccctgaggaatcaccacaccgacttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataagtgtcttcttttgagaagtgtctgttcatatcctttgcccactttttgatggggttgtttgtttttttcttgtaaatttgtttgagttcgttgtagattctggatattagccctttgtcagatgagtaggttgcaaaacttttctcccattttgtaggttgcctgttcactctgatggtagtttcttttgctgtgcagaagctctttagtttaattagatcccatttgtcaattttggcttttgttgccattgcttttggtgttttagtcataaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttgttttctaggaagtctcttattctctttagattctgcccagatcatccccttgcaacattttattcctgatactcctcagatttcctctccagagctatctctttgtggcaatttttgtcttaaattttaattatcagtacttaatatgtccagctcccttacaagatcttgcttcagaacagagcatttggaataggtaaagaagggtaaagtggtggctgggcacggtggctcatgcctgtaatcccagcactttgggaggctgaggcgggcggatcacctgaggtcaggagttcaagaccagcctggccaacatggtgaaatcctgtctctactaaaatacaaaaaattagccaggcatggtggcgcttgcctgtagtcctagctacttgagaggctgagtcatttgaaaccaggaagcagaggttgcagtgaccactgcactccagcctgggtgacagagcaagattctgtctcaaaaaaaagaaagggaaggtaaaatgggaaactggttgaatagaatgaacaaaatgagcacatgaaccagtacact

SEQ ID NO: 57880 - DNA, 1092 bp, Homo sapiens
actagtggcaaccatattgggctgtgcaggtatacaacatttccattattacacaaagttctgttggtcagtactaaagaaagtaacctatgaaatataagaaatgtagtatttggccagactgagaatagacatttagtgaggagacttagaggccgtttgttcagaatcagtataaatttggattcaccatggtttaaagctaaatgggatctttaaaattttagatttacccctttgttttacagatgaagaaaactagagttccaagagattaagtgattctcttaagaccaaacaagtaattaatggcagagctaaaattagaacccaggtgcctgttctttctattgtaccatagtattagcctcccgttcccaattaggaacagcaaggaaaatttgaactaaaatttacctcatagggtcctagcaactgtagagtcaaatgcatcctccaaagaagaatttatccctaatatttttaatgtttatagtttgttcatggcagtcttatagcatgttgacggaaatttctagaaatgtaaaaatcatactttcccaagaatggagtgttgattatgacagacttttgggaaatgtcaggggatgctaggagaagtttaatgcaggacattgttatccattagttcccgatattgcaggatttgctagaagaaatgtcttgctacataaatctacatagctagaaataccatggtactgagtggaggaaacagtgttcattgtggtgcaatataagaaaagctgtacctgaagcaggagaacatggttaaaatccctttaggtatataacgttgttacttgggtgttttagcatctccttaggcctttattgactcatccgtaaaataggaatacattttttgtgtctacctgaagtcttagaattagatcaaatgacatcttgaattcataaagtctgtaggcataggtctgtgattcccgtgatccccctaagtctgtccccctgccccggcccccagtagctatccatatgtacttccaggttgatattaaagaaggtttttttgggatctctgaagaacttttgtcgatgtaatcttatgtt

SEQ ID NO: 57881 - DNA, 1041 bp, Homo sapiens
cgtaacataaaacttaccagttttaccatttttaagtttacagtttaatggcattaagtacatttacattgttgtataactatcaccaccattcatctctagaactttcttcctcttccaaaactgaaactctgtatccattaaataattactccccatttccctctggcaacgctgcttccactttctgtctatgaacttgactatgctaggaacctcaaataagtagaatcatatagtagttgtccttttgtgtcgtattttacttagcatagttatcaaggttcatccatattatagcatgtgtcagagttcctcccttttaaaggatgaatatttcagccttttatggatactgcattttgtatatccattcatctgtcagtggacattgggttgcttccaccttttggctgtttaatgctgctatgagaatggctatacaaatatctccctgaaaccctgctttcaattcttttgggtacatactgagaaatggaatttgctggatcatgtggtaattcaatttttaattttctgaggaactgccatactgttttccttagcggctgtaccattttatgttcccatcagcagtgcacaagggttctaatttttccatatcctcaccaatatttttgttgttgttgtttttatgagatggagttttgctcttgtcacgcaggccggggtgcaatggtgtgatcttggctcactgcaacttctgcctcagggttcaagcaattctcctgcctcagggttcaagcaattctcctgcctcagcttcccaggtagctgggattacaggcacccatcaccacacctggctaatttttgtatttttagtagagacagggtttcaccatgttagccaggctggtcttgaactcttgacctcaagtgatctacccaccttggcctttcaaggtgctgagattacaggtgtgagccaccatgcccagcctgttttttttggtaatagccaccctaatgggtgtgaaaaagaagacaggctatactttagctcatcttttccaccat

SEQ ID NO: 57882 - DNA, 1039 bp, Homo sapiens
ttccaagtgccaatctccagcctcgctaatagtgcaggaagaaaggccgataatgaatcagcatagggtgaggcatcctttttgtaaaagtcttatatttgcttgtttcatttctttcagttaaattcttaactgtttttctcccttgagcactctctcctaatgctagcaggcatgatgccattatctatatgggcctacagagccacatgcctggtcatggcctagtgtaaattcctacatttctatttcaagacaatcagtagtatcttatgaccacctctctaccccagctccattttcatccttcaggcagtacagttgactcagctctgcaacaacaaatgagccagttaaagcggagggcattccattgaaatggtgctgttagctaatcagcatggatacagttgagaagcccagggcagctctttcctttcttggtttttagttcaataaaactatatctgctattgaggtcatgctggcttccttctcttacctagtccactccttgagaattataatatctattatttttaaagttatctcttcccaagactctaatatcttggcttttttttaactgaaatataatttacaattaatgcacagattttaaatatactgtttgctgggttttgacacttgtatgtaccagtataaccactacccaaatcaagatatagaacttttccatcaccttaaaacgtttcatcattaacgctcaagaataagtgatactaatctatggtgatagaaatcagaagagtggttgcctctcaggacagagaattgaatggaaaagatagaaatcaaccagcagtaatatttaattttttttttgagacagggtcttgctctttcgcccaggttggagtgcagtgatgtagtcatggctcactgcggcctcaacctcccaggctcaagtgatcctactacctcagtgtcccaagtagctgggagtacaggcacaagccaccacacccagctaatttttggagtttttctagagatggggtttcaccacgttgcccag

SEQ ID NO: 57883 - DNA, 1024 bp, Homo sapiens
atcttaaaaagttgagctcatagaagtagagagtaggactgtggttactggagtctggaaaagggagatagtcagaggttggttaacagatataaaattacaggtagggggaataagttctagtgttctatagcactaaagggtgaatatagttaatgataatttattgtatattttcaaatagctagaaaagaggattttgaatgttcctaacataaattatttttgatgctagatatgctgattaccttgatttgatcattacatattgcatatatgtattgaaatatcacttcataccacataaatacgtactattataatgcatcaatttaaaatttttaaaaagagagtatgtgatagactagtcatgcattgctatgctggggacagcaaggaacatgcttagaaggctggggaccctacttaagcccaacatagtgcatagttttagtctgaacccatctccactggtaaatccatgaaccagtgaaactaacaatgaatatgtaaaattgacatcttagcacctccttgacagatgtgtttaaaaacaattctgttttgtttatccacgttaggtatatgacagtctctgagaatcttaatagatcctttgtctttctgaatgaaaaataatctgcatcttaatttgaggaatagggttattctaattatatctgaaaatgcttttatattcagcagtgtgtttgctgttttctttactatagtagtaatcacatagaatgtttgccctggagggaacaagcataggtacgccacagaagataatgaccatttggatatttctatctttttttacctgcatctttggcctggattccattttctttacattgagttttatctattgctttcttactgttttccctgtttgctctggagctgttttccaagccaatcctgttgtataattgaatttatcactagagggcacaagtggtcaacagaaaagatattggtgagcaggcagaatggtgccctaaagctgagcagaagacaa

SEQ ID NO: 57884 - DNA, 1038 bp, Homo sapiens
attataatacagtaatccaggagaaaactgacggtggtttgtaccaggataatagcaggcagtaaagatgctgagaagttgtcatattcaggatatattttgaagttagaaccaatgagatttgctgttttcttggatatcaggtgagaaaacagaaggtcaaggttgacactaagactttttagctaaggcaactaaaagcatggaattttattaattgagatggagaatactacaggaagaatacagaatacatttggtgggggaaaagtagacatttggttttggttttagaattgttaaatctaataggtctgattgacatatttctacatggaaatgtcaagaggacagttagatgtaggaatctgcaattcaggtttaagggccaagctggaactacatcttggatatcagtaaacctaaagattggattttaaaaccatgagattgaatgtgaccacgaagagaatgaatgtagacagagaagaggccgaaagagccctggagcactccgaaattcaaattgaggagaaggggaagaatcagcaaaggaaactgagcaatcctggtacctgaccctgagaatatggatgcagtttccccctttttccaaaacgaaatcaaacaaaacacatggaacaataggcagttttatcattgttcttattttacctttttttttttttcaagggctatttcccatgaaatctgctcagtctgtttataaatggaccatgcaatggtataggagacctggacattccagggcatcttctggtgtcttttgagctagaaattgcttcctttctgcaaccttgtctagaggcctttgaagtccagggatgtcataagactcttcttactacatcagagggattctattaattaccatgtctgcaaatgatctgttaacttacctcttggtctcctttgccaaattttcttcagctctattacatctttgaataaatgtcacttcaatttcagttaagaagactcttgaggccggccgtagtggctcacgcgtgtaatccc

SEQ ID NO: 57885 - DNA, 1052 bp, Homo sapiens
gtagtgttggtatatccgattgacctttcctggatcagatgaacttccctgaaccaatttctatagccagaaattagatgagatttagcgagagaggcagtgaagcctgaaccctgaaaccaagtttaattcaagtccctcctctgctacttactgtgtaaccttgccaaattatatactccctgtgtctcagtttccttaactttaaaataagagaaatcatagtacttatcacataggtcatttctttaaatgagataatacatacaaagtgtacagaacagtgtctggcacatagtaaattatcaataaatcttagccgccatgatgatcataatgataacaatagtggtagtgctggtcatagtgatgaagaagaaacaagagcagcagctaccacttgttataggggtagggttaggagagggtcagctacatggaatagattccccacaggaaatagggattctgttatcaaaagaagagaaagagataaagggttggaaagataaattatagctaccaatagtcctctgtaatcacatccagtagtttgagagctgaagagtatctcgtaggtttgccagtaaggagatgttgctgacttgtgagagcagtttggtggagtggggctggggagcatgaaaggatgatatcttctctttgtgactcatctgcgtataacgattttgatggattttctgggaattaatagtctttggttagtagccatttgccttgtgggcagagctccaagatagtttgccgttaaaaaaaaaaatcctcataaaggcttaaacagggttcaaacagatctaatcgtcatatcatttggcacattgtggtacctgattccatctaaattgttttcccctaacaatccttagtccacatttctgctttctctccttgttaagaatagatggcaggtcaacattcttgcctactcctgcaagagcatcttgaaggaatgaaaggcaattatacttctgctgcaaaggagcattttccacatgttatgctaacagttatgaaaatagctagttattgga

SEQ ID NO: 57886 - DNA, 1345 bp, Homo sapiens
atggctagctgtgtgccaactttccatccttcagacctataaaatctgaatcagtttggttttttactgcattgtggtgaaattaaacaattcacataaatttttattgtggctgatagtcaaggctctaggaagctctgagatttaatcttgagttttccttgccacttcaacccaattaaaaaatttttttttttctttttcttttgagacggggtctcactctgtcacccgggctggagtgcagttgtgtgatcttggctcactgcagtctccgcctctagagttcaagcaattctcatgcctccacctcctgagtagctgggagtataggtgttcaccactacacccagctaattttttttttctgtatttttagtaaagatgggcttttgctatgttggccaggctgatctcaagctcctggcctcaagtgatccgcccacctctgcctcccaaagtgctgggattacaggcgtgaaccactgtgcctggcctcaatttaaaaattattaatccactcttaacttccatttagtggaactccaattttattctttcttttctcattgtcttccctacatttctgttcacatgaaatttctaattgtacagactttgcagtgtgcagagtcaaatctctcatatcctgtaactttgctgcatgctccttagttttttctttatctacacatatatctggtcagtttgatacatttttttcttttttggtcttctcagctattagaaacagacatgtttgtagaaaagaactcttaccatttgttgcgtctgggacttgtgtggagggtttttgttttggtctgggttggtttgctttttctatttaaaacttagattgtgtgtacacccacacagaaacttcatccagctaccaggctattcctttgtagagtggtgatcaaacaaaaatatgcatctggtgattctttcatttgatttgaaaactgatttcagaaacacattattttcttcttttacctggcagattatttctgagcaagctgaagaatggaggactcagcctacttataaagtaccaaactgttaaggtcacagaaaattatttctggaaggtacattagaagttgttctagcccaactctcttattttacagatggaaaacctggggcccaaaagagggcctggcttagcctaagctgtacaatgacttagtggtagaaaatgaactagaacatttctgaattcccagtccagcattctttccactaagctgatggctgtcttccaggtgcaggagtgcaggttggtacttattacaggactctgctggctgcagtggctctttctggtgctgtggaa

SEQ ID NO: 57887 - DNA, 1005 bp, Homo sapiens
agctatgttgttcacattaaaaagagataggttttcatttctgctttttgtaagccattgctaaagttaaatttaattgcaaaatactaaactcttgaaccaattctaggacaggtttgcagaatgattttcttaaaggacctttataatctattaccctgaaatgaatttctgagacttaacattcgtaacactagggcatgattaaatatatgggagcaagattgggaacattttgtcagctagtaaagttattgtgagctccatgctgtgcaacttgtatatcctgtcttgctttgcctctctgttgctgccttgtactccaaaatagcaccatctcttctccctactcccagcaacccactagactatgcagaagccattagtggatatattttgttggtctgatttttagcttttttgcttgttcacaaagaacatgtgtcaaaggccctttattacactgaaagaattgcgtgacttttctctgttctgcattttcttacatgtggaattaaggctgactctttactctaaaatgattcattttgtggtaaagtccctaatatgtctccctcactcaggagcatctgtgcaggagtcaacattaaatgtgagttatcattattgatcttctccatcacccccaaaaggggaggattttcacatcgcataaattaaacaggattgagatggaaaaatcagaagaagaagaagtgacaaagaacctcctgtttcctttagaacttatttcctgcccccaagtaatatttttggcccttctaagtacccagtaataaaacgtcgctataaaagcatagaatagtaaatgaagctgttatgaattctagactatcttccaacttggctgtgtgctgttgatggtctcctttaaaaataaattgtttgtttagtatgagatcaaaaattatttatataaaaatatatggaagagtagggcttgatattttttaacagtatggagatctttttagtgatacaaat

SEQ ID NO: 57888 - DNA, 1107 bp, Homo sapiens
ttccttgacttatatgaccttggttttttgggggtattttgttttgttttgttttgttttgttttgttttgttgttgcccaggctgaagtgcagtagtatgatcttagctcactgtatcctctgcctcttgtgctcagaggatcctcccacctcagcatcttgagtagctgggactacggtgggcaccaccatgccttgctaattttgggtttttttgttttgttttgttttgttttgtttttttggtagagacggggttttatgacattgcccaggctaatcttgaacccctgggctcaagagatttgctctccttagcctcccaaagtgctgagattacgggcatgagccatcacgcctggctgaccttgatatttttgaagatagcaggccagtcatatatgtccctcagtttaggtttattcagtgttttctcatgattagacccagcttatgcatttttggccacagtgtcatagaagcgatactgtactcttctcatttcatgctgtcagtttgtcatgttactagtggtcttgtctttgaggactggattgagatgacgtctgccaggtttctccatggtaaagttagtttttcctcttttgtgattaataaatgttgtctgatgtggtactttgagattgtgtaaactccagtttctcctctacttttacccactactttgaacatccattaatacttctttcttggattgattttacagtcatggttgccaaatggtaatttttctaactttattaccccttctacatttattagtaggcattctattgtaagcaagaagcttttctcctcctatttatttttttcattcatttatttatatcaatgtctactcatgggttcctagtcagtgggttataattcattgctatcattatttattatgatgctcttattatcccaggtttggctttttaagcaggcttctgtgtccttgtgtcatatcatttaagtgttgtttgaggactttctcaccttctagcacaagagatcaggctcattttctttccttaccccagctctggaattagccatttctccagggagccctgttcctcttagtacaaagtggcatttag

SEQ ID NO: 57889 - DNA, 1086 bp, Homo sapiens
tctgattcattctcaatctaaaagaatgagtttgtaaaactcttttcaacctatattcctcagaccaacttccaagtagttgatcacttcccttgatttaatttcacaaagttaatcataggaataaagaagttgtcaaggcagttagaaaagaatagcatattgagaaagtttgaagtgaaaagtataaatttcatgtggaaaaagggaaagcaggatagagtttccaagagtccagagaaaagagggttgttactttggggataaacccgttggcttagaaaacatttggcctagaaattttggttagtgtagtggtaacaacaaagtgcaaaagattaaattttagatgtttcttccaggtcaaatccaaaatccttcaacactatgcaaataaattcctctctttttaatttcgttttccctgtactactgagtcctgtagccttgcaattgcactactgtctgttttctctcttcatttctgacccttctttcttttccctcacctttataccactttccattgtcattttcccgattgtggcatcttaggaaactctggtaagctttatacttacagatccagccagtaaggtctgtaatggacagataactttctttgcagtgagccagagcttcagtttgcttcctcacggtgcaacaggaatggcatctcattaaaattgaacattaagggcctgaaggtgctttgactaatttttctgtctgggcgttgttacttaagagatctagaagttgaaaaatcccccttctcatagtattcggagcaatcagccttagagactgctgcctactctgaggcaggggacactggaaggttggtgaggtttgcctctgagcatgcccccaaagagcctccctttattcctagaagctggcaggctttcttttcctcctacaagtggtaacccgaattctgagttgaaagtgaatctttgcccttggctcctctccagcattcctcactgagcgaatagggatttggaatgtcagaaaatagaagaggggaggggaaaagatgtgtgtatgactgtgagtgtttatatgtaaaagcagcttcgt

SEQ ID NO: 57890 - DNA, 1528 bp, Homo sapiens
cccatctctactaaaattacaaaaacttagctcggcatggtggcgggcacctgttaagcttttcgggaggctgaagcaggagaatcgattgaacccggaaggcgggggttgcagtgagccaagattgcaccattgcactccagcctgggcaacaagagcgaaactccgtctataaataaacaaagaaacaaacacatccctcttcctcactagagaaaatttcatccatccttttggcatgccctcactcgctcctaccgacagtaagaatgactgttataagtggtatgctcctaatattgctattttggtctctgttgatcctaaataatgaagtaattttttttactgctacttttggctttcatatgaagtttccattagttcagtatcttttttgtgtctaaaagttgagaagttcccttagtaacagctctgatcatctctgatttgttactcaggaaaagcggaaaaactttcagattcacttgcatttctaatgggaaccacaccaggtagatattgatgagaatttgaaagctcagtctcttttctcataccacgaaacaaccctaatataagatgctgggttcatacaattagtagtaaaactttcttttgacagtaattttccaacattaaaaaaaattatttttcttctgagtcttcgtagttaaagaaaaaattctaaactacaaatacattagacacttctagctcttgatttttaattactatgtatattattgggtctaacatttataaattctataaattaggaactactcaatttagatggtttagcatttttaaattatcctaaaagtaagagccaggtaatctttggtcagtattctcaaatttttcttatttgctaatttaaaaatttttcaatgcagggtatatttaaaggaaacaaatactagagtatgtccaaattgtagtgcttatctgatatttattatattgaataaatcttgaagtaagtgggtcattagctgaaccctgggaatcttttaattaggcacattttcattgaattggtatttgttataataggatttgacctgtatttataaagcaagatcagtagcattttcccatttagtctggattgctattccttcagttctaacatgtcaatttaaaaaaatgacaaaaacaaaaaaatacaaagatgttacataatatttttcagtcagccattaatgtgcataaagggaacatttaatcaattagctttgttttataaccagtcctacaaactaattagggtacatttgataaataattggatgataaaggattgttgccttcatgagagcttgtctacatagcaactttggttagcaggccagaggcattctgcctctttgccttccagactgtcagtgttgacaattattttttgcatgtgctttgtgccttcctctgacaagtaccaaacagttatttagcatattatcgtatcctctatacatccaacactacatctgatgcactaccaatctggaatccatttttactc

SEQ ID NO: 57891 - DNA, 1039 bp, Homo sapiens
taaatgaaagacacagttcctgccctcaaagaattggcagtctaattggggagataaagaaaatcaagaattagaacaccagggaggtgaattttctaataaagacataggttcagggtgttttagatcagccatgtggttaatacattagcctgatgtttggagaacaatagaagctagatggacaaagaaggaaacagtacattacaaaggtagaaaaagaatatgagaacataatggcattattctgagagctgcatatcggtgtggctagaacaaaagatatatttagaaatgtaataagaaatgagagaggaggcttagcaaacccaggtcacgtgaggcttagtatataattttgaggatttggggagttatcctgtggataaagaataaaggaatgaagatttgaagtaaagttgctgtgctcagaattgcatattagagaaataactttggcagctatggaagctggactgggaggagggtcaggacatgatcaggtcactggcctttgattgcagtattccgggtgagaaatgttaagggcctaggcagagatattttttctgggaaatacagagaagcattcagttgtttagaaggtagaattgataagatatggactgatagaatggggataaggatgagcctgagagagggcagagtcaggagtgactaccaggtctctggtttaggtgactgggtagaaaatggtatgataagtatcaggtgcaggggctcacacctgtaattccagcattttgggaggcagagatgggaggattgcttgagcccaggagtttgagaccagtctgggcaatggagtaagaactgtttcttcaaaaaattgttaaactagccaggtattgtggcacgtgcctatactcttagctacttgggaggctgaagtgggagaatagcttgagctcaggaggtcgaggtttcagtgagccatgattgcaccactgcactccagcctgggcaacagaatgagactctgtctcaaaaagaaaaaaaaaatagtgtgacaaaattg

SEQ ID NO: 57892 - DNA, 1067 bp, Homo sapiens
gtgaaactcaaacagtgggatttaaggcctaaataaggacttttaaaatttacgatatactctatgctgtattctaacaatattttggagggactgatcaggcttcttaggtgttcattgaggctgtgtttttttttaaaatcatctgaatgtatttcatagtttcagatgcccatacacatctgtgtgaacctaaaactccaagctatggggaaagtaaatatagatattaaatgtgagaaatgtgacccatgtgctagagccacacaagttttagagctcctcattcccctgttggtcattttcatcctatatagtacacagcatgtgaaaggctcgatggaaaatatgccggaggctgcaaatgcatttatgaatcacaagagtttatgaattatacatataaaatggcttgccttaggtattttatggaggccttagtatatccatatatttccttctacaatgagtgcattttgtgagtttccaaaagatcagaaattcttcagaagctgggaatattcacaaaagggaggtgcaggtctgcatagatgctaagagctttaaaattctaataatattaggtagcacaatagagacaacaaaagatgagtctatcatttaatgaacttaatggtttttcttttaaaatatagtgatatgtgctgcaatatgtgagatgatgttacatgatatcatttttacatgccttaaattgatagggtagtcacaatctggcatatgagatttttcagaaatatttataatatgaactgaatgtaaatactgtatttgactatgtttaactttttgttctatatgtattaagtagtcagtaaagacaaatcaagacatataatatgatgaagacatatgtgatttaatacttgcttttaaaagttaatttttccttggaagtatactctcttacacatatgtataccaggtcacatggacgcctgtttttttccctgcataagacagcacttttggtattgccctgattctgaatgtatgtaatcacctagtgcagctgagaggccatgtgctatggatgtttcttttag

SEQ ID NO: 57893 - DNA, 1070 bp, Homo sapiens
ttgatttatagataatggctaagattgatgcttggtaaaaccctaattttcctgttttaatgaaaaaaaaaaaaaaaaaaaaaaaaaaaagcttgtttcgtcaccatagaggcagctgccagagtctacacagcagaatttaaaactaaagatatagtaaaatcttacccaacaaataggatatttacaaagaagaaactaaaaaaaaaaaaaaaaaaaattcaagtgaggtttcacatttcaagaaaaagtcagcagcaaaaaagcatgatttaattgtcagaaagttaggcctcagtctgcacaccatggagaaatgagctcctagttcaataggaggaggaaaaggcccaagggaccagtttgattgtaaacaggtcatttttccatacctaagacgatgtggaaagtacatctttggaaagagtgtcaagaatgctacccccatatgaagggtatagtttgaaggctgttctactcagaagcactgagagaaactaaatggtcttctaaattattgtttcatttggttacatgtgaattcaattccttgaaccaaaggtacgaagttttaacttggtactctaaccagcatcaatagccaatataatattctttttttttttttttgagacagagtctcactctgtctcccaggctggagtgcagtgacgctatctcagctcactgcaacctctacctcctgggcttaagcaattctcctgcctaagcttcccaagtagctgggactacaagcatgtgccaccatacccagctaatttttgtatttttagtggagatggggttttgccacgttggccaggttggtctcgaactcctgacctcaagtgatccacctgcctcagcctcccaagctgctggtattacaggcgtgaaccactgcacctggcctaatacgatattcttacaatttaaaaaatgaaagcagaggaatggtggcagggaagctgacattttaagagttcacttccttgtagttatcacagttaattcttactgttagaataagtggtaacttgccaaggtcacattgctagatgtcagagcag

SEQ ID NO: 57894 - DNA, 1018 bp, Homo sapiens
gtgtggtggtgcatggctatagttctagctatgtgggaggctgtggcaggaggaccctatgaacccaggagtttgagagggaagttacctatgattgcaccactgcgctttagcctgggtaacaatgagaccttgtctcaaaaaacaaaacaaaacacctcaatatctgaaggggtctttatctagttttttggagaggtgaagtaaacccagaaaactgcaaggaattattattacttaagtgccttttcttctgcttattcagagctatggtaatttttctgggtgtggtggaggaaggctgagaggtttacatgtcaccaaagaaccggaaaattgaataaagaccctacttttttataatctctgttgctgtcttcttctacacggctggtcagggtggctaggcgggcctcccgggcctcccgacgggctcttgctgaagcccggtcaccgtaagaatcactggttgtaggattactacctcccgattccaacctgtgggagataatattaaagataaaaattggttttgagaacaaagtagtggggagaaggtaatgctcaggggtagtttgcgccttttctaagaagtatttcggagccctggccagaaacaactcataacattctttccttcaatctctctgccagcgttcccagacctcagggctaaactgcacgagcttggagagggaggctgaccatcatttgccaagaatgaagcttattgaaaaattagtggtttggacctatgagctgacttaaatcttaagagcttttcatattagtttaggattgaacagcttccctcaaaagtgtgcttttaaaagtaaagatttcttgaatttcaatggctcttggaaaaatgattacaatgaactgtcaatgaatcagaaacatgtggacttagagatctgagctggaggttgaataggaatgaaatggccactagggcatgctacgtatgccttttaggtgctctacaggtttgctggaatcccaaacattttaggga

SEQ ID NO: 57895 - DNA, 1202 bp, Homo sapiens
tagaacaagttttccagctctgggagcctcccattgggtgcctggggaagcctgagcatggccataagctttcttccctggtgcccctcccaacccatccctttgctggcaagaacacagattgaatcattctgcagcaaaataaaaatgtattcacatattgatttcctgccccagtacattaactctgaaatattcagggatgcttggcactctcccactagaataagctcatgccaccagatacacttcacagctcactactttcctttctctcctcaccatgacctgcagtgaccatcacctccattagccactttaatggacagctgccatcctgggcagttttgagtgctaagaactggaaatctacccaaagcagtcaatttgctgccatgggaggcagtggggcagggggaggggaggagggtgaaaggggcaagatggatacagagctgcagggaatatagagctggtcagggtagccacctggagattattttgaaacatctgattcctgcaatgcatgatgacacatgcccataatcacttagcacctactcagcttttttctttcttcaggcatcttattttaccagatacatgatgccaagcattcatttggtgagacagggttattcaactgggaagccaaagcactgggatagtattaggcagatccccaaatgtctttctatgagcaagcatccctaatatgcagtttgggagagacatttattgttccagtggcctaaatagattggttatttattgaaaaaaaaaaaactttttaagacctgttgaggttatagtttacaccagatctggtgctcataatcaatcctgttactctataattccagaatgaaggagaaatgctgagccttgcccttgcatttcctaccactatcccaaggctgtaactgtaacattcacatagaattttaagcaatacctgcttatatctcaaacattttaaatcttccaagttgattcaagcagcaagaaatagaaataataaataattgattctcatgagatggtagaacagtatgccctagcacctaaacttctgcatcttgtgatttttttcaaacgcaccttactaccacacagaagtattctctcccgcttagagcagtgagttattagagataaccagttcttttttaatttttaagagatggagtctcgctatgttg

SEQ ID NO: 57896 - DNA, 1153 bp, Homo sapiens
agttttgtgccactgcactccagccaaggtgacagagtcggaccctatctcagataaataaacaaagtgaaagaagggagctgagtatgaggggaagattagaggaagggagagagaaaggggcagcagctagatttaagaacacaccaagtcctcagctctaatctcagtcatgatgaagggtccctgaagttatgcctcaaccatgttaatttggttcagaaggctccaaaccacatgctggactttcattctcaaaagcaatccatatgtgccttttgagagcctggcagttatattcatatggcatatttagatcttagccaagaatcagacatagctctccttccctgttgcttttctccatcatccttccacctgccacccatttgctccatgactcctgcctttctcatttcctttcttgcatgcaaactaaaaacaaaaacaaaaagtcatgtgatttctttgtcctacttttctctcctctggtctgtcttgtctctctctgtcttttctgtctgtccttttcatgtctcaatctctacagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggcaggttcagtcttcttgttagtcccagaagctctgtgctcatcccctccatccgagcctccatatgcaggttcctgcaaagcttggttatctgcagatggaagcagccaggactgagatcatagaatgggacataccagcctaggtcaagggaggcagtgagagagacctcagctgggctaccaatatattcatttggtaaggtcaccacattagcttctcttcccctggagactgagtatgaatttgttcactcagctacacataggtatacacgtgtatgtgcatatacctgtgtacatgcacatatacatatttcattgacggggtcattgccagatggaaattgatctttcttagccaatagcaacccaagtccaacccactcccctggagcaactggggttgggccttgggtaacc

SEQ ID NO: 57897 - DNA, 1014 bp, Homo sapiens
aatttcagtttctaggcgtcaaacatttttggtgttttgttttccatcccacgtgtaataaaagaatgatctttggagtcaggcacactgggattcaatattagctttgctgggtgccttgaactagttatggcacttttcatttccccatttgtagaaatcgggataacaactgtatcatagtctcatgaggcactagggagaccctctagcacagtgccatccacattatagatattcagtaattttctttttatttccctgatacaaattatttatgtatctgtgattcatatttgtgtacatacacatatatttatataatttaacctatatcttctctgagagatcaaggaaacagattatattccttaaggcacagttagatctcctaagtggttaatagcagagccagagctagaactaaataggcctcataacacctcagcacaggtcaccctttactgggggcattacctgcccctggggtcctataggttgaaatgactagtcaaaggacacctgtattgaacagatacagatgtagctttctgtagcctgcatagtggcgatgtacttacctgctatcctaaatcgctcttgctgccagtgggacccacacataaactgtacccttatcaacatcccattaggatttttcagatgcacagcgtacttgttgaaagtgcctgatcatgtaacaaagacttgaacttccaggatggaacttgaggctatttttcctttttttcacaagttagacaacagtatgtgtaatgttccaggatagcagaactaataaaattgagtttccactccctcccctgcccaacaagcatctatttctgtgaattacaatgccatcccctaaaactgctgatgaggcctctgggtatcctttggtgactgtcagtggggagctttggggaggattaaatacatgcctagtgttcactgtgcctcacagctctgtgagtgtaagttttctgagttttaattgttgaaagtggatat

SEQ ID NO: 57898 - DNA, 1325 bp, Homo sapiens
aaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggt

SEQ ID NO: 57899 - DNA, 1059 bp, Homo sapiens
gaaaggttggctgtgacagacagatgactataggttaaagggtgatgtcaaggacctcacaaggtcatgcggtctgctctctacctccagacagggctgcattcatctcagataaggaagatctgaaggaattgtctcgttttagaaagatctccactacaatagcctagagcaccccactgtgcaatgtgacagtccttgccataggaaagtctaatctaactcctttttggatgaactctggttctgtcttcggttgagatgagacaataacttcttactgggcattagggtgttgcggacgagtcccagtttgagacaagagagctgagtttaatttacaggctctgcctccaattttgtgaccttgtgtgaccttgggcaaggccctttcttgctttcctcgcctgtacattgagaaggtagaactagataacttctcaggcccttgcaaccccacagttctgtggctgcagttctgggctggtgtctgagtccaggaagtgggcttggctgggtgatgggagcaggtggtctccaggaattcccaatgcattgccctcccacttctgtcaccagagtcgagacaaattgagacaaatactgtatatgaatttcaaagccaggcacacccctggagggggagtccccaggagaccttggctctactggttattagctgtgtgaccttgagcaaattactttatatcttagagcttcagttactaagtagtcaaaacagaatgagaatagtggtggtattttagggtttttatgaggattaaacaagaagcatatgtaaatacttggtccagtactgagctgtctaagtcctcaatgagtggtagctattgttaataataataatacaagctgcgtagcaagcaggtggcagggcagctgtgagtagtggccatggggagcagggaaagattgtggacttgcagtgtgatcttcctctaccatcttgaaagcttccctacaaaatgggaacatcagctctgtctcactgtctctctgtctctctgtctgtctgtctctctctctctctctctctct

SEQ ID NO: 57900 - DNA, 1034 bp, Homo sapiens
tactttacaggggagggggaaaggcccttaattccgggacctgacttacctaccttgtgggggtgtctacactgcccaacattcagaatgttggggaactaccaggaggaatcactagtggtaaaggagcagcctgcagccctgggatgtctgagaggatcaggaggatgctgatgctggacagagaatgagttaaaccctgctcccccacagtgttccctgccccctggacactcaaaataactctgtagaacaaccttagtatgcagatgaggaaggggtgctcagagggattaaatgacttgcctgaggtcacacggctagtgagttgtggagccggactcctcccacaaggccactccacagagctgtttgccaagatagtcccttggtctcttctccccactccatgctcacctcatcccctcctcactttccccactgactctgcaggaattatgttattgggatcccaggatagaattacagccaccagcatccatgtgcttgagagagctggctggtccctgatgggggatgggttatgggaatatctgtgtgtgtatgcacacgtgtgcacacgtgtttgtgttgagggaggatctgaggcttatcattgcacatgtgaggtggtgggctcaatatgtatgctcaggggtatgtgctaatctccttcccttccttagggagtagggggctaagagtggtccagccacaccagcccctgcctttcctgatcacagctcagcagggaggagagcgatcccttcccttatagatcagatccagtaattcaggggtctcaggagattcagtctgggggcgggctccacaagggggttgaaagttccctcccttgctgaggctggcccgttggagctgctccgtgagccgttaaccttcctggagctgcaggccacatctagaacaccatgtcctgactccccatttggatctttcccccaccacactgtctttgtgactcccgtcaccatccgaggctgggtgaggaggccacccggggacatctctac

SEQ ID NO: 57901 - DNA, 2256 bp, Homo sapiens
ggatggtctcaaactcctggcctcgcgatctgcccgcctcagcttcccaaagggctagacttataggcgtgagccactttgcccagctgtaagttttaaagaaccatttactcagttacaaccagtaaagcaggcgtgtttcagaggagagtttagtcattgtttgcttaattgtcaggaacaatacaaactgctctggaagaataatacgggtatgtgcagggggtgggagggcaagaacaacagctttctgaaggggtgtttgtttctgtgtgtatcaagagaaagcaggaaatgggagctggctaggtcagcggtgatgaagactctctctcctgtcccagctcatttctgtttgctctaactatgacagcagggcttggaacaagtttgcagggatgaaggcctgaccagaacatcagggaaacaatccaagtgtgaggtagtgcaagtgctagtagacctatgatcaaggatggacaaaaagggaattctttaagcagaaggtgggtggcaggcaggaaaagtacaggggctttcagtccccagggaaagctgtgacaggggcacgatgcagcagctccctgctctcttctctctcctccctagaaaaaaacagaaaatgaagccaccaggaagcacactattcagcagaaagtggtaaaacaatgtaattgagggagttgtagactttcttcctgaaaaacgctcagtgttagatagctctcccccaccttttgtgggttcaaaatgaccttgtgtggaagcagagggattgccctgatggccctgcatgtgcatgcaattgagtgatgctggtctaagatactagaggctcatctttctacaatgatgaacagttgaaaagcaaagtatctaataataggctgggtgtggagggggtggatgtcttttccattctttcctcttccagctcctgaagcctgggggaataagcaagagggatgttgagctcttgattaggtttgtaacccagacactactggtcctgatgaattaaaagaacattaaggctgtagccagcgacaccacatttttcatttaaccaaattgattacagctctgactctcctaatagcctgggaaggcaggctggcttcctctgacgtgcttaggagaagaagctggggcaccagattgacacaaggctttgatcagaacagtaggcagctgagtctgctgccgtggaaaagttgaagcgcatcaggccagttcgcttggcttgattctgtgcgagggggctgcagccctctttctggctggagtcctgcagatactggttgttggcatggggagcaggaaggaatgaatagagtagagccagcccctttggggaagcaacaagtcctggaacacacctggctaagggtgggggtggtgggtaacctctttgaatgtaaaggtctcattagtccattgtaacttggctccccatttcctccactgcccttgttctggctgctccacaggtgaagggggagggcctctgtgcctcaggggctgtgagcacagcttcagcctgattgaggactccccagaggtcttcccccacctttttcgtaacatccactgagtcggcagccacttgccgccttgctctgaggcaagccaaactggggatagtctccaactggggatggtctgccagtaacacctggtattattggcacagtgatctgaaaagtgccctccactgcctcttctctccccaaagcctgaatcccacttgttctttgcatctcctcatattgcattcattccacctctcactcactcacctagtacgtattgaagactgacctcaggccatgtacggttttgtacccaaaagcgaggcaggatgctacagtcctattataaaagttaactccaggccaagcgcagtggctcatgcttgtaatcccagcactttgagaggctgaagtgggtggatcccttgaggtcaggagttcgagactagcctggccaacatggcaaaaccccatctctactaagaatacaaaaattagccgggtgtggtggcgcacgtctgtaatcccagctgctcgggaggctgaggcgggagaatcccttcaacccaggaggcagaggtggcagtgagccaagatcgcgccactgcacactgcactgcaggttgggtaacagagtgagacttgtctaaaaaaaaaagaaaaaaaaaagttaactccaaaagagttaaagcggatattcaaattgtgctgtaaggaagttctg

SEQ ID NO: 57902 - DNA, 1667 bp, Homo sapiens
ttcgagaccagcatgaccaacatggtgaaaccctgtctttactgaaaatacaaaaattagccaggcatggtggtgggcgcctgtaatcccagctacttgggaggctgaggcaggagaattgcttgaacccaggaggaggaggttgcagtgagccaagatcgcactactgcactccagcctaggcaatagagcaagactccatctcaaaaataaataattaaaaagaccaataaacatgttttgcttgtaggtcttagcatgtgtgcacatgtgcgtgcacacacgaacacacacacagctatcttgagtctagaaatgagaccatgtgcaatcaatgttctgtggccaggggttagggtggtaggaacaggatctaacaaagggtgttcaatcctcctttttgaacttttctccagccaggccctagacagtatgaggaggtaggcagctatcccatggcttctagactcactgggcttccttgggaaagtcactcaacctctctggagcaaacaatgtagagaatcatcattaggcttgctggtcttctggagccagaaataataacagttactgtaatactcaatacgcactgagcactgactgagcatcaggtactgtcctagatatcagataacctaagctgactctcaccatgctgctatgaaatgaagtcactaactcatggcctctgagaggtgagccgagattggaactcaggaagtctgtctccagaatccaaagtggtgagcacggcagtatgtagtatgcagcctcctttcagaagtcagcaaaggaagggaacttacaggccctctaacccaactccagctgtgagtggtttttctaaaagcataaaatggattatgcttagattccttcaatggtttccattaccttctgaagaaaatccaaacagttggtctacagaatctgtcatgagcttgcctttgcctctgatctttccctcctccccaaacctaccctatactctagctccactgagctatttacatttccctaagccacataatagaagctacctattttgttaaggccctgcttgctgtttagaaccattatactatttaattttcacaacaatccctcaaagtaggtggtgaagtcttcatttaacaaataaggaaactgaggcgttagagtagtcacatagctttctgactccagtgcttaagctcttcaatgagtgcactgtatacttttatccactactgctgtctttgcctgggatgccattctcttcattgcctacctagaaaaccagtctttcctctggtggtagctgaaaggttatttcatcagggaagcctgccgttatttcttgacttcctaccaggttgagttagtggctctctctctggttcccacagcatcttatacttttcttttggtacatgtttctcactccctgcatcaaggaggctgtgaaatccttgaagtatttaagtgttcccctccacgttgcccgctccctgcagggctcctgacagataataccctgggtggtggtattatctgcactctaggcaattgcttttttccgggtgtttttgtttgtttgtttgtttgttttctttttcttttttgagaccgagttttgctcttgtcacccaggatgtggtgcaatctcggctcactgcaatatc

SEQ ID NO: 57903 - DNA, 1553 bp, Homo sapiens
ccatatctgccagatccttggatgtgggggcaactccagcgttcttaaaaggaaggctggccgggcgcggtggctcacgcctgtaatcccagcactttgggaggctgaggcgggcagatcacgaggtcaggagttcgagaccagcctggccaacatgttgaaacttcgtctctactaaaagtacaaaaattagctaggcatgatgccatgcgcctgtagtcccagctactcgggaggctgaggcaggagaatggcatgaacccaggaggcagaggtttcagtgagccgagatcgtaccactgctctccagcctgggtaacagagctagactccatctcaaaaaggaaaaaaaaaaaaaggaaggctgtgcccaagtctactgcttttttgctcaggaagacaaattagtagcccagtctgaactaatggcaatcacagttatctttcttgcttgtaatatcaatcccctaatatactgaaaccatagggtggggcaggtgggatgggatgttggagaggaagtggctgttttccaggcccttcgggacaagccaggaggagcttctaataagcaacagaagagggcagcagaggaccaggattgagctgcttcccctcctagttccacgggagggaaagcggtggtggaaagacttgaatacctaaggccactctccattccgtttctggtctgtgacctgccctgaagttagacatcaggatctaatcttctgcaatgttttgcccctcacaaaattcttcagttcattgtgtatatctaacctgcttgctgtttggaagattaggttggagatttaatgttttttttttttttttttagtttttactctttttttctgtttttttaaaaatagagataaggtctcactatgttgcccaggctggtctttaactcttgggctcaagctatcctcttgcctcagcctccaaaagtcctgggattacaggtgtgagccaccatgcccagtctaatttttatctttttagtgatggagtcttgctattgcccaggctggactgggctgtagacctaagactgaagatcaggctttggattctcattctacctgaggtggagccaatccctaagccagtgatgatcccagttatgtgcctagcatactaaccacctactaggctttgtagatttgtatagaacggggacactgcactatacccaaggagcttgaaatttaatatagaaggaaactatgtaaaataatgtttcaagtttcttgttccagtgtgcgtgcacattgtgatggagctagagaagaaagagcaaggcttaggaaaggtgaaaatttgatttgagttgacacttgaaataaggttattgccaaactggccatgtggctttgccgaagatggagccttggcatgtttaaaataagactggtttacaaggtccccaggggtactctgtccttatctgcccctcccctcataagtttggtttgactgcagctccctaaagcaccacctaaggtaagtcaggggcattggctgcaaattgttccagtaatggttct

SEQ ID NO: 57904 - DNA, 2100 bp, Homo sapiens
tgatggaggttgttaaaaacctgaatttccctgcttcattctccagtgaagagcttaagaaaatgaggctttggatattttggcagaagtgtctgaaatgcacctgatttgccattatacccaccatcaaaagcaacatggccctttgggtattagtgcaagattagcctaagaatagagtagatctctacctggaagagggtgaaacatggctctctactgatttgggttgtactctgaaggccctttgtaatgggtttctgcctctttgtatttcacttaaaaaatcttgatggatatttggcagtctgttaagacctgcttctggcttggagcaggtattgattggtatttagtacccatgggtgtttttctgggctcagtcttgcctatgtttcttgccatatgacacataccggaatggattccagatgctatatacctgtaacaggagacagaattggacaacaaggattttaagagtcattgcccattgtaaagcattaagccagagctggttattcattatcagactaactacatactagtccatgctagtgtcagcctatattaaaatagtctttccttgccatagtgctggcgaaaacccaatcccttctgatgaaacattgcttcttgggaagacaagctgaggaaagcaatgaagatcccagtgtcggcctttattgagctatgtatgagggtcagggtccctcaactcctagtgactatgaagcagcagtgtgatggcttcgccctctttgcccctctgtcatcaatcctttgcatgtggctattttaagcttctcagctttcttttgggaggcttcatgtgtaacttattatagaaatgttactgaaaagctgcctaaacaaaaaattgtataaagtaggaatttgtataaagtaatactgttgtaaatccatcttcaagatgtaaagaatcaatttgtaaagtgtatattttcacttctcccttcaaatttatgtgaacaagtttttcatgtttcaatattgcttacataggaatacaccttacgtttttatcagtataaatggaacatttaaaaccagtcaacaacagaacagataatccagctccctgtttgtgttctgggttaattttgcaaggatgaagggctagaaagtggtgagtttcggtgtgtttcttattttcaggataaccggctgcattgcagtagaggaatggaatggtgaggtcatttgacctgttccaggtgagtggaggccaaagaacattctttctgcctccccttggatgggaaaattgagaaattaaaaagttgcctttctgaggaaacaaaagttattttctctatttaaaataaatgtccaaaggcacccctctaaacaccaaaacttttagctcctggcaaacttacctagctagaagttggagaagagtgcggtttcaaaccatgcttcctttctgcccttgccaatacgttctcactgactgtgattctgctgtgaacacacacacacacacaaacacacacacaagccccttctgtgtatgatcaggacaagtagttcaacagttaataaaaaagttaaattattggatgagaaagatatatttaacctaaatcataaatatgtatatccatttaataaacactaaaattgagaaaaattagtttggggatgagggccttcattcataatagccataatgcattatctatgatgtgagcttgattgagcttctttaaaatgcataaagaatttgaacaacaaaagaaatttgatttttttttttgagacagtgtttcactcttgttgtccaagctgtggtgcaatggcacaatctcgactcactgcaacctccacctcccaggttcaaatgattctcctgcctcagcctcccaagtagctgggattacaggcatgtaccaccacactcggctaattttgtatttttagtacagacagggtttcaccatgttggctaggctgatttcgaactcctgacctcaagcgatccacccgcctcagcctcccaacatgagccaccacacctggcctaggaatttgattttagaattctaaatacttatcattttctccaatcttttg

SEQ ID NO: 57905 - DNA, 1075 bp, Homo sapiens
ttctagttgtctgcagttttctgcagttgttgtgatgtttctcttcgtctgatggtggttctggggccaatagagaagaatagtctccagagtacaatttggaatcatcgtggtttggccttgttagtattcaaattcttagaatcccctccatcacccccgactttgagataggatgccaactgtcccagtcctcaccttccattgagaaattaagcttaaaaggagaccctgctgctaatataaagccactgcctttagagagcttttgccatcttagtaagcacaacccctacccccatccccactagtttttcttcttcacctgtgggtggtggtacacagtccctgacaatagcatctttgaggaagtcagatctttgtatctctgagtgagttagaaaaggtaggcatgtgtgtatttgaaccactccctccctggatgagaaccactgatcattttatgtgtgatgatgctgaatttaaagagaatgtcagttgcccaaagctacactgtactactagtaaataacaaagcctgggttttatcttccagttttcctacagtattcctcctaccttgtacaccatcacactactaatgaacacagataacgtttactttccagtttatgcctttgttgtatccctaaaatgactacagactgatgtgatctaaaaaccatgtttcattgtgtgttagctgtgaagctggcctgtaccagagaaacctctgaacttgtaggggaaaatgataaaatgcacatggaaactgacacttcagtttccatctcagtagtcctgcagctttgtgaggtgggagaggggaagggactgtgttaagttagagcctgaaccagaaggagggtcagtgggtaaagaaagaaagggtagatgaggtgtgccttccacctcacctaaatgaatactgtttgttttttgtttttccttccagattagactttgggggatttcttatatagaataaagggcttgattatatgtagcctctatcctggagaaaggttatgtaatttggactatgtaaaggaagttgacttctttacagcttcgt

SEQ ID NO: 57906 - DNA, 3252 bp, Homo sapiens
gttaaggatactgcggctgctgccacttccttctagtgaactaactgacccatcacatttaaggcccctgagaatatagttaggatagaaatctactaggaagcctgaagccaaattagggaagaacttcactaaagatagcatgagggctgatgttggcatttagaatttcatttttcatggcaaatttcatttgccataccaagtagtatggcacaatcattgaatgtgttcagttaatgcgccttacacctataaggtgtgggggtgtacatccttcaagaaggaagattattagtgtggttcctcaggagcctgtaggtcacaggatagacataaacacctagacagaaactattatagtagttagtcattcagggatttggtgaaaggaagactcttagtgggcacctctccatcttctggtattggttggttaattggaagggtaatcacgtctttaacattcctttttccagtgatcctttggtagcattaacagtgataggggaaggaagtatgttaaacccaaactggttgtcttatacaagactgggaggggagtggttaagatgcagtatttttttcccgtgtagattgggggatcatctgatttctaatttacatgttctctttagcttcattagttttagtaataggtgacccataggcgaaaattgaactttcctatcttccacccagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtcagtgaggtttgggccatagaggacgtgctttcccttaactcagaaaccctgtaagctagacctcatctcgctgggtctttctcctctgcttatctgctttgagctgatctgaatggattgctcagcccttcccccactgatatctgtgctcttaccatcgttcctgggtctcctcccttttcttgaagaaactcttgttcttccctttttccttttcttgctcttccagctttcaccttcccggcgctaagaaggtgggagggatgctgatgtgatgccctttggcttacttatcacagggcagcgctgtcttaaccccaaagcagacacgacttgaagaatgactttgactcggttgctttggctagggggccagctacactcatttggcttagctgttgtgccagaggtcccagtggtgggacagtggctgttattggcaaacggcctgaatttcttgaggctggcctgcccaattttgaatccattttttcctctgaaaaccccatcttcctgctctttgtaaccaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagt

SEQ ID NO: 57907 - DNA, 6852 bp, Homo sapiens
taacccagaaacacatgttgcacctaattgtcatctctttaagtttcttttaatcttgtagcgttttcctccccaccccactttttctcatgtcactgactagacagttatcccatggtatgctccaccttctggatttgtttgattgtttctttgtggagtgttctgttctctgtatttcctataaattggaagttagttttaaagccctggtgcatccaagttaaacatttttttaatataatgcattaaaatgtcaggtaatactgtatattctatattgcatcacaacaggagatatatctggatgacctaccattagtgatgctaagttttacattgtattggagcaacaccaatgcatttcatcctccataaccttaatgcttttactctcctagtttggctatctctttctaaaaatacagttcccagaccagcagtattagcatcggcaacagcagctttacctgggaacttgttagaagtgcaaatttatggaccttcctctgacccactgaattagaatatttggggataggactaaggaaactgtgtttaaacaagccttccagatgattcttatacatggtaaagttagagaaccactgggctgtctcaacttatattttagtttcctgaataatttatattgagttgctttaattaatcattggtgagtggattggggtaaaatattgttttgttgccttttatttgtgtaattcagtatgaaagtcttgagttactacaaaccttcatttctgttgaaatttttttcaaactgttaataggaaccaatgagatgaatgaatttagaagggtataaatagaacaaagggaccacagtatatgccatgttcacatttgtatccttagagcctagcacaaactaggttctctaggcccagcacagtggctcactgtaatcccagcactttgggaggccaaggtgggaggattgcttgaggccaggagtttgagaccagcctggccaacatggtgaaacaccatctctactaaaaatataaaaattagttgggcgtggtgatgggtgcctgtaatcccagctacccgggaggctgaggcaggagaattgcttgaacccaggaggtagaggttgcagtgagctgagattgcaccactgcattgcagcccaggcaagagtgatactccgtcttaaaaaaagaaaaaaaaaacaacactaccaccaccaccaccaacaaaagacccaaactaggttctctgtttgtgtaatgaaggaacaaatgtcacttctacccccaatatcattggtcagctggcaggttagtcagcgtttgtgaatttagcatgttgagatcatggagtaatctgaagtactcaatggaccaatctgaattaagcttttcctgtttttcatagaagtgttcttttctctaaactgctgtaatttttcttgacttattaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtaagtttacaaccagctcatctgcaagaccttagatctcctagtttggtaaaacatgcagttcatcacatacaaagatgacatcacagattaatctatattctgtgagttgttcttcccgtaaagccagggagactcttctaattttctggtgaagcaacctttaaatgttttcttggttgatttagcataacagtatctaaagaagaaaattttttcctattgggtgaaattcctctgtgttgaaattggactcttaaacttggccgtgcttcgcccacctgaatttagtaagcctgataaatgatctcccccattttttaaaagtgctttaactgcactttttgtattttctgtaaacttgcttgtgcatcatgactgggatcaaccagtatatatcacatttttaacttgttacttaattgaataaggaatcagtctatcttttatgagtcttcctcctccttttgtaaaggagagcctcagggttgcatgttccaaagaaaatcttcaatactaagaaatgcacatcctttttactgcttaggcttttattttgggacttcctacataatgctttatctgaaatttattttaccattggttgtgccttgtcccacattaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctgtatgtagggtttttttcttctcctttctatgttattgggaagaataatttctaaccctttctgttttataggaatttggagaaggcaagtagagtaacttgaaagcgttcagttttactaaaaagactttttgaaaattgtcaagtgttaagagttttgaatggtaagatgcatagaggtgggaaagattcagggtaggcttcccagtctcagggtcttgcaggcacagaaacagtcttgtttagtgcctgtgggttgatccaggaatgctaactaaagatattgagactaatattaatagatgtatgaaaatgcaatgctaatttattagtttatagttaagaagtacatttaaaagtttactggatactttgatactcatctggaataccttacatctctgacctgcatttagtaaatactgttgattcaaagatgatagtttaaagaagatgaggcaatgtataactaatgttacacattaagcaccttatcgggataaaaaagggatagctatgtgatgcttttaatggcacaaagcattgcccgttctagagtgggaatgtatacctgctactgggactagattgaatgggttcatctgtggatctggacaccttctcccattgatttctttgtagctgccagacctcttgtgatagacatgggttgccttgatttatttaggtattttgacacagatgttcttagtgtatattcgtatattcagtcaggttctagacagaattctgccatcagaggtcctccattccatctgtggtttgtttttataaagactaactgaaagttacagtccccctctcctgaggtgtatatatgttggtttgaaactttatatgcagtatcttttgtagattttagtctgtccatctgtctgtagacccctggttttaagaattctccctacgtattatctgttaatttatggtagaactcaaaggttagtcatttgctttccatctctaagctgtcagaagttaccttgttatcatataacccacacatattacctgtgtattatatttacaaaagaagtggatttttttttttttttaatatacccaaaggtctttacctgatttgcttttaggctttttttttttttttttaatagagataatggagagtttattctggccttgtaagggtgcttcatctggtgaatcgtgatggatctgaaaggggatagatgtggtgattggaaatggttttttaactgtgacagattttttgagaacttgtttactatgtgccaggcaaagagtgtcctatcccacatctcttacttgtcatctcaccctgtaaggtgggcactattatcacctccattttacacatgcagaaatttagccacaatggaatacatggcaccaggtcactcacagcttagtatgaggcagtcaggatttgaatacagatgatctactcaggatcccatgctcttaaccactaggactctgagttttaggggaaggccaagccatctcggacatcatccttgattgttaactctttttcagatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtgaatctggactttccttgttgggttattggaatttgcaaagctctgtacctttctctcgaacctgtagctttggtgttgctattcccttggtgtgatcactttactgttaacagcacccactttacctgtagcttcccacttcaagaccatgcaggtataacatattcttttaatttcctctgctcctattagaagttgtttcccaggcactctttctatagagcacatatttagcttttcacagatacaaataattttttcatttatatgtatgctgacccatttatattttacatatacgtatatgatgtatctttaagtctttgcttgactaaaaagttttttaccctgcttcttctcatgtaagtcaattagtagaaagggaaaacacttcctgccttttatcgctttttgccctttaagggaaaatattttttggaagaagtgtttgagcactgtgttatttcagaggaaagctcctgggttacacaccatttgcgatctttctgccaaaagctggattcttttgacatcactggatgggcagagttttctgttatcttccataggtggctgcagtaaaagaatgtgaagacaatagaaaagtacaatcaggaagacagtattcaatctttatgaggttaatctgatggtttttaaagttggtaaacatctctgtaccagagataccacaactctcttgtgccatatgagcacagacacatggattatatgagttaaattgttgataagatgaagaccaaacaaaaaaaaaaacagtctgtcatatttgtttccttggttttttatttctttgcaggcttctgaaatacagtgcctgacacatagatgatgaattaaatatttgttgcatagatgagttgtggcatttgtgcacactcccaaagtggagtcattggtgttctttacccaggatgtgctaggagtttacctttcttagtaaagggaaaggacacaactcttatattaattcatggtcaaaggagtgtttcccctagctcctttaataaaacactaaggaagataggaaagtggttatggatgatttctgacaggtcctcatttgatttactcaaaggggtacatatgtgttcatcgtattttaatcttcaataaggagaattagaaaaggattaaaaggctgtatgatctgttctcacactgagaaagtggcttatttcccagtggccttctttacatctctgaaatcagtccaagtaaaactggaaagattaaaggcttggtctttgggaagatatgagttgatttggccagttctgaaatgccaggagactcttcagtaggggaaaatcaagttgtttttttttttttttcccctggttgcctgcctgggtaatgcaagctactgtcattggactaatgggagtatttttaatcctgaagagattttattataaaacgttttccctccattaggtatctcaacctcctggcacaacatcattttctttgcctgatgactgggacaacagaacctcatatttgcactcccccttctcaactggacgaagttgtatccccctccatggtttgtattttgttattacgttgagggctggatagtaatgagtgatcttgtattactaggtttttattatagatgatcaagtaccataaaaaggactttatgctgaaatgtaggatataggctattatgtatttgcaaaatagggaagggatcctatttgaaggcttataaatgcaaaggaacagagaggaagactttatatccattgtcctcagggatgaaagggttcatgccacaccagctgataaacaccaagcttttaagtcagatgctaagtcatgggctctcttgttgcttcattacttaggagacttgtggagaatcttagggataatccacatttgctagagtcctgatccttagtcatagcatctcagtgtatgtctagtaatgtggttagagctccttgatctactcagactgttgacactgtggccatcagtctgtttctgtgctttctgttagaagtcatcaaggcagaagtacaatctcttctgcattagcaataaggtaaatgagaagaggattcagtgtataattaatactagtaatcagaagacttaggaaatctagttttggctctgtttattatattgtggctttaggcacattaaacctcacttcaactgaaggtaatttgtaatttaagaaggagagggtagtagtggtattaggggcagtccttctatttgtctcataaacccaaatgtgaatgtgaaacaccctttgttgttatcattttgatttggtctggtcttttacaggtgttagtccagaagtgaatgaactattgatggaagcccagctgctccaggtatcccttcctgaaattcagga

SEQ ID NO: 57908 - DNA, 3033 bp, Homo sapiens
atggctggctaagttctttaattttgtagagaggagatcttgcttgtgttgaccaggctggtgttaaactcctggcctcaagtgatcttcctgccttggccttgcaaattgctgggatttacaggcgtgagccactgtacccgccctaaaacatgtcaggtcttagcatttttatatttaagttcaactctaggcacttgtttaaaaaactccgtgttcagccaccaccctgcaaaaatcaaatcaacaaatttgttaataatttaaagcattgcaaacatttgtaagttacatttctagacaagaactgacaaaaccagtctcctctgaatttcataccagtagtaataaacataatgattacagaaaatatgacttttttcttcattcctaggccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactaggtatgcgcttctgactgcgtgagtttggattctttggcacctatgtttggaaacctgttgtgactcctgtcttgaatttctgtgaccacctgggtgtggtggacatgtatgtattcttatatggcttccttgggcctttgtctttacagatatcgatctggtggagggaaatcccaaaatcagttgacagtgaatgagctccggcagtttgtaacacagctgtatgctcttccatgtgtcctcagtcagacaccattactaaaggtaaccatagagggatgtgtgggagaatactttggtaatcctgtattttgtatataaactctattgatattactaagtaatcttctttgatgattaatatgtacatttatttgcagatgcttttaataacctattgagtggtatatgtatataaagagattatagtagatccacagaggggaaataaagttggaaatttttactttgaaagtgaccttggctgggcatggtggctcacacctgtaaccccagcactttgggaggctgaggaggtggatcatgaggtcaggagttcaagaccagcctgaccaatatggtgaaaccccatctctactaaaaatagaaaaattagccgggcatggtggtgcatgcctgtagtcccagctacttgggaggctgaagcaggagaatcgcttgaacccaagaggcggaggttgcagaaaaaaaaaaaaagagaaagtgacctcagctagtttaagctgggataaggtgtctgttatagtcacttagtatttgctgttagttggcttatgtgttatcttatttacctatattattactaaaattaaatgggatctcattgaatatgaatttaagattctaagtttgaaagaagccaattactgaaattactgttttaatgcaacaacctgtgtatttttttttaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggtgaaaaagcagacttctctttctttgggaaggttggacagttatctccagcttaaacacagagcacaatgattggtctatggcaagtgctcagtagctgcggttattatgcatgtggaagacatgtagaaatagctgagatatttggagctgctttgggacctgagtaaaagaatgttaattttttcttattttactgattaaaaatgaataattcaattggacacaccttttctagagttggtttaatgaaatttccctggatcctgttaatatcgtgtctttgagagaggaaaatatttacaaataggtgaagctgtttaaactcacagttaatacggttccaaggagtcttaaagagaaatgtgtgagagttaataggcactgttctgcaagaaaacagtgcagataattttcaacaggaatagacaatgtcatttgaaaaaaattatttgccatactgaatttcctttgaaatgctagtttttttggtaaccataagaaaaatgaaccatcatataaaatgctaagaagtctttgtttgcattttgtaggccacgacattcattgaatagccttgctacggcagtaaaggaaatcgaagagatccctgcatatctgcccaatggtgcggctctgaaagactcagtgcagagagccagagactggcttcaggatgtagagggcctgcaggttggttttaaaaagtatatacagaatgtgtaagtgcatccataaagagcaatattggcgccccgtccgggagggaggtgggggggtcagcccccgacccggccagccgccccgtccgggaggtgaggggcgcctctgcccagccgcccctactgggaagtgaggagcccctctgcccggccagccgccccgtccgggagggaggtgagggggtcagccccccgcccggccagccgccccgtccgggagggaggtgggggggtcagacccccacccggccggctgccctgtccgggagggaggtgggggggtcagccccccgcccggccggccaccccgtccgggaggtgaggggcgcctctgcccggccgcccctactggaaagtgaggagcccctctgcccggccagccgccccgtccgggagggaggcgggagggtcagcccccaacccggccagccgccccgtccgggaggtgaggggcgcctctgcccggccgcccctactg

SEQ ID NO: 57909 - DNA, 3795 bp, Homo sapiens
tttcgagacagtctcgctctgtcacccaggctggagtgcagtggtgcaatcatggctcattgcagcctcgacctcccaggctcaagcaatccttccacatcagcctccagagtagatgggactacaggcgtgcaccgccacacccgactaatgtttatatttgtttgtagagatgggatttcaccatactgcacaggctggtctccaattcttagactcaagcaaggcttggcctcccaaagtgttggaattacaggtgtgagccatctacctggcccagagtctggttttagggttggtaaatgatacgtgttaagacccatagtgtgatgtttggtaatttgataataatgggtcagaggtgtttggaaatagaagaaagatgaatgttatttttttctttccgtgttttgatacagctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattggtaaggcttatggaaatccaactgcatgttgtcattgggtattatttagtaaaatttttacgcactttaatatcattttaagcagtctttttaaagcctattttctttgaggccattgtaatagatgtatagtagtatctcgtggttttaatttttattcactatcttatttgccacatgtacatatgtctctttgaagtagctgttcaaatgtcttgcccctttaaaaaaaatgttttgtagaaacagggtctcactatgttgcccaggctggtctcaaactcctgggttcaagctatccacccaactcaacctcccaatgtgctgggattacaggcgtgagccaccacacccggcttgccctttatttttttaaaacatttggtttttgtaataattctttatgtattctgcataccagtttttttttttttaaatcagataggtgttttgctaatgttttctcccagtctgtggcttgtctttgattttcctaccagtgtctttcagcaagcaggagtttttcattttgatgaagtccagtttgttaattattttcttgtgtgaatcatgtttttttggtttcctatttaataaatcttgcctaatccaaagttacaaagattttctcctacaaagtcatctagaatttcatagtttgaagttttacatttaggtctttcatctatttcaagtaatttttgtttttcaaaaatatgagtcaaggttcatttttttgcatgtggatatctagttcttccagcagcatttcttgaaaagactatcttttcttcattaaattgctttggcacctttgttgaaaatcaattcaccacataagtatgggtctatttctggactcttgtgttctggtgatctatgcatctattctattgctaatactaaatggtcttgattattgtagctttctaagaagtcttgaaatcaggtagtatgagtcttctaactttgttttttttaaaaaattgttttatctcttttactttttttaatgtacattttagaatcagcttattgatttctaccaaatcaattcctgttggaattttgattgagactgcatgaaactatggatagtttgggggagaattgatatcttaataatattgagtcttccaattcatgaacatagtataattttatattgcatgttttttggcactattataaattgtacttttaaaaactgaatttctaattgtttattgctagtatttagagagacaattgacttgtatattgaccttgtctcctgagaccttgctaaagtcacttaattcccagtagctttttcatggattcttttagaataataatatctgcaaatagtaatactgtttttttttttttttttaaaaatatgtgcctttttgggtagaatcctggaatattggctctctgcagcccatttacattttaacagcaggttacctaccttaccctcttatattttacagttgggggaaaatagtgcccagagggtttaagtaacttaccaaagtcttacatcaaaaatggtagctcatttttagaactctgagactttttccatatatggaatttacaaattaaaattaggtatgaactacatgattgattctcaattaaaatccatggagttggtccttaatcttattttaaacaaaaatgttaactttctccatcccatgaagtcctttttaatgaccaattcaagaataaaaccaaaatctaattagcattttccttaccttcctcatctttgttggcccatataattggcagatatgaaatagttaaaaggttaaaatacaggataacagaataaaagaaagaagcccagtagttcataaacgactggcattctcaaggctggattaggatccagttttagatagggagaaaaggtgatagaagtttggtctttaaatgacaaaaggtgtatccaagaagggttctctagatgttaggtggtacagattatgttgaaatttactggttcaagaccttatttttcctgacagtcttttaggaggaaatgtttaattatgactttagtctttgctattgcacaaattttctaactattcagttaatgatatcctttcatataacttcctgtaaaaggctgagagaccactcagcatcttcccaaactcaatttctgcacgatagtcttttccactcgtcccatcttctttccttttatttttgtccttttaatagattctccatatttcctcagaagtaggaaacatattcctttcttttaatcttatctatacctcttatctatacccaaaatgtggacaaggctaatttgtagtagaacagataactaatctcagtagttttacagtcctatggtgttcatactcagatcaaaatgaccaaacataaggacctgccttgtctgaaaaaggagatctccctagacaaatgaacttgcctgtatttgctaggtcatttgtttctttgtatgccacacatttttaatcatgcatccctattttggtaaagcttttttttttttttcagactcaagtactactgcatgtttgtcttgggctggtggattatattatcctttggaggtctctctaaagtatactttattctagggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtaagtaggaagaacgattttttttcctatggaaaacagttgatccttactaaaagctcaatgataccgcagttctagggctgaaatgttaagtataaaacatctagttttctccaaagctacacgtctcaaagctaagtgtggtggtattatttccaggtataggtacacgctggatgatctctaccctatgatgaatgcattgaagcttcgagcagaatcttacaacgaatgggccttgaatgtgaatgaagctttggaggcaaagatcaacaagaagaaaagtatgtgatacagaaagtgacttggtgattggcaaattggggcttattgtgatgtagccaaattaaagtcaacaaaacatttcttgaaacagcc

SEQ ID NO: 57910 - DNA, 1132 bp, Homo sapiens
attattatataataataagctcagtataaggatttgtgtgcctagagcaatataggtacttttggggtgagggtggtggtaggaagaagggaatgatgggaggtaagtttgagttccaaatgaggaggacctctgtatgttatgagattcttgaaatagagtgggattgctttaattggtggtagaagatgctacttgaggggtaataataatatattaggatattcttaattgcagctgtttttaaaagttataccttgaaccttaatatgggcacatttttgttttgtgttcagatactaatcaactttggtagtctgggatactgctccatcttgtgacataaattagtatctctaggtgatattctactataataatttgttttttctggctcaatttcagaaagctgcctttttttgaaaattatctaatagactgtgtccagattgtctttagtaacaatgtcactctttaagaaactcaaaaatcttcaatttctgtctctttaggtttaccgaactaatcagtgtgctggggagtttgtgattacatttccaagagcctaccacagtggttttaaccagggttttaattttgctgaggctgttaacttctgcactgttgattgggtatgtaattacaatgtagttaaccttttcaaatttattgtttttcctgaggaaatggaatataatgttttaaagtgtcatgtgggctgggtgcggtagctcatgcctataatcccagcgctttcggaagccaaggtgggcagatcacctgaggtcaggagttcgagaccagcctggccaacatggtgaagccccatctctactaaaaatacaaaaattaggcgtggcggtgggcgcctgtaatcccaattacttgggaggctgaggcaggagaatcacttgaacccaggaggtggaggtcgcagtgagccaagatcacgccattgcactccagcctgggcaacagactgaaactctgtctcaaaaaaataaataaatgtcacatggatagttgccttgacccattactgctcagctggtcagtctgcaaattgtttaccagtccacaatgagataaagcacttgtaccacagtgtaaatcaagcatgaattacctaagc

SEQ ID NO: 57911 - DNA, 4755 bp, Homo sapiens
tccttatgagaatctaatcccccccccacctcccagcccttgcgccctgcccttccccatccatggaaaaattgccttccatgaaacccatccctggtgccaaaaacacagggacactggcgaccactgctatatactgtgttttttgtgttggttgcctacattgctctcagacaggtccagtgaaaagaatgaaaggatggactcaggtaatgtatttgaaagcatctcaaagtataaagcatcattgaaacaacaaaccttattactgtgctgttgtcaactgtacagtgctatacgtcattcagacacaactaaccattattactatacagtttatgttacattttttgaaacacagaaatatctcccggtcataaataattgctttccttggctcccttttacagttgtggcctggctggtgatagaggaacataaattccttttagacagtagaggtttcctgaattgcctaagatcaattatagaacattatagacacaatttttccttaggatgctgttctttgattcccatcactgagcttaattggtcacagacagtttgtgaggaaactcattttttctattccttgtatttccagatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggtaggcatataagtggcttggaaattgaggtatttattgaaattctgtttggttggcttgaagtaacttatgattacttttagcaaatccttaattaccagatttttaatgatttcaagaaaagtagaaagagcctacagaagaattctagtcctaactatgtcactatgttgtggtcataggggaaaattacttatcatcctttgccttcagattttataaccttggtttctccttctgaagaaaacctgaaggcctgagaccaggtctatttattttcaaactttaatatttttgagtatttttttccatactagcgaactcttaggaagagttctgtttctatcttggtaggaaagtgtgatttttttttttttttggtagttttctttgaaagtattacatatgatcagaaaagtacatagttatatgtatacagactgatgaatttccacaagctgaacacacccatgtaaccagcactaactaaaacaagaaataggatattcccagcaccccagaagttcccttttcgcccgctctccttcactacttttcctctttcaggacgagcactatgccctcaggataatcactatcctgacttctaacactatagattagtttgcctgattttgaactttgttaaagtggactcatggcttatgttcctctatatatatttaaaaagagacagatacagaagtatgtgctgtgtgagtccatttatacaaagctcaaaactgggcaaaacgaatctctgggcatcctagaaggtcagcatggtggcccctcctcttccacatttctttttttattttgaaggataatatttttagctggccttctaaaacgttagcattgtatagctaaacctttatcctcttttgtcttcttatttttaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggtgagaagttccaaaaagaacccatgagtagtatgcatgctggataggaaaactttccttttcagtgcagatgtgtcttaactgtgtctgaagagcattgaactacttttttccctaaggtttttcacttctgttagaacaggcatcctgacaagttaagacagtggttcttaagattcctagagcatccatgaattccctgaaattgcacacacactactttgcaagaacaacgtaattctgggggaagggtagtttttatctgaagtaaggaagtctttgtctaggccgggtgcagtggctcacgcctgtaatcccagcagtttgggaggccaagatgggcggatcacctgaggtcaggagttcgagaccagcctggccaacatggagaaaccccgtctttactaaaaatatgaaaattagctgggtgtggtggtgagcacctataatcccagctacttgggaggtggagggaggagaatcacttgatcctgggaggcagaggttgcagtgagccaagagaccgcaccattgcactcctgcctgggcaacagagcgaaactctgcctcaaaacaaaaagaagtatttacctatagaaaaagcatattctaaataaaagttacttttactatagaaaatcccatttggtggcagtgctagcctggatacccctttgggagaagcgtgaattatagtaggtaccacagtgtcctccaggtctgtgtaatgactagcctctcttttgttgtgttgaattcaggtatcactatgcacagtagagtgagccttatcttggtgtgcacattgagggggcaaggcgggagggatgtgcagatatttgggcttctttactttttaaactcttcaagccatttcttcacatctgttttcttctctatttttcttctaaatataaaaatatttgaaaatctgtaactcactcaaatcctcacacaaggaatttgaggatgtaccacaagaaagagaattggcatatatatgtatagaattaattctgcttccctaggcagtttctcccagctgtaaaatgaatattatatttaccatacctcgcagggatgatacagataaattgtttgataatttaaagtcctttgaagaataagaattccttagaaatgctaattgccttactagtgtttgatttaacttcgtctgccagaatgggcaagggaaaagaaaaatggaaagttgccttacccttgtgggttgctttaggaaactgtgataacaacatatcctgaagtgaatacgataccttatattcttagaaattctggatattggctgggcatggtggctcacgcctgtaatctcagcactaagctgaggcgggcggttcacctgaggtcaggagttcgagaccagcctggcaacatggtgaaaccccgtgtccactaaaaatacaaaaattagctgggcatggtggtgcacgcctgtaatactagctactcgggaggctgaggcaggagaattgcttgaacctgggaggtggaggttgcagtgagccaagattgcgtcattgcacttcagcatggacaacacagcaagactcagtctcaaaaaaaaaaaacaaaaaaaaaacaacaacaacaaaagagaaattctaggtgtctgcattttctaaagagtcagataaaaatgagagtggggagagggacttcagatgttcagatggaaagtcttctgttcatacttgaagggggaaaatgcattacatatgttcacatcacattccttttttgttttttttgagatggagtcttgctcttgtcacccaggcaggaatgcaatggtgtgatctctgctcactggatcctccacctcctggggtcaagtgaatcttctgcctcagcctcccaagtagctgggattacaggtgcctgccaccatgcctggctaattttgtatttttaatagagatggggtttcaccatgttggccaggctggtcttgaactcctgacctcgtgatctacccgcctcagtctcccaaagtgctgggattacagacgtgagccacagcacctggctcacattcacatttctaatgatatttcgtcagtttgtggattccttttttgcgtagtcttacaaagccgagtctgaaaaatatgaactggtaacccattttgtttgtgttggtgttgcagattgatttatttttataatctatttccaggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtatgttctgggttaatcctcctgccactcaagcttaattcaccacttctctttttcctttttattcacttttttatgatgttgatttagttctgtgttttccatagcatgacttgatagcagaaacagctgttttgctgcagtactgtacatttactcagtaggactggatccttagataccacaaaaactaatttgttgcagctgataactagattgctaaacagccttcctttgcaagtaataattgcaattcattggttttagtgtatttataagtgaaaatctatttcaaggtcttgagcttgtattttagggtgcccagtctgactgaaaagtctagaggttgctaaatgaagtgacaactatacagtcatgggaaacctaacaacagggatatgttctgagaaatgcgttgctaggtgattttgttgtcatgtgaacttcatggagtgtacttacacaaacctagatggtatagccaactacacacctaggctgtatggtgtaggctattgctgctgggctacaaattt

SEQ ID NO: 57912 - DNA, 2310 bp, Homo sapiens
tggcgtgatctcagctcactgcaacctccgcctccccagctcaagtgatcctcccgtctcagcctcccaagtagctgggactacaggcttgcaccaccatgcccagctaatttttgtattttttagtagagacagggttttgccacgttgtccatgctggtctcagaactccggagctcaggtgatcctcctgccccagcctcccaaagtgccggattacaggtgtgagccactgcacccagccattaggattattttgcattaatattatgtagcagtcagtctattacccttcttagggttgaattataatagtaaggaggtttattttaagtatagcatggctataaaggtttgagtgcttttccacgtagctatgttacaacataaggatatctccatcaatgggaggttattaggcatgggacagggataaattatttaatacctcataatagggatgaccttatcaatggatctggaatattcaagtctattggctcacaaagatctaaggcagcttatactgcccctgttaactcccagtattaggttataatcaaatattgctggcctgagagccattctgtttccatcaagtggtttatctctattttgatctattgtatgttgattttatagttttaactcccaggaggacattattgctctcattttcagtattgaaaacattatttgattttgaaggaagtcgagtctttagcctgcctcttataaatatataaatttatccaagttgtggttgttaaaattgacattttatttgctcattagcaaataaataaaatgtatttcacttgcttattaaaataaccacatttttcaggcaggtttatttttataatgtagacctagcatagaagtaaaataaacaaattaaagccttgttttttatctgccagcttgatgattgaccaagtatacttgatgttttcagtgtcacctagaacgtaattttctttattttcaggaatgtagtaagccacaagaagcatttggctttgaacaagcagccagggactataccctccgtacttttggggaaatggcagatgcgttcaaatctgattacttcaacatgccagtccatgtatgtacatatatactgctttgatttaggattttaatagcttttggagaaaagtgtacctgaagacccatttttagttgaggcctcactctagtaggcattgtcacacagaaagcagaatgaaactttaatttgttttgtggtatttaaaatttcacaatactttaaaaagcattctaattttttattttagaatttctctaaagatacctcttccacacagattatacagcaccagtaatagaacactaataaagaaaatcatcagcaatcattttggcccaacaaatataaagaatacttcacaaaatgtattaaatgactgctgtgtgccaaggtgtactatgcattgggaacacatttgttgtatattgttatgtaatcataagttagtattataaatttcaggatgagtccatttttaattcccctttatgcactttgaagcataagcattttccattcagcatttaatactccatcaaatgagtacaccaaaatgtaatgctttaattctggatatttaagctatgatttttgtcactactaataaagcactgcagcaaaccctttatgcatgtagtactctttaattggatgattttcttgggatgattattgaggtcagatgagagtcattctccctcattccatcccagttgctgtatcaatttatggatcccagcaatatatgagtgaatttgtttttccccagcacctctaacatcagctattagttacttaaaatgtttgcttatttaatggacttaaatttatactccatttgaattttcagttctcttgacttccttatgtgttataatatttgccaatatgtttgcttaaccaatcctgatgacttgcatgtaacctcttctatttgtggttaactgtatattttgacagaatattagatgaggacattgagggatagacatttaaatgttacctgcctctggatttacaccagattaacaacagattgacatttagtctggtgactctttattctaagggcgtgctgctacaagttgctccttttgttatatcatatatactggaagtccccaaccaccctttcccaacctggccattgaccaataccagtcggtggcctgttaggaacagggccacacagcaggaggtgatcagtgggcaaacattacacccgagctctgcgtcctgtcagatcagtggct

SEQ ID NO: 57913 - DNA, 1516 bp, Homo sapiens
ggggttttgccattatggcaggctgatctcaaactcctggcctcaagtgatccacctgccttggcccccccaaaatgctgggattacaggtgtgaggcacctcgcccagccacaatttgttcttgatcctttgacttttccctatttgtttttttgtttgtttgtttgtttttgagatagagtcttgctctgtcacccaggctggagtgcaatggcaccatctcagctcactgcagcctccatctcccaggttcaagcgattctcctgcctcagcctcccaagtagctgggactacaggtgcgtgccaccatgcccggctactttttgtaattttagtagagacagggtttcactgttagccaggctggtcttgaactcctgaccttaagtgatctgcctgcctcagcctcccaaagtgctgcgattacaggtgtgaaccactgtgcctggccaacttttccctatttttaaatttctcattcatgctttaatagtagtttcaaaggtgagctctcttccttaggaagagagagaagtatgttttgaatgccctgttaatagaggcaattggtaggatatagtcaccttgagattccagttggatttttaaagattatttcttcttaaaggaaatattcatgtatatgacaatttttttaaggccatgaatattaaaatagaacccgaggagacaacggaagccagaactcataatctgagacgtcgaatgggttgtccaactccaaaatgtgaaaatggtaagaaaatttgtcaatgaataggaaagaaaaagtaaataaagtaaaaataactattcataagtaaacataagctgaaaattcaatagaaaaaaattaaaaagtaaaatttagagcagccagtacatagtagtcactgggttgggctttgagaaaatcttaatatatcaacagtgtccttgttctcataattaactgactagtgggagagagaaacagaaactatatgtatgcatattaggagtgtggatgagtttctcagctgtagcaagttgctactttgaaatttgattcaatgcagttacttaagtaatttgtgaaaaacataggtgcctttgaccgaatgtctgatagatttatttcaggcaaggcaaacagacatgcttcctaaatctgaattgtggttaattgcttgcctgggtatcacttgatgtaagtcactgagaggtggatttgagattcttttaagagaaatcttatatcctatataggaggcacatacaaattaagaagttactaaaatttgttcaacctagggattagtgaactagtggaaaggcagcacaatgcacaggaaagtaatagagatacaatataaagtaatacagtaatcttggcacaaccgctaactagttatgtaaccttagagatgtttcttgatttactttaacatcagttttcttacctttgaaatgggtttgttgtgaaggattaaatactttatggaaagcattgagcacaatgcctaccacatgat

SEQ ID NO: 57914 - DNA, 1029 bp, Homo sapiens
tctagtgatctcgttcccataccagaggtatgaaggttttggattcctgcctagcctgatggatatgtgagttttaggactcagagataatatatagggaactgtttagagctgggaagcctcatattgcattaatcatactaaatcagtaactggttttcaataattatcaaaaatgaaaaaaatcagccattttgttttctgaagaaatagataaataagagaatagtttttcactttggtaagttggagataggaaaaaaatttagtgattcactttttctgaatgaaggagactgcccagaataggaaaatatggttatttgaagcccataagcatgtttaaagtaaattaatctatgaatcagttctttcttgagcatattcttgatcttatacatgtgtatataagaaatgccccagtgctgtggatgcctacatctgccttgatgacacctgatagtaatgatattgcccatggaataaactcttttagcagtggacatcattaaaatgtatgaataaacacaggcaaagtgagaaagcacagttccacagatacttcagtattaccacaaaaaatggttttatttgctttaccaataagtatcagcactttaagaaataatagaaactgagattggcttctataccctcaatgaggaaggagcccttaatagtttagtgatgttagaagtgtgtagtttataataatagtttattaaaataatttatggaaaattattgtggaagcaaaattttctgtaaatactgacagaccttggaataggtcagcaaactcttagaggctaatggagttatgacatttatataactacttaggatttggcttattgcgatgattgaataaagcataaagcaaatagataagaaccaagaaccttctaggaggaaaataagaattgttcttccgaatttgaatagaaacacttctctttgttttgagacagagattggctcttgttgcccaggctggagtatagtggtgtggtcttggctcactgcaac

SEQ ID NO: 57915 - DNA, 1011 bp, Homo sapiens
gcgaatctcattagtgagattctatggtagtaactatgctcatagtgttagtgcttcaggaaggttgttatttccacgtatctcattccagatatagctgctataacacaccctagagggttacttttggaacttacttttacaaaggtttttcgtgatgttcctgggtcctgttatgaaaaagtagtgcttacctgaaattcatattagcttcggtggcaatattttgtcgtgttaatgttatattggcattaaataccctcctttagccagcttagaataaaactaaaaagaaaaaccaaagaagagatgcatttctgatcagaaccaaagttattgctgtgggctacccgttgatctttgccttgcgagttagactttgtagggatatactgtggtaaatggaaaccctagtgaggaagactactttagtcaaatgacctgttttctcaattcaggtgatatctttggatgataactttgctagttatatctgaaactatacagttgtaaaatctagaaaacatattggattccttatttttttttattccgaacacttgttaaaaatgagatttttaatatggaaaattgttttgggagcttataaggggcctttctaacaatatggaccttccattaactgacagtcgcaagcacaaataactccaagtggttcattgggaatgccttgagactgttatggcctgttgtaacctgatgatgtcagcaatgaaaaatcaaagcaacaccacctgttaaaattttttttaatgttttaaacctgtatagatgtatgtatgtggttggtaactgcagacttgtctttatttttatttagatttttaaaaattgtaggcctgttgtctacataaatagttgtaaaatgtaccttacaaaaatccagtgaaactctctaagattaaaaaaggagggaatcctttcagtccttgcacaccggggaacaaggtcgtgaaaaaaaggtcttggtgaggtgccgccatttcatcc

SEQ ID NO: 57916 - DNA, 1232 bp, Homo sapiens
ataggctgggtgcggtggctcatgcctataatcccagcactttgggaggctgaggcaggtggatccccagaggtcaggagttcgaggtcaggagttcgagatctggctggccaacatggcaaaaccccgcatttactaaaaatacaaaaaaaaaaaaaattagctggatgtggtggcaggcacttgtaatctcagctacttgggaggctgaggcaggagaattgcttgaacccgggaggcagaggttgcaatgagccgagatcgtgccattgcactccagcctgggtgacagaatgagactcagaatgagactgtctcaaaaaataaataaataaacaaacataaaaaataaaaaatagaatgttgaatgtggaacctttttgcctcttatagtcagatctagatacagttgcccatagtagattaattttctcttcttgaactcttcctaagtacggaagtgatagtgaataaagggagagagagtccctttaatgatgctttgtgggttgtaacattttagaaacatgtcacttatatacttaaaaaggcaatgtagttttatggttaaaaagcacttaagtatttatacaatcaaggagtctgaaaggaataagcatttaaaggtacccttttgtaaacattgcatctacaatataggtagatatttgtgagggacttactctgtgccaagtatgttttaggaagtgatacacattctttgtagaaagtttaaaaacataggaaagtatggcaaaaataaaatcactcctgatccttccacctgttacttctctcacggctatttttatgcatacattcacaaattcaagtgtactgttcatatacatcattgcatcttaggtttttttactaatcatatgagcatttgctgtatcattgaatagtttttgaaaatgcaatttctaatgactgcggcaatccgttttttatagccagactttattttgatgtcttctattgtagaatgtttaggtcagttctagttttttattataatactatgatgaatattccttgtatgtaaatttttacacctatttctgatttttgaaatagttattagggagagaagaattgaagaacatatacttaagaaaaacagaggtgtacagtaaaggaattattgcaaaagggtgaagtagggtgtaagttaaatttcaggaagcttgagaaaagttgatgcactgttccagtggaacagaggcctc

SEQ ID NO: 57917 - DNA, 2421 bp, Homo sapiens
acagataaggaaactgaggctcagggtgataaaaaggtaaaaaaatgctgagccatggccgggcgtggtggctcatgcctgtaatcccagcattttgggaggtcgaggtgggtggatcacctgaggtcaggagttcaagaccagcctgaccaacatgtcgaaaccccgtctctactaaaaatacaaaattagctgggtgtggtggcacatgcctgtaatcccagctactcgggaggctgaggcaggaaaatcgcctgaatccaggaggcggaggttgcagtgagccgagattgcgccattgcactgcgggctgggcaacaagagagaaactccatctcagaaaaaaaaaaaaaaagaagctgagccataattcaataccaggcccatttgattctgaaatttacattctttccatcaaacatgctggcatgcatcctagtctttagtttttggaggcttatttaagagcccagaataagaccaagtattacagtcccttctttggtagagatttagttttaggtaacctggttctttccacatgattgctttggggatgtgaaaagtagcttagaggggacaaaatgtttatggaccatgttgtcaagagagatgttgaaaatttctaacttaaaattaatagtgtgtgtgtatatatatgtgtgtgtgtgtatatatatatgattggcaaaacatgtttttaaaagataaccatagccaagaacattttccccttggagtcatacttagatgtgattagaagtgacttccatatagttgtttctaattttgctattttaacagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaagggtaagtttgggggctagccttaacctgttttatcttactacttattggtacattgtcttttcagggaaatgaaaaagccttgattgtgtttggaagaccttgttttagaagaccttattttggtggggcgcggtggctcactcctgtaatcccaacactttgggaggccaaggcaggtgaatcacctgaggacaggagtttgagaccagcctggccaacatggcgaaacctcgtctctactaaaaatacaaaaatttgctgggcatggtggcgtgtgcctgtaatcccagctactagggaggctgaggcaggagaaccgcttgaacccggaaggtggaggttgcagtgagccgagatggtgccacttcactcaagcctgggcaaagagcgagactctgagactccgtctgaaaaaaaaaaaaagaccttgttttgtgttttttcctctagtgtttttgttctgctttgagagcagctatacttagaagtttgtttctggaatgagtaagattgtggaggaaatttttttactgtccaaagctgaggagttgattattatctacttgttacaactttgcattctctttaaatttaaagtagctaaagtattcctggctgtcatatgaaggtataagctgtgaaataacttgcctacctgttctcttctgccagctgagatttttgaggagattgtcagaatgttgatatggtaaaaggggattttataatgctacatagctaacgggttcctcttctagtaattcctatgtagccaagttcatttctgacaaaatggtatttgtgaaattattcacttaaaaacttttaggtaaaacagtactgtaaaagcttcccatttatttccaggccttggtagaaagaagaggggtgtcattatccattcacaccctttgagttattttaggactacagcagtgagtcctataactttaagaattgttttctgtgctgtagagaggtaggaagagaataacatagtttttgaggggtaaatcactaaccaaagtcctgtcctaatactatacacacacaaacacaccatctgtaatgcttaaatccagtagattttttcttccctctctcccttattgattccaggtgaacactttttagcctagaagaaagtagccaatctgacattcaaaacttttttttttaatacattatatgaatgtttagtgagcccatggatgaaattgtttagaatgttgaatgtgagccgggcgcgatggctcacgcctgtaatcccagcactttgggaggccaaggtgggtggatcatgaggtcaagagatggagaccatcctggccaacatggtgaaaccctgtctccactaaaaatacgtaaattagctgagcgtggtggtgcgtgcctgtagtcccagctacttgggaggctggggcaggagaatcacttgaacccagg

SEQ ID NO: 57918 - DNA, 1109 bp, Homo sapiens
gtcttactgtctcatccaggctggagtacagtggtgtgatctcagcttactgcaacctctgcctcctgagttcaagcaattctcctgcctcagcctcctgagtagctgggattacaggcacgcgccaccacactaggctgatttttgttaatagagatggggggtttcatcatgttggccaggctggtctcgaactcccgaccttgtgattcgctcgcctcagcctcccaaagtgctgggattacagacgtgagccaccgtgcccggccggccatgtataattatttaaccagctttattttgtgtatttttggccgtttctcactgaatttagaaagtggtattatatgattttgctgaaagagcattaaattaaaaaaaaatttttttaagtggtattgtacttaaatattctgtgaaagaaaataatggcaggtaataggagctttaaaataagctaaatgagatgaaaactcaattctttgtcttttaggcccaaactcgtgtaaaattgaatttcttggaccagattgcaaagtactgggagttacagggaagtactctgaaaattccacatgtggagaggaagatcttggacttatttcagcttaataaggtaaagagctaatgaccatcttacttattttataatcttactgacagaatgaatttgatcttctttgccttaaaaaggaacttattgctcagccaggtggctcgcacctgtaatctcagcactttgggaggtcaagggaggaggattgcttgagaccagcctgggtaacataaggaaaccctgtgtttacaaaaaatttggaaattaggcatggtggcacgggccctgtagtaccagctatttgggtggctaaggagggaggatcacttgagcccaggaggtggaggctgcagtgagctgtgattgcaccactgcactccagcctgggtaactgagcgagaccctgtctcaaaaaagaaagaacaaataaacttactttttgagatgtgtgaaatgagattctcaagtcagttgagtgatgaggatcatcaggtcttgaagccttgtggaatattttgcttccacctgtttttctcattttcacactttacaa

SEQ ID NO: 57919 - DNA, 3280 bp, Homo sapiens
gactgggtttcatagaacatatacaattaaaacaatgctttggtccttagttgatgttattcttggtaaactaacaagaatgtgcttttgtgacactgatttctaattggttttgtctgcagggagttagagccaactttcgtagcctctgtagagcatatactttttcattttgctaattatcagatctcaaaatgacagcctttctataattagaaggataaaaacagtattctaatatattaaatatgtggatgttaatagcacatcctctacagagtgaattttcctggcattttttggaaaaatcttcagcatcttttgaaagttgttctcacagtggttgactttattttttaaacatttctctcagttaaatctgcttttagttgttgttaagttaatgctggcactgaggaaaatgtttacctgatgtttctcaggcctctgaggattttgaagcttcaactttctacttaattgccttcctaaggaatacatttttgagtcctaaggaaactaattcaacttctttttttttttgagacagagtctcgctctgtccccagtctggagtgcagtggtgtgatcttggctcactgcaagctccgcctcccgggttcacaccattctcctacctcagtctcctgagtagctgggactacaggcgcccgccaccacgcctggctaattttttgtatttttttttagtagagatggggtttcaccgtgttagccaggatggtcttgatctcctgacctcatgatccgcctgcctcggcctcccgaagtgctgggattacaggcgtgagccactgcacccggcctgaacttttaaataataaggttcttgtactttatcttgtaagggttaaaataaaactattttcaagtttttttgtttgtttttgtttttttttgagacagtcttgctctgtcgcccaggctgcagtgcagtagcatgatcgtggctcactacaggattgacctcctggattcaattaatcctcccaccccagcctcctgattagctgggactacaggtgcatgccaccatgcctggctaacttaattttttttttgtagagacagagcctcaatatgtttccgagtctgggctggtctcttctcttttctcttctcttcttttcttgttagacagagtcttgctctgtcacccaggctggagtgcaatggcgcaatctccactcactgccacctccgcctcctgggttcaagtgattctcctgtctcagcctcctgagtagctggttataaagaatgagagaggtattttatcaggcatgcgccaccatgtccggctaatttttgtatttttattagagatgggatttcgccatgttggccaggctggattcaaactcctgacatcaggtgatcctcctgccttggcctccgaaagtgctgtgattacaggcatgagccatcacactcagcacccaggttggtcttgagctcccaggctcaagcagtcctcccccttttggcctcgcaaagtgtgaaccccactacacctggcttactttcaagttttgaaagtaaaggaaattaaaataatctcagtgaggaatttatatggaactgcatgtaatctgcaaattcttattacatctagttagtatgaaaaggctgttttatgttagaaaaagtgatttatgatcagttttattgatagggagtacaagttttactttttggccagcttacattatattccttttagacacttaagcatcaagttaaacattatcgcaatgtttctaagtggggatttggattatttatttgactacataatttgaggattatttttcaaaattttcaccttagaagctttattatgatctgttgtatttacctttcataatggcttcccctaccccccatttaaaagtcatggcttggcttctgccatgcctcacacctgtaatcctggcactttgggaggcctaggtgtgaggattgcttgagcccaggagttccagaccagcctgggcaacatagcgagacctcatctctacttaaaatgaaaagaaaaaaaaattcgtgtcccattgaggtcagactttgccaaaggtattttagttccgtatgatagtgaacattacaaataaatttaatttttttattggagtctagttttgcagctgacagtgaatgtcccaaaactgaatgacatttatctcttctctcattctttataaccagaagagatgacagagtttgtagtgatccatttttcatgcaaaaatgatcttctcaaactatttctttagttttaaacatatttatacccactgtatgagcatccttattgacagatatgtactaatttccatttgatgaatcattttcaggattcattttagctttatgctaaaataagtatattgtgtatatattcatacatagaagctcattttaatttgtaaaactttaatatacaggcttttgagaacatcaaatatctttataattgtgttttggtattagaaggtacattatctgatcaatcagggaataacattatatatcacctgtaagtcttagttgttaaaattttcaggccattttgaaagtatgttaagactaaatatttgaacatttacttctatattctgacacattatttttcatatgcttttgatctcagcttaacccagatcaattcatttctgaaaaccaacagcttttataacacactggaagcaaagctctgagcaatataaaggcttcctgttagcctaccatagaatatcaagaagcagtgtgatttccttttgctaggatgtgttctgtataaattaaacacattactttggcttttagttattgagctaaacaaaaataaatcagactttaatctttttcacttgggatggaggtattttttaactttaacaaagtatagtattttttaactgacatttaaaacattaaccataaaaaggcagtacaactatgttaaacatttgaaggccttaccgataattacctttgctttttagcttaacattttatcatgcatcaccggcgggcatttttattgaagtctttgttatcactaaaacaaaacaaaatttcatttatgtatttattttagagctaggttcgtgctctgttgcccaagcaggagtgcagtggcacaatcatagctcactgtaaacttaagccccctgggcttaagtcatcctcctgccttagcctcctgagtaggtaggactacaggtttgcaccactatgcctaatttttacattt

SEQ ID NO: 57920 - DNA, 1033 bp, Homo sapiens
actactctaatcacataaccccagaaacaaagaacaaatccctatcaagcccacataattacaaggtctttaaggcaggatcctcccaattttctgtggttataccaactcatcatttggtgacatttaaaccagatggtaatatctcatccttgccaggctttaacttggaagagatgggaggtaggagcccttaggatttgtattctgttatctttataggacagtggggaaaggggtggatataagagaagtttatacagtgaaatttgagtattacctccactttgtaaaattccaggtctttagacttttgcctgtctcagagaggctttcatccaatatgatgtattttggacaaattgagaacagccaccaaattttccagtgggaggctggcttcagggatttgtggtagagtatgggtttggggtttttaaaaattgtgcttggtagcagcccactcttctgggttcctctataactactgtttttctctggtaaccttgtggcttttcccatcttccatttctaaaatatatttttgatttatagaatatatagttgctcatcaagatttttttgacaagaacaaagtttagaatttgatttaggattctaagataatttggttttgaggggtaacattagccagctaggaaatgaaaacttcaagagaatagagattttgtggaaagaatagagtaggaatcaaaatgttgggtttctggcatgtgttccattatttccatgttatccttgagctcctaaccttaaggagggtcatgactattttcagagctttattctattaacctatctgtaaaatgggcagcttaaaatatcagcccttctttacatagtgaggcccaaagagggaaggaatctagcccaaatcctggtggagccagatttgaacttaggctgtgcaggtcctcagttactgctctgaactactgcattgccttttatataaccatagtaatgatacaattgtgatttcatgagatgattaatgggaaattatgaatct

SEQ ID NO: 57921 - DNA, 1068 bp, Homo sapiens
aggctgaggcaggagaatcacttgaacccagaggcagaggttgcagtgagctgagatcgcaccattgcactcaaacctaggcaacagagcaagactccatctcaaaaaaaaaaaaagaggggactactctctacatgggtttacctaagaggcaatgttatgaggtccaataacagaagatatatttgaataaaaaactaggaaatttaagtttatatgattacataggggtcctaattaactttttttttttaacataagattgtctaattgttggtaaataataaaatatagggagtaaaatacagggagtcagtcttggtgcaaggtgaagattgtctaattgttggtaaataataaaatatagggagtaaaatacagggagtcagtcttggtgcaaggtgaggccacagagctgtaatgggcctgaccagcctcgcactgtacaagcaccaatctagagctaggactgaagctgcaagatgactgacaggactctgggggcattagctccctccaacaaatggtggtctcacgtttcaagggctgtggtcacctccttcctcgtgacacccctggacatggtggaaggtccatttgcagcctcagtgcccgctggtggccagtgagctgacaccttcctccagacttcagagcctctcttatgccaagctgccctcctctctccaatcctgtactacaatggtgtcctggagcctctgtacctatgaccaaatggtccccgctgtgccacctggttttaagaccctaccagcttcactggcaccttggatgcctctgtgaagattctgaggcacaagggcaccaggaccctgtggagtggcctcccagccaccctggtgatgactgtgccagctaccaccaactacttcactgcctacaaccaactcaaggcctgcctgtgtggctgagcccttacctctacataaccttggtagctggtgtgctggtccaccctggcactatcactgcaatcatcagtgccctggagcttatgcagacaaagctgcaggtttagcatatgttatactatgtgctggtacctgt

SEQ ID NO: 57922 - DNA, 1059 bp, Homo sapiens
actgtgtgtatgtatatttttatttatcacgtttttttcttttttaaaaattactttttttttttttgagatggagtttcacgcttgtcacccaggctggagtgcatgcagtggcgtgatctcggctcaccgcaacttccgcctcccaggttcaagtaattctcctgcctcagccttcctagtagctgggattacaggcacctgccaccacacccggctaattttgtatttttagtagagatggggtttctccatcttggtcaggctggtctcgaactcccgacctcaggtgacccgcccacctcggcctcccaaagtgctgggattacaggcgcgagccaccgcgcccgggttaaaattacttttcaaaagccagttcctctattatgtaaaagaggacaggaggggtattttctagattttaaaaaataggtgggtagagtcttcaatctagttacatcatgaccttggacaaagtcatttttctgcaacgtatgcttgtcatctgctctaaggggatctgacactgacctagggctgctgtccagactaattaattgatggattgcaaggagcttaaatcccaaagctttatttgctcattgctaagaagagtctggggacagatttagtgagacaagggttagtgccaagtacacatccctcattttcccatatagtgaagggatttccccttgtcccccggggacagagtcttgctctgttgcccaggctggagtgcagtggtgcaatcatagttcattgcagccttgacctcatgagctcaagccgtcctctcacctcggcctcctgaatagctgggaccacaggtatacatgccaccacacccagaattattatttttttttagggacagggtcttgctgtgttgccgaggctggttcgaactcctggccttaagccatcctcccacctcagcttcccaaagtgctgggactacaggcatgagccactgcacctggctgtgaagggattgttttctttttttcttgttttgttgcccaaactgtaatgcagtggcacaatcacagctccttg

SEQ ID NO: 57923 - DNA, 1070 bp, Homo sapiens
aattgtacacttccacaaattcattcagaaatgtttctttttctgtcattattagatgaattctttgaatttgctttttacaaccaagtttatgaaccagattaatgaagaaaagatgtctctaggacagtgaggcatttcagttccataattgtaggatgtttggaacaaagatgcagaatttgactggaatgcattcttttaagtcctctaccccccaccatgatttaagacactcagtcctttaactgtagaccatccttcttaaagcaccatcagcatatatctttacacatggccttagagtcatcccatatgtgctgctgctgctttttttttttaagcatttaagctttctttcggatataaaaactaatcattttgttctgccagacccgtcacttcagggagtaaattaaaaaattttattacaaaaaatgtgaagcatacacaaaagtgtaaagaatagttactttagctattttcctggatagaagagcagaaagtggagtagcagcattggagttgagacaaaactagggatcttcatttgtaaagaacagcttagcttagcttttgtcctattcaggttataagtgacatttgggcaattatgaggtgagctttctagccttcagtcagtgatggtcattttgcccaattaggttggggatagtatttctcagttttagtcaatggctttgttgctttgttacacatttgttgggacatgtcaagtaacttgaccagctgcaggtctgttggcacatggaggtgttggagtcggttggtgggtggaggttagtctctgctaacatcacttcatttctttatctgttcatttttgtattggccagactttatctgaactttcttttcttaggaaggggccttctggtcagagtgggtatttagcctgacaaaacagagctgacatcagtagtaaccaagaaacagaatgatgttctagccaggcatggtggctctcacctgtaattccagcactttgggaggctccaggcaggaggatcgcttgaggtcaggcgtttgagatcagcctgggaaacata

SEQ ID NO: 57924 - DNA, 3719 bp, Homo sapiens
ggtcctcgcctccgctcccggggtgcgggggtgtgtgatggggtggggtgggggtgggggacttgcgagttgtcgtgcgaggaggaaagttttcaatatggcggcgggagcccctggtcctttgtgtggtggcggcgtcggcccggagcggccctcacctgggcgccccaccctccagaccagggcacccctccaccgcctggtccccgggcctccaggtgtcccccgggccggggtcaagaagggggcggccagcgctggctgggggcggggaggagccgcgggtccagccccggagcggatgtttgtggggggcgttagtgtctgggggacacttttggggcggcgggggcaggacgggcggcggtgggccccgatgcccgcccgcgctcccgaacgcgcacactcccggcttcttctggctcagccgctcggctccccggggaggcctgggctgtgctggtggggatggggtccgggcgaggccgtgtttgtaggggaacgtcagacggagagacctccgaagatttcgtgctcgtttcccccggccctcaggctccgggcactgaaaggcagtcacccaccgcagcccttccagccctgtctacagcgcctcgggcctgggggcagtgagtgaggggtgggtgttgctgaaaccatccgtaacggctccaacgttcgctgaggagagcccggccaactccttcctccgtggccggaactgggtgcgctcctacacccctgttttttttgcccacctttcgggagggtctgagtccgagttggcctaagcggcggttggacgggctgggaccgttgggaagcgggtttaactgcctttcctgctgtttaagaatcttctccccactctcttcccccacccccacttctaagtagaggaagaccccttcccacccctttctcccttaagcttgctttttgtaatgacattttgagttgtagggattctgtttgtaatcgttatgttttggaaagctgttttcagggagatccctgaaaataaggcttcttaacccttccctgccccaaattaaaacacggacacctactttagtttttcttaagcaagtttgaaaatggagatgaaatacatgcttcagaaaataactggccagcgaatatgagggaaatgtttgaaaatagatccatttcttacagcgaagtgggcaaggttgattcttgctgcttaagggaagtacgtttctcttagtgcaaagaggcctgcagaagttataacagggctggttagagccaaggttttaattcttgaataataggtcatgtttcacactgtagtaatgtagcttcatgtcacatgctaggaagggtgaatatgaatattgcacatttgcataatgggattttattcagaaattgggtaacttgactaagttcttagtaaccaaaacgtggggagtcaggttcctgggaggtgtcctccatgttggtattgtggtataccagggctggggtaaatcctttatcttgttttcttgttctttgccttttagagggccctttttctgaaaagatagtgttgctctggttaggcttggctacccatttcctcatcttggctagaatattaatggtaatctttgcaaaatgtgtgatcgaattgcctttttctcactctgaatgtcagacagacatgatggccaccattttgtattgagagtgctacatagtacagcctgaggaaaggggttaaagaggcaccaataatctacaaatacaaccagtactctgtttggagacctcctttgtgtggaggggacttgcttcctcctttgtttaacaaactcctttgccaaatggaaagagtttgagagtatttgttgttgatataaccacaaaaagggaaatctttccagaagttgtagctcttgaagaggggtcttgttggaacaaaggcttcttaagagatgtaaacagtctttgttttagaaactgttttgtttttgggaaagctaactgtgaacaagtggtttcatatagttgatatatagcaacaaaaaaacccttcaagaagtgtgaaatattttccatggtgatatatataatgtctgtatttctggatgatttttgttcaccgagtttttggaacacaaatggttatattagaaggggaattggaactattggtattttacttgttagaaggtaaggagaagtataaaacatttctgtctccttttgttcttacctttgtatctttaccaatggtacttaatatagtttcagtttatagctgctttctcagtgagactcccaaactgcttggcttctgaaaacttagagtacttacattattttgtatatggcagcttaggggttctcagaaatttgaaaatatagtaagataaatgtgagaaaacgtgattaagtcaagaagactatacttcaaatctgagtttgaagtttaatacaaacctttgtttcaaattatatcaactatgtaggataaccaggcttgttttctggaccaaaaccttcttaaatttacaattcatctggcttctggttttgtcacctttaaaatgcaaatttttaatttcctccatgatactgtacttagatgtctgtttaaggacaaatgatatttttccatatcactttgtggtatttggagatgagtaattttaagggtgtaactattaggcagaaaaatagttggctgctcagtaaatacttttttgtctcccaaattttgataggaatatatttatggctttagtaacttattttcttgctttcaaatgtctcacatttggccatagatagattccacaaatttctttttttttttttttttgagacggaattttgctcttgttgcccaggcctggagtgcagtggctcatcacaacctctgcctcccgacctcaggtgatccatgcgcctcggcctcccaaagtgctgggattacaggcgtgagccaccgtgccgggcctagattccacagatttcttctttgtgtccggagaaggtttaaatcaaaccccagaggccacaagagacaaaaatttttcagctttaacttcttgtggttactagtttgattccttcatctttatagccaagtgtaaaactgcccttaaatgttttaatacagtcaccatttttgagtgagcctgttggttccactcctagagaagagggaggaacttatacacttctttgtatggtagaagtgttaatgatatggagctcatttactccctttccagcgtatcattctccctaatttggggtttgatcgacttaggcctaaccctctctctgttttccctatttctttggtgtcatgaaatctttccctacttgtatctttggccactttaagcctttaacgtttagagaagaggcttatcagtagaaacatccttgagcaaaggaagaacttataactacttaaaaaaaaaacccttttattgaaatataccatacaattcacgaatttatgatgtgtaattcagtggtttttgatattttcagagttgtacaaccatcaccacaatcaattgtagaacattttcatctccctcaaaagaaaccctgaactcacttgtaactactttttttttcctttttttaaattatactttaagttctagggtacatgtgtacaacgtgcaggtttgttacatatgtacacatgtgccatgttggtgtgctgcacccattaactcatcatt

SEQ ID NO: 57925 - DNA, 1038 bp, Homo sapiens
cgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggtgagtcacgccagcaccccggatccagctcgtggctgggggagggagcggggacgcgcgggtccggggaggcccgaggcgcggggggcggggagccggtcgccccgccggcctcgtcaagtttggggctgcctagaaggtcggagttgaggccgggggaggaagacgggggcttctccagggtgggagatgaggagcgtgggag

SEQ ID NO: 57926 - DNA, 1012 bp, Homo sapiens
caccagcacccctaatttgggtctctgggctgaggggcccctggcagcatgctcaatggccttggatagctggaatgtttggaattgcctgcatcttggatgaaagtcttaacaatagaatgaaaactgctgcaacactgtgtcagcactttacagaccaccactgtaaattcccagttgaaactgggaatttggaattccatgttcaaccaaatcatgctgagtgcccagcacagcgtctgacacactaaatgctacaggtgaattccctttttcctctttcctggcaggaagcggggataggggaaccactagaaatactgtaataacatgaataagacaaggccattagccgggagcaaatcatagaacatcagccctgtgaaatgagtggtattagtgttaccatttttcagatggagaaattgagactcagaaaggttaattagccaaaaatcacacagacagtaatagcagagctaggaaaagaatgttcatcctagtacctaactttgatcttcccaaaacaccaaactgacttctaaagctgaagaaagaggacacagaagcttcatctcagatctcaccaccagctgccccttaatctgccaacatcgaaccattctctcccctctagactacagtggcttcaaactttgacttatctccagtatttttttgtacatagcaatagcaacaaaagtttcacaaaacaatattacctttgtatggccaggcacggtggctcatgcctgtaatcccaacattttgggaggccaaggcgggcagatcatgaggtcaggagatcaagaccatcctggccaacatggtgaaaccccgtctctactaaaaatacaaaaattagcctggtgtggtggcgtgtgcctgtagtcccagttacccaggaggctgaggcaggagaattgcttgaacccaggaggcagagctgcagtgagctgagatcgcaccactgcattccaacctgggcgacagagcaagactccgtctccaa

SEQ ID NO: 57927 - DNA, 1046 bp, Homo sapiens
ttttcatttccctgaaaagacaatgtaccaataagtagtaagataaagcaggtgaaggctagcccccagttccatcaggagcatgcactttcccacctgcttccgagccctgttggggccgagagtccccagcacacgcagcatgaaacctacttgccctctgagtctaagcttggaagagggcaaagttaggaaggggaagctctaaataaatcacaatataacatgacaaatatgtgtagaaatgtgactaaagtccagaagcagggcaaacctgcggtaaatggcagtggattttggaggctgagtcagttggccagacagaccaggaaggaacaaggcggggggaacagcatactatctcagaactgtaacaggctccctaatgctggggcttaaggtgaaaggcagagtggtggaaaagagatgaaaactcaacacgggtaggctgtgtgtccatggaacaggaatcttctgaccaaagtgaaaggtttgtgccaaagagtgagagggactcccccagcgcgtaaacctttgagggcagggtgtgtgttcatcacatgccgcgcagtcctggtcccccatcccatgcatacttgggtactgagctaggttgaacccagtgggaggcaggaagataggaattggagccccagcttatggtgggagaaagacggtgaccacttaaagccttagatgtctgggattagaatccaagggatggtaataaatgtagatgattctcatatccctggcaccttcacagtgaagctggctcattagccagggagagagggaacaaagttagaaaccaaatcctagtgaaagttcagggtgtcgagctgggactgtctctgcgtacttcctggggcactctgggcagcctgaggagcaggctggggggctgttgatgctggcttcaccggggacttgaacacctgctcaaaagaaatgtggcaggactcagctaaggaggctgtatggaattcccttgcggacaggaggaatgcggaagctgacagcacgtgcttcctttccccacccct

SEQ ID NO: 57928 - DNA, 1045 bp, Homo sapiens
acctctgctctaggttgagaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcatttactgaacctactgggcatggtcctcatggagttttggttcaactggaatctctgtgccaacccaggatacaaacttccatccagatgcatggatacaaatttccatagctccggggctgctctaacagtttgatatcagcagacgtgtttaagccttcaacttgatttccaattattccatcatttctattctgaaatgactcactgtcgtagaaggaagtttattatataaccaaggtttcaggtatcctcctgtcaccacctctactattcaggaggcctaaaattgaaataagtactaaacagaaaccttaccatctgaagtcccttccattgttttctagttgcttcctcattcctttacccccaaactttctaagggctccccgactgcagtgcaaggtggccttgggcacagttttgcaaccaacctactcccctggaaagatggcttccttctccaattagcctgaatgagctttagtaagcaattgagagaactgtgtttttccgacaaacggtcacatgtccatcgttatggcatgtgcagaaaaacagagttatccacacaagtcaggagcaaaacccaagtagatgcctctaggggcacatggcccctcacatcacaagccagaacctaagctaagcattttttaaattgagtttgagactagcctgggcaacatagtgagaccccatctctatttaaaaaatgaa

SEQ ID NO: 57929 - DNA, 1768 bp, Homo sapiens
gacacttgccaccatacccagctaattttttttgttgttgttgtttttgagacagagtctcgctctgtcgcccaggctggagagcagtggtgtgatctcagctcactgcagcctcaaccacctcctgggctcaagcaatcctcttacctcagccccatgagtggctgggactacaggtgtgcactaccacagcctgctaatttttgtgttttttgtagagatgggggtctcactatgttgcctaggctggtcttgaactcctgagctcaggcaaccctcctgcttcagcctcccaaagggctgggattacaggtgtgtaccaccacgcctagccctggctaattttttcaaactactttttgtagagactaggtctcattatgttgcccaagctaatgtgcatttaaaatatgtgcagttcatatgtcaattatacctcaataaaactatttaaacaaaatacagtgggcagtaagtaaagctaattcaggttgtttggttagagaagacctcctgagaaggctatgtttgagctgactactgaggaggagctagccataccaagatctgagggcagaacagaccaatgctgtttgaggaaggcaagaaagccagtgtgcctgaagcataatgagccggggaaactaggaccatgtggggcccatgttgaggacagcagtgaaaccgagttcccagaccacccagctggtgcccctctttcatttctcttaagaatcaggctcacgcctataatcccagcacttcgggaggccgaggcaggcagatcacgaggtcaagagatcgagaccatcctggctaacacggtgaaaccccatctttacttaaaaaaaaaatacaaaaaattagccaggcgtggtggcgggcacctgtagtcccagctactcgggaggctgaggcaggagaatggcgtgaacccaggaggcggaggttgcagtgagctgagatcgcgccactgcactccagcctaggcgacagtgggagaatctgtctcacaaaaaaaaaagaatcagggcagagaccagaggcaaagaagagccacccagcatcatcgtctacagcttaatgagagggcttctctttttttgtcattcctgctagggagcaatgtgaagtgtacctagaacgggggtgttgatggaactgggccagttcaacttctgcgttctttatgttctttcccactgcagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggct

SEQ ID NO: 57930 - DNA, 1516 bp, Homo sapiens
acgagccgccgcagtcagaatctgaaccccggctcttcaatttccggcaaccgcgccctcctcgcgcggccttaagccccgcccctcgggcctcagctcggcgaggctccgcccctggggccgctgaaggctagggagggaaccgggtcccgccccggcatcttttgccgcgggaacccttccctgggccacccggcccagccagcccggccctctgcccccgggggggcttcgagcgcgggccgtgcgccccgccgccgtccaaggccggtgctccgcgggcgcgtggaagggaggcgccccattccggctctcggagctcccgccagcttgcaggacccggcaggtgcctctcggccgccgctcaccgcgggtgttgctgggttcctttcccactttagacctcacccgccagtcctgaattcaccgtctcatttatgacgggcacctatctgctccacagaggatccccaggaacaactggtgttggggacgcggcaaaataaccctggtaacctacccactttaccgaggcactggaagcctgtggttttccagatgaatcatatttcaagtgcagtagatccctgacgtcctggaagtaaatttcgaagaaaaactttttttttcccttcagtttagggattttaatacccttcctaccaccatcatcgcaagtgagaaagttgaaaaaaaaatttatttcggtaaactgtgttgaagtgcaaatataatgtcatttcaaccatagacacatcctatcattcaaaattatttctaaaaatatgcagatcattttattatttcacgtgcttgaacagatggtgaagtgtaatgtctagtagaagagcaagaggtacccattcgtccaaaacagcctttcatcaaaggaggaaaaaagggaatctgtgtctgttgttttgtaggtattttgatgacttttgatctagagattggtggaggtcccggggttcttttaagacttcaaggtttaggagtagagttctcaattaattttacgaagttagtggcattatggagtcagtggaaagaacatggatcttggaattgaaacatacatggaattgagtcctgactatcattcattaacattaaaacagttaggctgggcgcggtggctcatgcctgtaatcccagcactttgggaggccgaggcgggcggaacacctgaggtcaggagtgtgagaccagcctggccaacatggcaaaaccccatctctactaaaaaaaaaaatacaaaaattagttgggggtggtggcacaagcctgtaatcccagctactcgggaggctgaggcaggagaatcgcttgaacctgggaagccgaggttgtagtgagcggagattgagtcactgcactccagtgtgggcaacagaacgagacaccatctcaaaaaaaaaaaaaaaaagttatttaacctccatgagatgcaggttgctattgtgtaaaacaggggtgtccagtcttttggcttccctgggccatattggaagac

SEQ ID NO: 57931 - DNA, 1040 bp, Homo sapiens
gcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatc

SEQ ID NO: 57932 - DNA, 1507 bp, Homo sapiens
cctttttgctttcagaaatatcagtgtaatagaagctgttcaatattcatggatgtttcattattgactacaaagttggcaaatcaagttccaatgtgctgggtggggaactggcactagttgtgtttttgcaaactcctaggtggtctttgaatgcttttaaggattttgttttaccccattctttttagatgtcttccttgtctataaaacttaattgacttatctcatttaaaaatactttgtttttgctctcagacttttaaaggacccttggaaaatttgtagaggaaagagttcttagaaatctctcattctctaatagtctgtaatttgtttattctgagcagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggtattgagtctgggatgcaggaatgggagggaactcaatgggtaatgggctgtgggtaaggattcctttttaccaaaatgacgttcatagacttcccttcaactaaaaccctggtgtgtcttaatatattttccattaattgggattatctttttcttataagcataatgtcagatttctcttagagttattggaactcttgtgggaaaattgaaactaaaataattagttgaagcactcagaaaaaaaccgaccaggaatgggcatgaggatttaccactctttctggaatggtctctgtcttccaggaggatatgacggcttgaatatcttaaattcagttgagaaatacgaccctcatacaggacattggactaatgttacaccaatggccaccaagcgttctggtaagaccagatctgagggaggggacaataggcgatgctgtcagacctttacatatataatggtggtgcatgggacaaaccgtagattaatgtaaaaatgagattctgctctcctccttgtctctgttttctctaaatactaggataaagacagttgatacttacaactagattataaatttgaaagcaaaagccttcatgtctttgttctctccctacgttttagaatatctagtacaattttgcctgtgtagtacatgcttaataaatatctgttaaataaagtctctaatgcataaggacaaaagagtagctacttaccttcaccaagagctttttgaagtggagcaggctgggatatagaaaaggagagagcactgtgctgttctagtttacttactctgggtaaaaattgcttcagaaccataatcacaactcctttccctccatctacctttattgccacctttttttcacttcctccctttctcctaattagaagggttgggctctgagttaatgaaagtaaagaagagaaccatttttattatttatcttttatcatttcaagtccaagccaaagggtttata

SEQ ID NO: 57933 - DNA, 1040 bp, Homo sapiens
tccctggaagggcatccaaactatgtaaaaatagttaaatgtaagcgctgcgatagatgggaaatactgctcaacatatctgtttatatcatttgatttttgatccatctagtatgttatctatttttcaagtaaattttaaaaatcatttctggaaaccgagagcatggttactaccagcaatactcctggaatcacagggctttgcaaactggttttctgtagtcagaagttaattatttgcatgtgctctttgtactcttatagtattacaggtatccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggtaagctggtatctcggcagaatgaggggatgcttttcaactacttcttgcaggtgacaacatagttgaaaataatactctataagaagtacagacacctcgtttcagaccttttcttctatcatctcagacaagtcactttaccactctaagctttctttcctataaatcaaggatgtcttctctatctacttcacataattatttggaaattaaatgagataaaatataaaagcactttatacattgtcaggcattacataatatgttacaattttttgtcaatattatttagattctgtgaattagagataattttagtgccacataatggcaggtaagtagtatatgcttccacccacctcttcacttccccttatgtggtttttccattccggaatgaagagaggaagaaaaggagcccagtgtggtagaaagtacatgggttttggcagttactgttggtgcaggtaccagtttacctcgtactagatttattaacttgggcaggaaccttaacctctgtgtgcttcagttgcctcatctgtaaatggaatcatcgtagcacctgcctgtaacattgttatgaagagtaaataaagttatttat

SEQ ID NO: 57934 - DNA, 1030 bp, Homo sapiens
gttagagaagctcctgcttcagaggcttgggtgaacagtttgaggggtgagcctggagatcattagataacaattatgacttaaaattatttcaagagctgacttcgaataaggcaacagattcccccacctgccttccttaaagttatagagaagaccagaagcaattcaggaatgggaaaaattctgaaacgaaggccaatacgtgactggtgatttattaggtactatctatcttagagagagagagagagagagagatacatatatatatatgtgtgtgtgtatatatatatattttttttttaacccaaattgactataattcttttcctggtctgttagctgtgtctgaaaaaaattgttttcccaagagcctagctatttctggaagatgggaaataatggtggtgggcaatgggaagcaggaaggaaaaagtgaacgtggttacgttttgagatggtgagctaattggaaaagtaggatccacggtgtgtaattatacatttacaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgaggtaagtagtgcaacactctcaggatccaaaaccttgacggactcttaccttagtgttatgtattcaaaattgagtattttaatgtaggcacagagtctcctgttttgcctctctaggaatgccagtgagagtggtgctgggtagtccccaagcatatttctaagaaaagcgaatttcttggcaagtcaggctcttgacacaaatgaaaatctgtggttcaattttgtgttttgctgtctgttttacatgcctctgagtgttttatataaacacttgataataaactttgtccccttctccattaaacataaattgttccaaattgcccttatgccacacttagcaagcctcttcatttttgacttc

SEQ ID NO: 57935 - DNA, 1328 bp, Homo sapiens
catcttctataccctcccctgcatcttatccaacaattgcctgggttagtttaacttcccaagtatttctccagtggctcaccactgccacaactatagtccagtaagcaccgtcaccttttgcctaatgtaccagagcagcatctaacctcttctagctcttggccctttaaactgttctacccacagtagccaggataatctttacaaaacatcaatatgatcatatcactagcctgcttgaaaccttcggatgatttcaagttgctctgagagtcaaatccagtattctaatgctctctgtacctggcccttgcttaactctccagcttcatattttactcctctatcaccctcattcactctgctacactagccttctagtcatttcctcaagctgccagttcttttttgctgtagaacagagctgttcaatagtacattctatgaagatggaagtactctatatctatagtgtctggtttgctcccgctagccccgtgttgctgttgggcacttgaaatgtggctaatgcaactgagaagctgatttttaatttagttttaattacggtgaatgtaaatagccacgcatgggtagtgtattggacaatgcatttctagtgctttttagtgtgctcttctgtctgcctcggagtactctcttactccccctggctaactgctactcatccatcagatttcaatttgttgcttcttccgggaggccttccttgcctcaccagtctaaactaggaaatctcatgttgttctgtctcatagccccagtacctttcctatgtagtatgcaataatagtgagattgttcatttttctgatttagcagtttgactccccatttaagagcaaggatcatatctgatttgttcaccatatctgatttgttcaccattgtgtaatcagtttccaggacagtgcctggcagttaagagtggggttcagtaaagccctcaaatgaatgaactttgtgaaacatctgcgtttttagagtatcacagttcttaggaaaagttttttttatctattcacagtgacactctgaaaggtatctcccagaatatgtactctgtaggggctggtagaaggggcacaggacctctattcaggtgtctgtctttgggaagtcctaggtgttattatatacctaagtccttccagtgatgtagtgtaggtttttttagagtgtatctcacattatctaattggtcatatgtatgcttagatctaagttccccagatgattaattaaatatatcttctcaaatagcatagtgcgtaatacacagtagttccttgaaggctaattga

SEQ ID NO: 57936 - DNA, 1031 bp, Homo sapiens
agaatgctggaattataggcacgagccaccgttcctggtccccagtttttcttttttaacattcagttatgttttcagtttttatatatacataattgacacacttttagtttttaatacatgatttaaacagtgtgaagcttttgcattagtgcatagccataacattaaaatactctgaacttttcaattagataaatatgagatttgttattactatcttctccttttctttcactctagtcttttagtaagttttcatgtagagtagaaaatggatacattatgctgaattcgcaattggttttatagtttgattcccaagagttttataggcatttttgttgaattgtgccaggtctctggatgtgattcatcttgcaatactcattttaaagattaagcagagacaggtgtaaaggtcttgctgaaagtggcacagtacataagccagaaatagagtttaagttccttaagcatagaatttctaatctgtttcttaggtgttgaaacaagggttcatctgataacatgtagagaagatgctgagatacaagaatatatcctagatcacacctgtccaactattctaaagtgtttgctgcctgtgtctgtcctaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtacggatttgtcttgatgttatggtttcttcaagattgggcaattacaaaacttgcaaataggatgcagttacttaccatcagggcttcataattaagtgtgcattttggctcaaagatttcattaacccctcctgtaccaaatttatttgcatttttatggagagggagtttgccactttcttcaattaga

SEQ ID NO: 57937 - DNA, 1227 bp, Homo sapiens
ttccatgcggtggctgtttccttgtttgacagtcttatgtctgttctgttcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatgggtaagaaatgaatcttccagcaggtcctgtgatggtgagtgaacagcccaaagttaaagggctgaggaaaaggtggtatgagactgggatcatatagtgtttggaggtacatatatgtgcattgaaggtaaatcatcaatattaacattttggtgtatctctgacaaggactgtgtttttaaaactttctaaatataccactttaatgttattaacaaatttgtttaattaaggataaactagaagaagcaaatgctttctcctacttgtttcttattcctccttgcattatcctaaaggctcttttctttttattcctacagttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttaccta

SEQ ID NO: 57938 - DNA, 2255 bp, Homo sapiens
tattccatggtgtacatacaccacatttcctttattcactcattggtcaatggacacttaggttggttccatatctttagagttgtgaattgtgctacaataaacatacatgtgcatgtgtctttttcatatgactgcttttcctttgggtagacacctggtagtgggattggtggatcaaatagtagctctacttttagttctttaaggaatctctatacccttttccatagaggttatactagtttataatttacattcccacaaggagtgtataagcattccccttttaccatatccatgccaacatctgttgttttttgactttttaataatggcctttcttgcagaagtaaggtggtatttcattgtgcttttaatttgtatttccctgatgattagtgatgttgcctgtagctctctgattcaaaaacatcaaccatcaaagtgtacacattcccttttttcttacaggttttttttattttaccctcctgcaggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaagtgagttaaaagaacaccataggaaaatactgtgcactgttgtcacatcttgagatcccagtgcttactgggtgataggagctcatatcactcctaaaggtttcttgatatgccagaggaaaggctctctgttctgtggcgatagtggggtgatgaagcttttctcttaaacacttcatgaacagacttactgcatcctcttcaacagatggagagaccaattgtggaatatattttctacctgaaaagcactatcttttgtgaggcttagagtgccagtgcactggctgctttccaagaccttgtacaagcgtaacttactattagcccaagccaaagtagggtgtggtaaatagtctatgcttcattctgctggtgctcctacccagcagtcaagtaaagcttatctttgctgcccatgcattgctggaagctccagatgtccatcatcgtgtgctttctctcttgcccagccgtgagcctgaggttctatttgtttgcttgtttttgttgttattgttggttttggtggcgacagtggtgtattattttgttttttctaacaacaccagtaagaaggtacattttcctcatttaaaaagtcaactaagatagaaaaagctagagtatcccttaatactactcccaatttaagaattttgtttttagaactcattctatcagaataggagaattttcaaagcctttcctgagtgtgatgctgggaaccagctggattgtgatggaatttctaaattcaagtgtctactatgggagatacggctgttcactagtaagggaaagggatagagttctttgaatggggattcttagagatttttccatcgtaaaatagaagtgaccttgtggaattttaatccagaatacaggatagattgtatgggagtctacaatacaggatagattgagggaatggttaaatctgggagcaggtggagaacagaaagagctagttaaatgagccatacaaattcatttcccccactgatttgtttcatttttgtggttctttttagactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggtaggtcggaagatgtacgtacacctcagaggtatttagaccttaggcctgataggctcaaacctatttgagccttaaggtttgcagcttgagaaccccacccaaaccctgatttgtgtttcagaactttcaaaacagcatcaatttcaaagctcagttctcaacccccagtgtcatactatttcagtagaatgccaataggacagatcattacccagctggtcaattaactgcaagcacagatgtagctactcttatacttggtttgtgacagtttaaaaatgtagcaagcacagtaattttagtgacccgagtcccaagctcagaccaagggattaaaatt

SEQ ID NO: 57939 - DNA, 1033 bp, Homo sapiens
tgggattacaggtgcccgccaccatgcccggccaattttttgtgtttttagtagagacagggtttcaccatgttagtcaggcaggtcttgaactcctgacctcaggtgatccacctgcctcagcctcccaaagtgctaagattacaggcatgagccgctacactcagccaggattttttttttttttttaatggtcaaaatatgagtcaggactctgctagccccattcatgctatgtcttggatatcccccagtccaggctggttctccactattacctaggaccattcagagcctgactgacatcttcttagactagttctccatcactgcttgtccttggggaaggtactatctagtgccctacccagagaaagtgtatatgttctaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtgagtgatttggatggggaaaggtggaatttgttgtctccctaactgcgaagggattatagagcccaacaaagttgttcagatcgattggcagctgggattctacctttaaactactaatgactttaagctaataaccttggttgacccttgatcactgatctttaagactgagagtaaaaggcctagaaaccaaagaaattgggactagatatttttttgtgatccctggcagaactgttctaggtggagacaattccttgtacttcgtaatttccaactgtaaaagtaaaatgccaacatttcaaaaaatggtcttttttgtctgggtttctgtgaccagtgccactttctttgaaacattggactgcaattacacagctaaacctcatagctttctgattttttttttatttcaatagctcttgggttacaaaggggtgggggggggtttggttacatggatgaat

SEQ ID NO: 57940 - DNA, 2965 bp, Homo sapiens
aggggtttgttctgattttacaccatagactaaaacacacttgtaattctccattgtttgtgagtgatccaccccatagaagtggtattttcagatcctagtattatttgctcttctttcttgccagacgtccgatccctatctctccctttcctgtctctgtgttactacagtttagaagaccaaactggacaatggactttgctcactatgatgacatgatctccattgacctccattgtatgtactttaatgcatgatgatatattttgtatgatgagttgtagctgatggctggtttgtgagttaactggggtctcaggttttggtgactctgggtctagaagatgtagagaggtggtataggagctagtgatagaggagctagagggaatcggaagaactaatagtaaatgatttggactgaaaaaggaaaagactttgatgatagccagaagacttgagggcataaaaacttttcagatcaaatgatgaaattagtaagaatgccaatctggattctgcacatgatctttggaccctaattgcccaacttaaattttctctatattattctcattgcctctagtaaaatagttacatagcactcaaagttactaaatttagtgtgtgaccattctagttgaggggttctctccctccactgccctcctggagcaatcaaattgtatcacttatttttgtgcatatcacaaactacctatgttatctggctctttgaaaacaatactataacttgttcaacttgtattttgcacagtgtcttgtattttgcacagtgtcttagaatgccttagggtgctagtcctaaatacacttgctaaatattcaatgaatgtgttgacttactctggggaaagggataagagaagccaccacaagcacaagaaaatgcacataagcccttatctaagtggctagaagctaagtcatatgctggcaagctggaatctgccccattcattcattcattttgaaatgggttctaactaaaataaagtatatttattattttatgatccatgtattgcatctcagaaccagaattttgttttgttttgttttgtttctgccctggtagcctgatctaagttacttccaacagtaacttagtaagtaacaagctaagtgtgcccctcttttcagatttatctaagatgcccaaaaatatttatgttttttgcttgtgatataaagttgttttttggtttttttttttttgcttgcgatataaagtattttttagtaaagctgctgattcagtagtacttcactttgaggaaatatgttttgaggtcagcctattgagaaagatttccttgtgtccctctcacacgggttgcccatcctcgaggttttcataggcttccagcttcctgttctccttagctcaattgttcactatgactgtgtgctggcatctcgtcagagtcttgcacatttaaaggaagaggaactgtctatgtgttgacaccatataaaggtctgctgtatagcaagttattgtttttgtctctcttggactagattgccggttgctttcaactgtgcttgtgggttgagcatagcatgactcatgactgtttagaagcttgaggattgcccttacctgatgtgttagtaagtgttctccagaaagcaccaataggatacatacatatggatagagatgggatttattcggggaattggctcatgagattatggaggctaagtcccacactatgccatctcaagctagacaatgaggaaagtccataactggttcagtttaaggctgaaggcctgagaacccaaggggctattggtgcacgtcccggaatcccaaggcaggagaacctggagtttctgatgtccaagggcaggaaaagaagggtgtcccagctccaggagggaaggagggggagagacagagagagttagggagtcagagaaagagatttataatccctgagaaggaattgtgattactcttagataaaaaagaactgacacaagatatcaaagatatttgtatatagtgaatagccatggatgatatagtgtctccctcaggagcaaagttatgtttactgcccaatataaaagattggggctccctaagcttaagtttcctctcccggaatgcaacccactccatgtgcagttgttacctggccctccctgcattgcaatgtggttatttgggtttgggtggggcttgggtaaccaatgcaagaaaatgctaatattctggctactgctattgctataactaataaagtcctttgtatgggggtagaggtggggagagaactaataatttacagcatagtggaaatctttggaaactttctccctctttccctctttttttatttgcatttccctgaggcctgtttaaagactactgtgaaaatccaacccaggaaaacctaaagtgtctgagatttttcctagaaaatggaattctgggtttttctgattttgtgtgtgcctgtctctagtttctgaaatactcatttgagtagggcttagattatgggttgtggtggttgaaacaagttattgtggagctggttattaggtatgtgtgtggcaaagggtaaattggggctgcctccttgtcttcaccttcctgcttccaggtaagttcttgcttgcttgcaggacagattgtgatgaaagcttgttatcccagggttgaactcaggctataatcctgtaatagaattagtagacttcgcagagaaattaaccactaggcatctgtcccacaaccaagttccttttgtatgtatgacacatttatcagagcatttgtagataaggtctaactgagttcagttggcatttaattcatttctaagcctggatgatcttgtagtaattgcagccagatgttggctttatatttttattcctcggtctcagagctaggcctttcttgggcagagtgagcttt

SEQ ID NO: 57941 - DNA, 1043 bp, Homo sapiens
ctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaagggttgttgtgtctggggtccttgtttccaaatccccgaggacctagggaggaagggtttgccaccatgcaactctcccaggtgttccaaagaacctttgagaagttgtaccatgtgctgaaatgtgagctgccagcagactcagtgatcatctcagcagctgtctcagcagagccagagctccgcttctccctggaggctctcgaggtgggggaaggagaacacacattagaggggacatttttgagcccagctgcccctcacagtgttcccttgataggccactcttccccttcttccttctcttggcctatccttcaccatatttatccttcagggaacctggcacacaaatcaaagtgttgtctttctgtttggaagggaagccttcttctttaaaaagtaacctga

SEQ ID NO: 57942 - DNA, 1200 bp, Homo sapiens
ctcttccccaccttcaaaaatttgcccccctgggtgagctgtggagtgagccagagatagctttcagcccttcccatgggaacagctgggtgcattagcaagtccctggagctgctgtgtgccacttgggaaaatagattcacacctggctctgtgcctgtctccttcaccagggagtgacactttgccagaagcagctgatacattgtgtggcgctgaactgactcacagatagccctggccccattgtccctcaactatattattgtcagggctggctcaactcaagcttccacccaagctccaggatcagatgtcatagcagctgctcaactggcctcaggcatattttcaactctgcatttgttttctaagttcgctgtattgactttattcttccactgctctcttcacctgacctctcagggcattttaacattcagcccaacaagaaatctccaccagaaccccgagtggcgaagaaactgggaatgattgccggcgggacaggtgcattacactgagggcctttctctcccaccattgttgactgttgccatgcaaattcctaggtgaccctctgaagactggtaaccatagccaagctgttgttcatcaggggatttccagcaatgcttagaactccctagtatctgaaaaacaaaatcataagcaggtagaaaccaaaaaaaattttaactgatggaattagagaaacaaattaaatgagctttcctcattttgaatggatctaatagttttaggtgagagaagagagaagcagctaggaatgactagctaggaagaaagaaaattagcattggacactactgtgcattagacactgtgtagtctaatacactactatatattagacacaaaaattagacacatatataggtatctatgaagtaggtactagccttttccttttacagagagacaatggggttccagagaggctaaatgatttccacagggttatttcactggtaatggcctggagcaaaattagtatttggctctgcctagtgcctaagtacatgcacttaacctctgcaaatacagtgttctagaaccctcatcattgaatccggaggtacttgtagtcatttgtgacactggagtcctagcctccaaaggactttcagaagagtcttagattagttcctaagaaagatttctacaatatgaacttag

SEQ ID NO: 57943 - DNA, 1383 bp, Homo sapiens
acggtgaaacccagtctgtactaaaaatacaaaaaaaaaattagccgggcgtggtggcgcacgccagtagtcccagatactcgggaggcggagccaggagaaccacttgaaactgggaggcggaggttgcagtaaccgagatcgcgccactgcactccagcctgggcgacagagcgaggctccgactcaaaaaaaaaaaaaaaagtattgaataagcaccggagaccctgagccaccgagtagcggagggaaagggtggcgcgcagaggggcccagccccgcctctgccggaccccgcccccaaaaggccccgccgccgccacctcctgctaggccccgcccccgacagacacccccccccccccccgccaggccccgcctcctgcccccccagccgcgaggtcctgcctcctgcccggccccgcccccggcctgccccgccctccgacccgccccgcggcgcattgtgggatctgtcggcttgtcaggtggtggaggaaaaggcgctccgtcatggggatccagacggtaagaccctcattcagtatcctccactgggggacccctccccatctggttctggccactcagctccggaccaggggctgtcgctgccgaccccgccccgcagggctctgggcccaccgtggatgctggggtcccgatcccgcacatccgggctcgggactccgccaggttacccctctgcccttggcatgcctccgcgctggagctcgggatcgccacccctgggacggtcaccacccaagccccgggctcttacccagcctggcggtcacgctgcctcctctacccacagagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggtaagttggggaagaaagggccagggtgaaggaggggaccagagtgctcctggcatggagggtacagcacccacggtggttgggatgtccaagggacgtggcagcgccaggcgcgcttggtgaaacacttgtgtcctccaccctccagactgtgagccacaacaccaagaggttccgctttgccctgcccaccgcccaccacactctggggctgcctgtgggtaaggaaagtgtggaatgggctcctttccctggtatcctcagaaggtgactcccctcctgggatctcatgaaacacgctgcttcaaccggtttgctccacacaccattccccttcccccacttggctctgcatcctccaagctgtgaggtgccactgggcccctctagagtgtggcttccatgacccccat

SEQ ID NO: 57944 - DNA, 2526 bp, Homo sapiens
ggaggcggaggttgtattgagctgagattgcaccactgcattctagcctgggcaccactgcattccagcctgggcaacagagtgagactctgtcccaaaaaaaaaaagttaaacttcaaaatggtatcgccaatagttgttaaataaaggccttaagaacaaaacctatttacttgggcaacaggaggtaaaagtttccagcagctaggatgagcaggaaatgataagtttgaggggtttccttggacctatttaaaaccattttcttaactgtgcaatcaatccttgggagaaatgaaattatcgagtatctttagatatggtgtagaagatcagagattattcttttttttgtttcagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggtgcgaccacagagagctcactcttttatctgtgtggctgatttcattactgtttgtgatttggagctactcactggatggtgacctcttttcactttctctactccatgtctgggcatgacccagctttggactccttgagcccctctctaatttaaatttgatattattaattatccaggtaattgtcttccgtgtggttgcctccttccccactccagtatccactttcagcaaaacgtcttgcttcaagtcccagatagaagagtctttgacttttcttcagaggcttattttagctagaatgtttaaagctacagatgcctatctgctcatctttccagctggattaggtgttgcttagatttgctagttgtctttaagtattacacagtttttgtatttatgcagccttatgtatagttgtagtggtgaggagtaggcaaattatatgattagtaaaagggctagtttttgatgctaggtatggaagtgtagtgacaattgtaaactgtcaggctgtggtgggaaggaatgttgaagtagaaaggagtggagaactcactgtgagatctgactggagaacctggtggctcttcgccagtataggttcctccaggacaggttctttttgagcagctaaagcataatataccgataccaattcagagtttgctcttttgttcagtgaaaaagtgaggacttcaactttaaaaatggatggagaactgccggattacaaggcaaagacgtaaaagtcgccaagaggtcaagtagcactggggacaggctatctactggccagtggaatagtgcagtaaagttcatacagagaccaggagtcttagaaaactgacctagagcaggagagacaggtcacatattggtaggagtaatgtgtcatgtttcaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaagtaagtgagaatttgtgttggggtttgactaatgaactcttgtatggtaggcctgttatcatggcttgtctccagcttccttgatggggaggggtgtaggtcccaggctgctaggggactaatgtaaacttcagggctcagagatttcacttctccaagacctttctgctgtgctggctggcttatcttaccttaaagctttctggtgcttttagtgtattccttattctttttattttaatgtatttgcatacattgtacattggaccactctagatataatggttttgatggtttgggctaggaagagcataactcaaatggtagacgtatgctgtaatttttaagaggggctttaaatcacagtacagaggtataacatgaacatctcactatttttctctttctaatgcaaccttgacatcagggattcccctttattgttgacctccttaaggattctggtgtagacttgacttctgtagcatttggaagtgccctgtgccaggctattgcccggctctggtaggtcatctcatagactataaggtaccctgattcataaaccttagttctctcaagttctttctgtgttctaggctctttttatctcaggatttccctgatattttatattcacatatttatattcaagtttctgtcattcttctgatttgtaaatatgtctactagcctttggtccattctctctttttctcctacctgatgaaattactaaatcacctttggcaaacaaggttactctgttcctaccccaaatctgatgttccatagcatttcccattctcttgtagtttgtttttatggtattgcacattatataatgattcttctcccctagtttagctctagggtgatcatatcctacctaatacatattaattaaaagggta

SEQ ID NO: 57945 - DNA, 1031 bp, Homo sapiens
cagtagcatagcttgtgtgggacactggagccgttgtgatggcagcagaagtgttttccccttaaagccaagcccattaattttgatggaacagcaggacgtacagggcatgtctgaagggcaggacagctggcacggcggacgacccaccccttatcccctgggaggtacttcacttcttgtgcttaaccctagctgtagcctgactttcactgaggggcttattctagacagaattcagcctagctctgtagtttccttactggctgtctgctcccagaaggtcctgagcagtttgcttctattatagggccagccctctctgcctaccttatggccttgtatcatcttgcctggtggctgctggctctccttacattttaatgtagaggattagcctgctgaatcagagaggatgctccagtctctagataccatgtttctgtctttgaagataagacaataggagttgatgtcagtagcctctgaggttgacttatattggtccctcctgtccttattgaacagccctgggattgtccgtttttatgttgcaccagtgtcaacttgggggtctatctgtgccaaagtaaaatctcagcattgggaccgtggctggctttagagctgtcaaacagaaaggtttttggtgattattttggttgtagtgtattttgatttttttctttttctttttcttggtttattttatttttactttcttatagtgcttacttttctggtgcagaaagattgttgggaacagacaggaaccaatgtgggaattcaacttcaagttcaaaaaacaggtacgtggtcttctctttgtttttcagataataccttgttctaagagatttccctagatatctttcttagtctgtttgtgttgctataacagtaccacagattctgggtaacttaaaaagaacgaactttatttcttaacagttctggaggctgggaagtccaagatcaaggtacttgcaggtttgatgtttggtgagggcctggtccctttgcttccaaga

SEQ ID NO: 57946 - DNA, 1640 bp, Homo sapiens
cctcccgttcagtacgaagatgttcataccaatccagaccaggactgctgcctactgcaggtcaccaccctcaatttcatctttattccgattgtcatgggaatgatatttactctggtaagtggggactcaggatgtcattctcagctcctttttttttttttttttcattctgaaaggaggtgaaccgcagctcttttttttttttttttttttaagagacgtggtctcactctgtcactcaggctgaagtgcagtgatggaatcatcactcattgcaacctcaaaactcctgggcttaagctatcctcttgcttcagcctcccaagtagttaggactacaggtgtgcaccaccacccctagctaatttttattttttgttgcaatgggtgtctcacagcgttgctgaggcttgtctcagactcctagcctcaagcagttcttccacgtcggcctctcaagtgctgagattataagtgtgagccactgcattcagcttttttatagatttttgctatatctgaggtttgaaggatatttgtaaatttaaccatgaaggaaggtatcttttttcaaaaaaaaagtttgaactcagtcctgtatattagcaacagacagatttgtggagacattaattatatctgagagtattttaccttgtttccttctttgtaggaaagggaatgtttttgcattttcatgtgtagtgatgattaatgattgagaaacattatcctattaggaagaatgatgagatatatacatgggcactgtatgtcaggaccttgaggcatgcatatggggttacaaatgggatattaaaatacagggtgaccagctcagctctgtcctttgtgtgatattatcactgttcaaggcttggccagtaattagtaaacaacgtatgtgcctctggcatatttttccaggttttaaaaatttttcattggcttggcaactggagagttcatgtaatttgtcttctctgtatcttaggcttacattcagaaatacatgaggttccccttccacaatgaaagtagcttttttaaaatggtaaatgacttcaaataatacataaatatactgacaaagtaaaggtgacttagacttccactatcctgtaactgcaattaatcttttgggaactgttctcttaatgtgtctgttaatatgtatgtactctctctctctcaaataattttgtataattgagattgtgtcatatatacagttttgttttgttttttttgagatggagtctcgctctgtagtccatgctggagtgccgtggtgcgcagtctcggctccctgcaacctctgtctcctggtttcaagtgattctcctgcctccgcttcccaagtagctatctgggattacaggtgcctgccaccacacccagctaatttttgtatttttggtagaaatggggtttgctcaggctggtctcaaactcctaacctcagacaatctgcctgccttagcctcccaaagtgctcattagggaggctttctttagcatagtttaaacgtgaagctgagaaggccttataaaattctccttaattttttatatctttaaaggttggctgggcgtggtggctcatgcctgtaatcccagcactttgggaggccgag

SEQ ID NO: 57947 - DNA, 1817 bp, Homo sapiens
atgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggggagaagcacagtccctgccaggttgcctgaactaaagatgccatggagcaggagtgtcttggtgcattgttccccgcttaggagtacctttaaaaagggggtgaaataaatttggcttaataattgtattctgactcagctctgagttttttgtgtcaaattccatggtatggtgacagatacagtactagatactgcctcagctctctctcagcataatattgacaaacatttggtaaaa

SEQ ID NO: 57948 - DNA, 1079 bp, Homo sapiens
caaggaaattatgccaaatggtgaatatattgggtggaagataaatgagagaaggttgtatgtgtcactgatctcaactatagcatttgctgctgatatagaacatgctgtgtatatatctataaatacacacacatgaacacattgcatgtatataaaaattgttcacacttttagtggtgcttactgggtattggtaaaggattgagtaggcactgtgatgaaacttcacaaagcagatggaaaagatgcattaatagccacagggggcagggtaagggagcaattcaggaaaatggagaggcttagctaaaatttgtcagtcaggaattttggcatttgagacttgttttcatactatgtatatgtaatagacaaacccttcattttgtagtaacagtgttagaacagccaggtgcctgaaggcaagcgacacaattcactgaagagcatactacagatgtagtatccggatatcaagtttccccacttaaaaaatgggtgcgatcaaaggaaaagcaaggaacgggcaggagagcaagcgtgaaaggtgacaaacttgacaattacaaggccgagactaaggccaatttagggaacgggctgttagactaggaacaagggcgagttcagagggaggggcagaatgtgggcagcactcctgggccctgagacccttctgcggaataaaactctggcacttcgccacctcctaggctgaaccaagatggcgcgcggcctcaaagcggcgctctcgtcacgtgcccggacccgaggcgcttgggggcgggaggcgtggcctcggtcgcggcagcccagccccgcctagggggcggagccggggggggttgtccgcggaggaagggggcggggccccgcggccgcgcgcttgggcggcggaggctgcagctacctcggcgccggctcggctctaggacgtgtcgggctgcacgggtcgggggcggctccctgctgcttccgagcctagccgcctggccttcggcatttgcaggcaggtgagcgcccagagcctggactggggtaggatgcgtcttttccccatctccagctcccctcga

SEQ ID NO: 57949 - DNA, 1100 bp, Homo sapiens
gtgtgggggaggagggtgtagaagggaattcgcatccagtggagttggggtttgtgctgctgagcatgtcgtgatgtcagaaccgtgtggtgcatgaggtctggctgctgggctgtaaaggagggctggaggggcagggcatggcaggcagccaggctcctgggtctcatctctgagttgattgctgaaatcttagagttggaaagagttgtcagggatggcttataggtcctcacagagcctctgaggatggcagagctagagctaggcaagagaatgagtagtcaggctgtggtggtgatgaggtggggatgaaggctcagcagggctggggagctgggtgttaagggggttttaagatatgggcagctagccgaggccttcgaatgccaaggacattcttccctgggctttaggccctactgtgttggctccataggtgagttgctgtagaaacaaggtgtggcaattgagtggtatggggtgtgtgtgtgtgtgcacacgcgtgtgtgagtgtgtgtgcttgtgcatgtgttggagaggaggagaggtgaggagcagggaggactgagggagtgaaagctgcctcaaagtctgggtcctacgtagggaattgagagaaatggaggggagggagtggggtcagagggagggacaagtgtgtattgcagccacatgaagtcaccatctgtccccctctggcctgctagctcacggacctataattagctctggagggcatacggtgctggctcacaggagcgtgggacttcgggtggccagcagagtggaggattcagagggaccatggtccttgatgtactgtggaaggggctgcttctaggggaccctctgcatttgctgtactgggaggggcctgaggcaactgagaatgtcacagggacagggctggtgggggaaacagcagtgggggaaggagctctaagcgaggatggcaggagactccagggctggtctgagcctgagacctccccgtttgttgcctggctgctggcccactgcacaagaagcacgattgctgcccagctcattgctctgccttcagagaggctcgggtgctgcaacctcggggcctcctt

SEQ ID NO: 57950 - DNA, 1740 bp, Homo sapiens
tgctgggccttctcttccctctttcatatccatcagtttctgtttggaccttaatccaccaaaccagaagcagaattcccctccatcagtttctaaaggaaaatgtcattgaattcctggagaaatggaaatgccaggtgggagggaggatgtaatctggtcatattggtggctggatggggaagggtctgcagagcagactcagtgactttctcactcttgtgtacaactctgttcccttggattctaacacatggaatgcatggaggacccagagatgtggacccctctggagaagcacatgctagctacaggtttactgacctgcagtgtggatggattgggattttgtgggggaggtggtggaagtaagggatgggtgagaggatcccaccactgacttgcatgtgcaggacactgctttgggggtgaatcctgaagcactgaggggccttgggggttttcaggaatttgccaccttaacccgggagctgagcatgtgtcgggagcagcttctagagcgggaggaagagatatcagaactgaaagcagaacggaataacacacgggtaagtggggatgaccttgtgtcgcgcgcgcgcacgtgtgtgtgtgtgtgtatgggggtgtgttgtgaacaccttgaccaagagagcaggcaagagtggggccaggcacagtcctagctcaagccccatccttccctcttcctgtctcccatcctggggtgagagttacatcgtttaaccaccagtgctgggctctccacctgtagttgctggttcacagaaagctcagggtcctggggagaggccggggcagtcaccttgagtagtatcagttggggcgggagctctgtgcccatttggaagtatttcagtgttttcacagtggggtggctgtaactcatgtctgctcggggatcacatggaccctgcttgtagcccctggggcacatgcttacagccctccctctcaccctcccctgctctccctgccagctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcccacctgcccgccagcccccacatccagccaggctgccctggagcctcccatgtatcccttctctgagatttccacatccggtatttagggagcactggctccctccaaacattgtcttaacttcaaggtcctcctgttaggctccctcctgcaaatgtgctgcttagtaggcccttcactgtcctcatgctcagtggtggtagaccaagcccagtctcttccagcctgactcaagtggggtccccctttcttcctccatctccccttacctcgagcaggtgcgagagcggctccgggcagcgctggagcgagtcaccaccttggaggagcagctggcaggtgcccaccagcaggtaatctgcctgctcaccctcagtctgcagctcctggaagtccaggctggttcacccctgtgccctactctgtttcttgtcagatttctccctgccatggctggaagctgctaggcaaggctaggctgagcacctctttctaggagacattttttaactaagacaggggctttggaagggtctggaatgtatgggaggttctcttctctttgactc

SEQ ID NO: 57951 - DNA, 1068 bp, Homo sapiens
agcagggggcaggggtgcgggatggagcggcagaagaggaggggactgtggagctggggccgaaacgcctgtggaaggtaggtcatggagagctgtgtagcaggggtcatgtgttccccaaggtgggaggttggaggcccggctctgccttagttcagtagactaactgcttgaattaaatttgaggctttctctgatattcccccttctcttttcttcttctccctaccccatctgcaatgaaatctgtagatttttattttagtgcccaacacatgctgggcacatcatacgcttgtctgcttgaattgttaggcaccatctgcctcatgtggcagcatcaggcaagattccttctctgtctgaacctttgttcccccagtcacgcccctttctgggttacaagaggctggcatagcagataaaactagaaacttgttttcaagagagacaaaggatagcaaggtgtttggtcattgtcaggagtgacctcctggggcccagagggaggcagttgtagccagaggagtgctgtgatgttgggggcagagccttgacctgctctgggtgtgctgttcctccttccacccctgggataggggagtggggtgggtgggatgctgctgtgactcacagagctactgtccctatccctggaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggtgcgtgagggcgcaggcctgctctgtgacctcattgtggagcgtgtggagggagagccaggcaaaggctctggggcgtgagactgaacacctgcctccttgcctggctccattgttggggggcggtcatggaaggggtgggccaaagccagaaactgacaggagagtgtagctcatgccccttaatgggttccaatcagccaggtgtgggtgggga

SEQ ID NO: 57952 - DNA, 1026 bp, Homo sapiens
agcatggggattatttacagtctcttgaactgctagcttcaggatgttttaaggctaggcctgagcgaggaggaggcaggggagacctggcaggtattgaagtacctgggaagaaaggcaatggggatggtggtcctgctccaagatgataagtggaggctgagcgtcactggtactgggggccatgatccccagggccaccctggcaccagggtgcaggggatgcggggcctgagcaggaagaacagagatctgcgggctgcaccgacccatccctgcccctaggctgaagaacggcatggcaacattgaggagcacctgcggcagctggagggacagctggaggagaagaaccaggagctggcacgggtgagggcaccaggccgggccctcaggccccctccttcccgcaggacaggctcccagggcggtctgtggaaggggcacggaggaagggcctggccagggacacagccacagagagtgggaggaggctggcaggtgaagggggaggtggtcaggagactggagagagtggctcccagaggatgagaagaggacaggggagggagtcaaaccccagcaggagagggtggtcctccctgggagggcggcctggtgcgaggcagacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaaggtgcccagaggggcggggttgggatgcgagaggttagtgctgggtgtggggcggggggaggcgggactgtgatgggcgcaggcggggtctcaatggggtgggtggccagcctggagaggtggggctgagactgcacacccagaggctcaggtctggaatgggagaggaaggcaggggcctggctcacagctgctctcccccagaacacgttgatccaggagttggagagctcccagcggcagattgaggagca

SEQ ID NO: 57953 - DNA, 1047 bp, Homo sapiens
gattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctggtgagaggcagctgaggagcaggcctggcatcactggaccctgcaccgggggaggttttaagggatggtaggactcacgtgctctcagctgggcctgccatcttcttcccatggtgtgtgcagaccccgacatgtcaggccaccagcctgtccttctgggtttgggaagggcctaggtcatatcttctttgccctctcccttggatgagcccagactgcttaagaaactcacccactgccctcacctcttcctttcttccagagaaataagccctggcttgtttttctaggccagcttttttttttttttctggcgtgatattctctccgggcctgtgtgaggcactgaatcctatcttctcatcctaagaccactgggctcccctggggttggctctagggcacccagagggtgagtctgagcttacccatccctctctcttgcagcccagtgacttaagaaagcataggaggaagctgctggtgagtgctgcctgatggcccaggtactaacgggttcactgctcccatgccctttcctttcagcttcctcccccagggcccttgagtctgagtctgaactcagagaggcacccagggcctccccactgcatttctccatgctccgccacctcttctgggctgggtaggcaggcccgagatctctccctctatcccctgacggctccactgtctgttcagtcgccagtgtctcgggaagagaaccgagaggataaagccaccataaaatgtgagacttctcctccttcctcacccaggacgctgcggctagagaagcttggccacccagccctgagccaggaagaaggcaagaggtaagtagagcagac

SEQ ID NO: 57954 - DNA, 1030 bp, Homo sapiens
ctagctggctgaggaggaggaggagggagagcacgcgaggaggaggttggggaaagaggaaggagaaagaggaatttgctgagacagggagaggtctgtgtgtgaaggaaaggggtggtctgggaacggggaggaggaacatggccacctctgctcagaatatgggagtgtcagcccagagaatgaggtccagctccttcttccccagtccacaggggtgaggggagttgtggagctggccacagacaggggaagctgaacggtttgatcaggggaagaagcattttgggtgaagccttatgattttcgatgctctccacacacgttggcacctaaacctgagacagcacctcagattggtttctggattacccaaacttgttgcctactgtgcactgtgggggggtgaccgggacttaaaagaattctaagattctgcctctggccacgaattctgaagggttctagcatcaattcaaggagatgtttagtagaagacagaactctgcatgttcccctttgtggttttgtgcaagtgaatgcacccagagaaggaggctcagagacacagctctcagtgtgtggatttccacacccctgacccaagccagggtcatccttctctctgagccttgtagcccacttgtgtttggggctctgggtttcctttgcaccttggcttggaggaaggacaggttctgtctaggattctagggtcgataacttgggtccatctggctggaaaacacccccaaggctgaggctcctggggagactctctgaactggggatgacccgcttgatgccattctctgagactgcttggatgcagggacactgagcagaagctccaggaataatggtcccgtcaggccatgggttgtcctctgccaaggagcctcctgctgcttctgttccccacccctgatccaggcaagggaggagaggcagaggggctggctgacacacacatctctttccttgtagttctgctaacagactccgaattcagtatgcaggagcctatggt

SEQ ID NO: 57955 - DNA, 2106 bp, Homo sapiens
gtctcctgttgggctttgggaagatggcagcattgagccctgccccttccttcccatcctcacaaagggctctccctggtcttcaggaggatatgatgttgattctaggaggataccagcagccttggttccctgcctttcacataccacccatggggctccatctccccatccctactctgccaaaatttccacgtctctgggcagtttccaggatgggctttctggggttttatatggttgtcaggttgggggaaacaaagggaagagggcatttgtgaatattgtcttggtcctctaacacaagaatgcggactgctctgtgggcccctggggtggagtctttcattgtcggccatctccatgattgagaccagcccccatttcagaggactcagggagggagctttgtccttgtcctttgggctcccagcctgatggggatcctggggacccacacccaggaccagctaggtttcctctctgcctgcagtcttctgggaatgtctgggtcacccatgaagagatggaaactctggaaacatctactaaaacagtgagtctggcccttggcctttgtccctgggcctggggttgggactgatactcccatgaggatgaggggaaggctgtgggcagtcagagtgggctgccatcgatctcacgtgaggttggtatccctgaggtgtgatctgctgtcacggtggagggttgtcgggagaggggtgaggctgggagcggagcagtttgtatgtgtgtgatccttcccaggaggtcacaagcttgccctgggccactggtgtgctacagcggaggagagttgggctggggagggctttgccctgctatggacctgagccacagagtctctgcccttgtgcttcctccctggtggaggaatggggagtgttgggagagctgggcatcttgcctggctcccagtcaagcctgggaggtgtgtgtttttgccacacacacatttgccccacctcaacgcaaacatgggtgcacacaccaaccttgtgttctctcttaaccatcctgacgagctttccccagtcacccagccagatactgggatgtctttttcctctccttgatggggcctagggtagagctgatgggtttcttgactttgcctgtttcccctaacacgctgcactcgttcctgctaggacagtgaggagggcagctgggctcaggtaagactccctaccctgtctagaaccagctcccaaaacttcaggacagtgttcttctggtaggttctctccgcagcaggaatctctgagtccttcatatgaaaagccctggacataggttctctgctcccatcagagtgccccccgcccccacccagttccctcaaactgcttgttctggtttctcagggtggcaggtgaggagccctggaggactgtggcccctgcattcctggcccttctcctcagtctcattcttttcctgggaataatcagacctagattagtatgagtcttcttcctctccctgtccctctcaggggcaccctggtgaactgagcgaaggtctttcatccatttcatgagcaaacgtttattgagcaaatataaggattaggcctttcctggctctctggatatagaagtaaagaaagcaagccctcatggaggcagtaaacaaataaaggaataatatcagtaaacaaaccatgtcaatagggataaaaaagacagtctcggctgggcgcggtggctgacacctgtaatcccagcactttgggaggccgaggcgggcggatcacgaggtcaggagatcaagaccatcctggctaacacagtgaaaccccgtctctactaaaaatacaaaaaaaaaatagccaggcatggtggcgggcgcctgtagtcccagctactcgtgaggctgaggcaggagaatggcgtgaacctgggaggcggagcttgcagtgagccgagatcacaccactgcactccagcctgggtgacagagcaagactccgtctcaaaaaaaaaaaaaaaaaaaaaaaaaaagatagtctcaataagtaaacaaataaagggacaatattggatagtgatgcgagctgtgaagaatgaagcagggagc

SEQ ID NO: 57956 - DNA, 1087 bp, Homo sapiens
cagaaaactcagcatagtggttcccttttagaggggcagtaggagatgtgtgctgacagcgagcatcagtgtgcaaacagtacagtgtgggtaatgctctgctgcttagcttggttggtgtccactgttgctaacttcatttatatgcttcataatgggcacattacatatagtcttatatgtatcagctattacattgtaaaagagaacaaaatagactttttctatctgaaaacatcaagtaagggtaaggaaagagtgaggtagggtcgctatgaaaactaaagctttctcaagttgggtggtcacggagcaccctgcccaggtcaggaggccacgtccacatggcacaggccctgcaggaccacacggcagggtgtgcgtgggaaagcaacagaggacctggagtgttcttggagcagaggctcaggccttagagaatgagtgctgctggctattcaggcacaggccaccaccctttatttttttcagtcttctgccaacatttaacttccttgcttcctccatgaagccagccttgtcccggagtgagacaggcttcctttgccacgctgcaggtcctctgtaacacagcctctcccctgggctcagcgggcttgaggctcactgagagtcaggaaggcacgtctgctgcacaataccgcaaatgcaacccagagtcaacaggaaggatttcatattagctgctgccgggatagctacttctgttcattagtgtagataattgatatgtgagtggaaccgtatcatttcgagatcttaaaaagttccatttaaaatcctcacctcccaccactaccagcccccttattgaagataaactgaaattgtattggactgcccttcctccctcatgggtggaggatggattcatgtgtctcccgaccagctataccagcctcagcctgctggctctaccttcctcccccataatagcctcctgcatctcatttccctagaccctggcctatggggacatgaaccatgagtggattgggaatgaatggctacccagcctggggctcccgcagtaccgcagctacttcatggagtgcctggtggacgc

SEQ ID NO: 57957 - DNA, 2860 bp, Homo sapiens
tctgtccttataatgactaggtcattgtgtctagtcctaaagacacaaaaagtcatttttctttagcttcacctcctttgagatttttccccaggtctgaattttattgcttgtctttgggcttgctgaatttgctgtgtttacctgacaagactcaaactgaacctggtgttcaatttaggtgtctcattccaagttgagagggaaggtcttcctgggccattgccatgccgacatcccagatcggaacctctccgctttgggctcacatccctttttataggatatcatccagtcctctcctcctctttgctgaaaagatcttctgttcaaaagtgtctgcggcgcaggtcccaaactggcagcctgtgggcagaatttggcccacagacttgtttttgtttggcccacataaatcttcaccactcaaattgagctgccagtatttaaacagtagattttatatacaattctggatttctggcttcttttgaaaacttgaaagctctgtcaacacattctagcatggaagcaaccagctggagctgaagagtggagtccactcaggatgggtgggcctgctccagggcctcccagccccccagcctgcttctctcacttgtgttacctgcctgttcccagcaggcatttgtgctggagaatgcagtaggtggccacggttctaggatttggcagtttttaggaagtccttcttaacatccagcttcaagtcgtgtgggtggctctttgagccaagtcttttgtcttgactggataataagaccaggagtaggggtcttcgaggttctctcagggctctgtggatgtcctgtggtctctccaactcagaaatcttatagaaagttaaatctggaagggatcttgttagtgtccccattttatggatgagaacattaaggcatggggaggagcagtagcccaaggtcactcagggatgatagcagagtacaggggaacccaggtacgctgactcaagtccagtgctcttggcactgcacagagcctcctggcttagaacccttggcctatgtgaccccagcatgagggctgacttgtgagggaagaccgcatcctcccctctgcacccgcccccacccaaatcagctagggctgaaaaggaatcgtttttctctgcccggaggctgccaggcccagctgcacctgtcccctactcagtgattgatagggctggggagagatgagctgttgccccaccaagccgggatgtgcctgggctgctagaggatctgtcagcctggccccagccaggactatggaaatcctccccgcaacccctctgccccatccccaggagagaattgtgacctgaacatggggttctaggttcagctctgaatcttgagtacttcagagtttctaaagcattttcacatctcaccgccaaactatgtgtctacctgcttttattccacgtaacatttcacaagcatgttcttacgtctttaaaatttcttttaaatcatgatttttatgacaagaaagggatattttaaaaccttattttacagataaggaaaacaagttcaatagaggttgatttccatcaggtcacccagccaggtgattacagaatggggctcaaatccttgtctcttgacaccctactcagagctcttttccttgggacatggtgctctattgagcaggtcttctagaagagctcctgttttggtaggacaagcatgcatgatagtcataaatgtcaccctaatagtgctgccactactgagtgcctgtaatgttcccaagggctggctaagcccttgtatttattgtcacctgcaagagaggtgtgaccccatctcacatttgctgggtgcctctcagctaggaaagggcagagcttaagggctttgtatttttgccatggtatgcagcagctttgaaaggaactggactgaaaattatagtgagtgagattgaaattagacagaaggcatttccagtcatgagctgtgtgtgcgcatgccccttcacagtggaccaaagcttaaaccagcggcttgagcaacataagggtggcttgggccagaaaagggttcctggaagtggcatctctgagctctgttctaggcagaagagcctcctgctgagaagtgaggggagaaaaggagggagcagtctgcacaatttaatctcacaaagcagtgccctcaataagagtcaaaagcaggtagagttgggagggactttccattctaattctctaaagatgggaaaactcagagaagctgaatgacaaagtagcattcaaggaaggaagaacactacagctcttccaagatggaatgagctgccttgagaagtaatgagttcgctgcccctggaggcattcaggcacaggctcagtgactactctgaaggaagctgtaggggtgactcctgccttaggtgggagcgtggactgatggcctccagggttccttctgacccacagaatctgtggttctatgcctggcttagttactgaatgcttgctctgcacctgatactgtttaagtacttttagtaatttatgcgaattaattatttcctttaattcatcaagcatttgtagagtccctgctctgtgctaggggtttaggatcagtgaacaaaacaaagatccctgccctcatggagcttatgaattctaactggaagagacagtcaaggaataataaatatatggtatgttaatagacaaaacatgctaggaaaaaattagaccagggtgagagggattgggagtatgggctaggggtggtgatggtgataattgcaattttaaatcggatgaacaacgtgactagtgagttggactgagaaggtgacattt

SEQ ID NO: 57958 - DNA, 1602 bp, Homo sapiens
agcagatcatggagtatcttataggccattgtaaggactccgagtgaagtagggatacaaaggggtatcttgtttttgcttttccttccacttgcaggtggtaggggtctttgtcgttccagtgcctggagagagagggacatgttggattcattcaaagaactttttttcccatcaatccatccccaggcccgctccctgactgagagggaggatatgggttagacagagaaagggagtaacctcgggatgggtcgcaggcaaggccctggggaaggaggagcatgaggaggctggggtgctctttgtgctggaggcagtaggtctggacatgctgtggctgatgctggatgtgagacaggtggtgtgggaatgtggccccactgaggctctggcttgggggctgtgtgcctgcagaaccagtcttcagtatggcatcatgtgtctgaagaggctgaattatgaccggaaggagctggagaagaggcgagaggagagccagcatgagatcaagggtaagctcgtcaggcttggagagggttcgggagcagcctgcttggctggtccctgccttgggccaagtggaggggaggcattctgtgtctcagggaatcttccagtctgaaaaggaagatgcagcctcaccttagggagctcccagtctgatggaggagacatagtccatgccaagttgtctataattcccctccctcaaccccacataccagatagcagccaccaactggacaaatgcagtgaatcctctgggacggtgttatagactggtgtgcctgtggaacttgttgatctggatggggctggatgggagatgcaagtcttagaggagaccttgaaggtggaaagaataagaaggccattccagcttgggtcagggggatgacccgtgcaagggttctggggagaaagcttggagcctgttggcctgaccccgggtcctgtaaactggcagggatggagtgagtggggggttggttccccaggcacccaggtgccagggaggagagaaagaagatatggaaatttagggatggagtgggggtcagagagcagggtggactgcggctctgggtttagggagctctgcttctgtccttggagggcccttgatgaaacgtagtatctccttccgtcccttttcttcccccacactccagatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggtgggcagccttttaatcagtcaacttgagtctctccctgtatccctcacttgctctctttctttccctcatacacaaaggcttaggtatcttggggggtggggagcttttctagggcctatgccagaggggatcgcaatgtcctcaattctccaagtgatcgctgtgcataagcaagccctcatgggaacacatggccttcacatacagagcacacctagcgtgggcctggcacacagtgtgctcttaca

SEQ ID NO: 57959 - DNA, 1972 bp, Homo sapiens
acaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagaca

SEQ ID NO: 57960 - DNA, 1047 bp, Homo sapiens
gggtgctggcaggatcagttgtgcttgtggcgcctcactccctgcacatgctgctcctgggctcgagcttggggagcagacagtgcctcctgactggttttcctttagctttgatcttgctggctgtccttgccagggcttggctgccagccttggtggttgatagccaacctttgacctttgacatccagccttccccctcctccacatgtgctaaccacagtgaaatcacagatgcacaaattatcagaactgggaagaatcttaggccaactgcatcattttaaagaggagaaactgagaagtagggaggaggaagtccttgtctaaagtgacagatggcagaatggagtaagccacattggactttagcagcctgcctgccttgtcttcaagagccaggaaatattcatttaatatcttctacatataatcacaccacctttacctaggtgatcacttaggtacacacacacacacacacacacacacacacacacacgttgtctagagtctcccttctggacctctgcctgccccagatccttccagattcctgtcactgcccccctatcaaagatccttgcccaattttctaccccagtgatcttgcctctgttgggtggcaaagggctgatgtgacatagctgtgacatagatgtgatgttaggcccttggcctctcctccttcccatacagagcagatagagagcttcactacttatggatatgaggccttaggttggttccttaccctcaccaagcctcagttttctcattttggaaatggggataataacgcacttagcttattgcctggcacccagtcagctaataaaatgttagctattatttattattattaatgggactatgattattcctaaaagcagtagctctctggaagacttctcatctagcctgtaggagggggctttggctccataacttttccatggtggtacccccatccctaaaacaaagtcctgcattctaggagggcttctggaggtctcaatccctaccctggccccaaccattgtcagc

SEQ ID NO: 57961 - DNA, 1001 bp, Homo sapiens
atccggaagaaagcggatatcctgacaggtgagctgcatttgggccacttttgacctaacaatatttgccaatcaagaaaagacagctgagaggttgaacattattcatgagagccacatggggttaggggataaaagttggagtctccgggcacagtggctcacgcctgtaatcccagcactttgggaggctgaggcgggtggatcacaaggtcaggagttcgagaccagcctgaccaacatggtgaaaccccatctctactaaaaatacaaaaattatccgcatatggtggcgcatgcctataatcccagctactcatgaggctgaggcaggagaatagcttgaacctgggaggcggagattgcagtgagccaagatcacaccactgcattccagcctgggtgacagagcgagactccgtctaaaaaaaaaaaaaattggagtctagaacccaccaaggtgggggccctgataacaccccacaccccgccctgacacatactgtgggttggaatccaaaacagctgcatcccaagagcaggtcatctattccctgcatgctgcagcccagcttccagtcatctgggcggcccagaaaaacctcaatttttaaagctggattaaacttactccagactgccaactaccaggactcctaggcttgttaggcttggaagaagcaaataaaaatcatctctggaagaaaatgacatcatcccaggcctcaattattcctacagttttgcaagcacaatgtcccgaacataataaaaaaacaactgggggcgttctgctcccacttaaaaaatcctgcgagaacatggctctcattataacatcacgtgacagctggaacacctacagcagcatagattttaaaagccatcagagagcagaagtgaggctgcaaacagaacaaagcaaaacaaaaataagttaattaaaattccagaaagtaataagtaattcaaagtaataagtcattcccacagccactttc

SEQ ID NO: 57962 - DNA, 1083 bp, Homo sapiens
caggttcctagcactgacgacagcgagcgatgacctcagcgccgccaaggctgcgagggcgggggctggggtggcgggggcggggaaaagcgccggagcggggccgagcggagcggctccgggccccgcccccatcctctggccgcgaccaatgagcgccgccgccggctgcccccctacctccctggacctcctgaaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacaggtgagcgcatgccgaggggcctggcgccaccgggggtcggccccatccctgccagggccgtctttcttctactcctgcggcagggtgacccacgggagcagctttgggactcggtggccctcctccgacccccggggcggcccgcagtccccagtttcctgggtcctcctccccagccctgtgctcgggtctcggccgtggcggttctgatggggcgcgcccctctacgctctcggaggcgcagaccctggtcctggagtgccagcccgagtccccagcttatgcccctgtctcattacgggctcgtctccctcgctggaccctcgagatcttaagaccctcgatggatgttgttgcgggccgcccggtcggccgaggggtcccgatgagggaagaaggtgcagtcgagccttttcaacaatttggagtcccagtgcggttcttcctgccggtcggggtgcgctgtgcctggggtagtccactggttgctgactggcttcaagttggaatttgggccccctttgtgttatctttggttccccttagccatctgccacctattgtggtagggaggagagcctcgtagctcgtgaccctgccgtgcgggccttcaagttgggaggtgaaga

SEQ ID NO: 57963 - DNA, 1568 bp, Homo sapiens
gcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgtttttt

SEQ ID NO: 57964 - DNA, 1047 bp, Homo sapiens
tcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaacttgtgtggtgtagagaagttaaaatcctcacgttgtacatttgtgtttccctttcagatccaaatcctttctttgtgtttaatagtatttctcctcacttgcactcagacaatctatagcatgtgggtggtataaaagaaaaatctggttgtatggctgggccatttccaagcatcccctctttcctggaaagtagctccttacttccctccgttttgtttgtttgtttgtttgttttgagacagttttgtcactcaggctggagtgcagtggtgcaatctcagctcattgcaacctctgcctcctgggctcaaataattctcccacctctgcctcttgagtagctgagattgcaggcatgtgccatcaggcccagctgatttttgtattttttgtagggacggggttttgccatgttgtccaggctggtctcaaactcctaagttcaagtgat

SEQ ID NO: 57965 - DNA, 1070 bp, Homo sapiens
cacacctggctaatttatgtattttttagcagagacagggtttcgtcatactggacaggctggtctggaactcctgacctcatggtccgcctgcctcggcctcccacagtgctgggattatagcatgagccactgcacccggcccattgtaggtttttaaaagtttcataattaacaaagtaaggaaagatacagactcaagaataaaagtgagctgggcgtggtggctcacacctgtaatcccagcaccttgggaggtcaagatgggaggaaggcttgaggccaggagttcgagaccagcctggtcagcatggcaagaccccatctctattagaaaagaaaagaaagaaaaggaaaagaaaagaaaagaaaagaaaaggataaatgtgagttgtcatctgtatacaccaacccaggatgtccccttttctttttctctgctgtttagtttggtgaatagacgatgccttccttgggctgtttttgctgttgtcagggtatcatacaccaaggcctgggtttcaggtgcctgggacttagtgcttggctggtattccattcccaaggccctggaaacatctgtctgacatcctagatgaagctcttttgtctgccttatggaagtccctgttagatggcacagtgcattgaatagtgtccccccaggatccatgtccacccggaaccttacaatatgacttatttggaaacaaggtctttgcagttataattaattaggggtcaagatgagatcgtaagataaatatgtacaaatattacgtgtccgtaataaataaaaataaaaataatttaaaagatgagatcctaatgaattagggcgggcctgaaatctgatgactggtgtcttttttttttgtttttgagacagagtttcactcttattgcccaggctggagtacaatggcgcaatctcagctcactgcaacctccacctcctgggttcaagcaattctcctgcctcagcctcccgagtagctgggattacaagcacctgccatgacagctggctaattttgtatttttagtagagatggggtttcactatgttg

SEQ ID NO: 57966 - DNA, 1053 bp, Homo sapiens
caggagccgcctcccgagggtggaaatggctgggccgcgcacactgatggagaacagatggcgggggcggggctgcctcttccttcccccgcccccacaaaaacactgtgaaccctcctccctaaacccgaggttgggcaagggggccgcaggacccatcgacgtcacgcgggcccatcccgggcttgaacccttcccctctcccatggctgcttcctagttccttgggccattcttctccttggctgttcctcctgaggcccagccaggagggcgtgtgctatgttcaccctggaacagaagggggcgccctgcgcatccctgtgtcctgctggccagatgcaggcccctgcgggagccctgaccctgcaccctacctccgtcattccctcgctcctccttcccgatacccgggccagcagggccagggcgatgtctggtgccggggaaccaagcggcggagcagcagctttgccagaagggatccttggcccaggagaactgggtttctcggcctctttgagccagagctgccgaagatggaggagtccccagggggactttctgaaccttacctccgggctgtttgctcggccaggaccaagatcagatagtccacggcccagatgtacccaggagtggcgggtgggggaggagagagaaggggacaccaagtctttagacacatctgtgtttctggagcaaagggaaaccacagaaggccaggagtttgggtgtgcactgggtgtctttcaactgggtggaaccaaactgagtccttgaagtctcgctcctgaggctgcagaagaatagatggcttttccctgcctcgagggtgggataagggaggcaaagctgggagaaagaaagggagagagagaaaacgaatggccggcacaggtgcctgggccccagccttcaagtgcggtcagagcagatccggtggcggagtagggcctagatgaccacggactgcaggaggcggaagcacatcatgaggtccagcgggatgggcggcttcaagtagtttccatccagccgcaggtagcgcag

SEQ ID NO: 57967 - DNA, 1017 bp, Homo sapiens
acatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgt

SEQ ID NO: 57968 - DNA, 1033 bp, Homo sapiens
cattttaaaccaccgatatgatgtcactgaatgaggagctggaagagatgcccagtagcacaccattatctagagtttcccccatacagacaccatggacagaaataacttcaagggcacgattaatagtgaaatatagtaaactaattgaaaatgatgatttttgaataattattacatttgttttcaatataatatatttaattgtgagtttatataatttaatttttcataatggctgtgtttaacaactgacttgcaaaattctggaaaatttagtaatcggttcctgcaagtagtaagagctggctccagcacatcactgctctcctcttccccacttcttccttctcttcctcctccccctcttcctctcccacagctttcttggcattctgtgtgggtgcaagagatggggaatatggaaaagagctccactgcagacactgctattttctgagccaggagccataagtgtcaaggaaagaagatggagaaatgcaaatttggctactgaaaaacatttcagtacatgagtgtgtgtgtgtatgcatgcgtgtgcatgtgtgtgatatttgcaagggatcgagaggttgattaatgcctgggctaaagatcaccgtttaaagataaggaattgggctttatggctggaggcccatgcctgcatggtccttggagggttcttacctgggaggagtggaagggctccgagctacgtgaagcggccgatggggagccgaggcaggcagaagtaggcgctggggaagaggctgaggttgatggggttgccatccaggcggatgtcttccagctgcctgcgggtgtgtttgtgctcctcggggtcacagaagacgtctctctgcatggtctctatcaggttattctgggaagaacacataccagctgagcctcaccaagaggctctgccccttaagcagcaccaaaggctcacatcagctgtccctaccagctctgcctgctctggtgcaactggagaaactgaagcatctagggccaaagccacacaaca

SEQ ID NO: 57969 - DNA, 1022 bp, Homo sapiens
agactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtaaaggccatatcaggggtggggagttggaggaaggtggctagtgtttcaaaatattgttttcccagcttctagagaaggcacatttctggaggcccagctggtatatttttgtctggtgggaaaggtatggcatctgaagcactgaaaggagggcaggccatgaagaactgtatctttcccagagatgatgtttagaaagtgtgctattctctaaagattattcttttctcctttttcttttctttctttcttcttcttttgtttctttttttt

SEQ ID NO: 57970 - DNA, 1032 bp, Homo sapiens
tcctttttaggaggaagaatggtgttttctgaggaagagttaggccagcccttggaggcaaggtctgggcccagaacagaatgggaaacaaggggagccttgaataaacagcaaattattaactgtaggccttctttcaaaaggctgaaggctattttggttgaatttggatctaaaagattgttggtggaactttctgttttatgttccttctgtacccttctacttcttttctcctctgcagagttgaaggcgtgacagtgagatattgagggcctccaattctttttcaacaacattcaactaatacttaaaaactgctaggtgctagggacacaagggtgaacatgacaggtgcagtgcctccttccatagagcttacaggctaaaagaagatgcatatgaatgaaggcaatttcagaaatcttgccatagggcttcgatgaggaagagcagcgtctatgggaacacagtgtagggacctaagctgaaggcattgcaggggaggggaagggggcttagagctggagacagcacacctgtatcatttagggattacccagtgaagctctagcatggccacgctctatgatcattgctaccacctgctgaatattcctggcataagatgccagcatttttgccttccttaattactgggtagttactaggtttagggagctgagattccttggggagtaagtggcaggcgggaaaaaaaatgtgttttaagacggccaacccaaattacaattttgttttattagcttgaggatttagatgaacgtctatcaccttaagatctctggggcttaactgtgttcccgtcactgtgccttttgagggcagtggcatgttttaccaggaattgtccattttgctacaagctgagatgtactgggattgggctcttcctcggtgtagcagattgaaatttctagtagtattgtcaatctggaaaaaattgagtacatatcccaagtaaatgttcacctacaagactattgccttactattaatacatctaacact

SEQ ID NO: 57971 - DNA, 1050 bp, Homo sapiens
atacttgagcaaatcaggaaggaaagggtcttttttatttattttattttagagacaaggtctcattttgttgcccaggctggagtgcaatgacgtgatcactgctgctcactgcagcctcaaactcctgaggtcaaaacaatcttcccacttcggcttcctgagtagctgtgactacaggtgcaccacatcatgcctggctaatttttgtcttttttgtggagacaaggtttcaccatgttgcccaggctggtctcgaactcctaaacataagcaattcacccaccttggcctcccaaagtgctaggattacagacgtgagataccatgcctggcctctttattttatttatttttgagacagcgtctctctctgttgcccaggctagagtgtaatgacatgatcatggctcactgccacttcaaaactgccttttatcattttccttttttcctacattcattcatccactcctatctccttttcaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaacgtgagtgtcctaaacagctcagcgtgactcttatctgggttctttccaccaccaccaccaagcgcttagtattggtggctgacaggttatagcttaaaacatttcccccattatccagagtgggctttccaaaggaaaccaagcagtagctactaagctattcttccaactcatccttattccaagggttcctccccaccccaccctcaccctctgtcttctattaaatcctttttcggaatgtcaggaatcctctacccttttaagacattttatttatttattaattattattattattattattttaatggaatcttgctctgtcacccaggctgggtgcagcagcttaatctgggctca

SEQ ID NO: 57972 - DNA, 1050 bp, Homo sapiens
ctccttcagcccctttctgcagtaaagattcactattttaagcactgagttccaggaaggatggttgttttaatagtgcttagtgacatgattaatccccttgctggaataaacctagcttgggactctgaggtagtaccaggaagctgccactgaagaagaaatccataccctaaaagcaccccagtttcatctaaactcattagaatattattccaaaggccctaatagagtgttgaaggcaagttccatgtctagcatgggttggaagtggtcggaactgatgtcagggtccaaggtatattccgggaaagagacaggaaggttttctggtttccacctgcctgccactcagtgctaccaccttgcctgctcacctgtcctatttgtgtgtacactccagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtgagtagggtagagcctcgttgtggtttatcaatgttgtcttggatcctcatcacttttatccccttctttctgcaccgaccgagactggcagaaagaagctgaaacttcagggtggctagttggggctaggcggctgtttccctatctccgccactgtttggtcgctccctaggctttttcagagagaaatgttttcctgtgtgtaagggttaatggccctgagatctcttaatccaaatgaatgagaaacaaagagcatatattacagcaggggagatttacattagcaagaaggaagactttaataactgcttacctgtctcttgctttgggttgtaaattccttaaagatagagaaggctgcagcttgctacaggcaattctctagcataggagtaggatctggctaagcacagagcaataaataccaagtaaggactggaggaagaaggaaggctgtggttacagaggctctctccaga

SEQ ID NO: 57973 - DNA, 1011 bp, Homo sapiens
gctgtggctcatgcctgtaatcccaacattttgggaggttgaggtgggcagatcacctgaggtcaggagttcaagaccagcctggccaacatggtgaaacccggtctctactaaaaatacaaaaattagctaggcatggtggcaggtacctgtagtccctgctactcaggaggctgaggcagaagaatcacttgaacctgggaggtggaggttgcagtgagccaaggtcgtgccactgcactccaggctgggcaacagagcgagactccatctccaaaaaagaaaaaaaaaaatgttatttcccctatgagctccaggtatataatgtgaaggctttgtaaatgagttctttctccctaagttctctgccttgtcaaggcatcttactcaatagtgctgtgtatatttcttctcccagcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgagcacccccgaccactctgcttcccttcaagatcctctcctcaggaaggcatgggtgcacaccccacactgaacccatgtgaatgagggagccctccagccaggtggtgacataataactaatatccaagcgtctactcaggccacgcatgttttttaagtgcttaaggtggcttgttgtatttaatcctcacaactcagtaaggtgggtactatgattatccctgttttacagatgagaaaacagagatataaggaagttaagtatctcactcaaggtgatacagctaatagtggcacagccaggattcagacctggacgatcctaagtttccatttcctaatctga

SEQ ID NO: 57974 - DNA, 1078 bp, Homo sapiens
actacatgagagcaagtatcaatgcagcaaactgagagagaaggtaaaataagtcaagaccagaactaacatttaaaatgtttaataactagtacaacaaaaaattagccaggcatggtggtgcacgcctgtagtcccagctatttgggaggctgagatggaaggatcacttgagcaggaaggtccaggctgcagtgagccatgatcatgccactgcgctccagcctgggtgacagagtgagaccctgtgtcaaaaaaataaataactagtgcagctcagatattgattaattagaatggacaccagccataagcaagcagtatatctgtaccaacacattcttactcttagttcagaccacacttaacctccagtgcttctcctctccccactaggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccaggtgagattctatctgcagttggggcaggagatctggaatgataaagggcagaagctgggagccagggttccctacatacctaggaaaaggaatgaaggaattacggggactggagctgtaagttgaacactttgggattcccaatctgctttcttttgcatattgctctagaattggagcccattgtgtcaagagctccagtgcagggcagcatgttgactggaaataaaataatacttctaaaatcctttcatgatctttctaaatacacagaaatttcacagaatgaccaaaagaagtattctcttctagtccctttctatggctcctgtcagcctatatgaaatgtgcatgcacatctagtatagactctccctgtccctgccctttgttctgaagggcttatgataaaaagtgttgtgcaactcaaagaaagagaagtaatgggatttgtacatgtatattacata

SEQ ID NO: 57975 - DNA, 1075 bp, Homo sapiens
acagatatctctctctctctctctctctctctctctctctctctctccctctgcctctctctctctctctcttttcccccctcccccagggggagtgcagcctcagtctcccaggttcaggcaatcctcccacctcatcctcagttcctaactccatcactgtaccttctccttgtcactaactggctttagtcacaagaagccaccagctcccctaactcctccagattgtctgttaatcatagtcacagtaactatgtctgtctccccatcagagtgctcttaaaggctgtttttgtctgtctcccctttgagatttcttcttttcccttcccctgcaagcaaatcgggacttgtacccaaggatcctgaggagtgggatgatgtggctttgggggccttggctggagggccagctgcctgttagtcatttccttgatggtgggctgcccctttctctgttctagattttcatcgtggaatttgggggtaaacccttcagttgtacaagcctcagcctgtctcagtggctgtggtgtctcttcattgggattggagaacttctgtggggccaggtgagtaccggcacaccctcctggtgcattctcacagcctgcagaactcccctcctctacatgagatggaacaagcaacggtggagaccccccagctcctcatcttcatcttctcctcttccctccccacccccactcaagttttcaagttcttgccatctcataggatctcaaggtggaatgatcacttcagaggtttcagaattcttctctaactaagcctggaggtagaaaaatcccttagcttggctgggcgcagtggctcacacctgtaatcccagcactttgggaggccgaggcaggcagatcacgaggtcaggaaatcaagaccgtcctggctaacatggtgaaaccccgtctctactaaaaatacaaaaaattagctgggcatggtggcaggtgcctgtagtcccagctactcgggaggctgaggcaggagaatggcgtgaacctgggaggtggagcttgcagtgagccgagattgcgccactgcactccag

SEQ ID NO: 57976 - DNA, 1014 bp, Homo sapiens
actactttgcatgtggcaactaagaaaggggtcattcatttccaatacccttctcaaccccttgcctatacataggcaatatcaccatcttctccccaaactcttttcccccaggtcctggtctctgtttcttcctactgcgtaccatgctgtatagttctgttaaccttaaaagacagattgcaaaatggaacagaagaaatgagacagaaagaggaaaatgaagtatatgaccaggcagatggctggtcaattactagaatagaagctctcttttgtgtgtgtccataaatacagaaaaccttcctaaaagcctgaccgctggtgggcacttggagaatgcttgcctggatggattggtgcttctgcccactgctcttccagtgggaagggtggtagggcaaagagtaacctgcccaagggcctggctcatgtaagttgactgacagctcttctcacgctgattctgacgtcttcctcttcgctgcgcttgttttcagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcaggtactctgatagtggtctgtccttcccttgggagaagcagcttcccatcttggaaggtgttgggagggtagcagttcttgtcggccagcatctcttcccttccaaaggctcactactgatgggcagccctagatcctcagcttcaggacagacacgcaaaaggatctgtgtggggtcctctgagaggagaggagtcaaatgacctagaccatgggacactattagcatagtcctttagctctgggttgaccctaaagcccagcctgccaccctctatcaaatgggcaagcttcagcataaggtctcttgcaagcactagacctgaccccagggtggg

SEQ ID NO: 57977 - DNA, 2334 bp, Homo sapiens
atgaaagaggtaccctacccccaccttcatcactcctacccctccaacctcaacagtttcccccacattactcccatttcttttctgagtgaagattttttggacaagactaggatcagccaccttccaacaactagaaccgtcctacaaccatttacctttcccctggcccctctctccaacttctcggagctccaaccctctccccctaccccaattctaccatccctgattctaagccacgcctcagagagacctgcagttcagaaaagcagagctgccaaaattgctggtgcctgtggacaagcaaaagctgttcacaggcatcaattattgtcagttttttcttgatgactctgaactgaccgaatcccttcctttttgcgcagtaagacagagactatgacactgggcaatgcatctccttttgcccagtaaaaccgcacgtggtttcctttccttcatcctcttcatccaccccatcagaaaggccacttgtttgtagcactgcctcctggattaggtttctctccctggtccctttcattcccttctccacataagactatgctcctcttcacaatttggaaacagctagagaaagcagcatgattgggcacagttgctgtgtatcagagacatgaacgtgcatttgaattatgagagccaggtcttttctcaataggcaggaggaaggcatcttttgacacctgtattttatctgctgcttctagggaaggggctgaaggagtgaagttctgtgttatttgcggggaggggacacagtggtggttgtgggatataaaaatatgcatgtttcctggctgaaagggcaaattattattagagagttttaagttcctgcatgctgctgacacaaatgaagattggtttgtctgcctggctgcacagttttcatggtcactcgtcacccaacctgtattatgtgcagattggtgtatgctggctctttgaggtctttaaacagataactaaacctcaatgcataatttttccattccacattcacaaaatgtttggcctcagcacagaaatccacatatctcaatcatctttttaagtttggctatgaatttgcatctagttcccatgtccttgccctccatctaaaagaactaatgaaacttcttgttttctgtttcattttaaaagtagattgtttgggaatgctaacgttgctttgggttttctactttttttaatgcagctttcaaaacgtcctagttgccgtcactcaccccagcccaccccactgcttgaaagttgagccatgtgatgtttctagtgccccatgatctcttctgatgtgtgtttggttttgatgctgagcagtcatgttttatagtctgggttttgtttctctcctaaatccaccatctccttgttctgccggccaattctcacctctctattttctcatcctccttttccttcccctggtatagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagtt

SEQ ID NO: 57978 - DNA, 1035 bp, Homo sapiens
ctggttttgaactcctgagctcaggcaatctgcctgccttggcctcccaaagtgctgggattacaggcatgagccactgcgcccagcaggaattttttatttttatttttattatttatttatttatttatttattgagacaggatctatctttgtaacccaggctggagtgcagttgtgcaatctcagctcactgcaacctccgcctcctgggttcaagtgatcctctcacctcagccttcagagaagctgggattacaggcatgagccaccatgcccagctaatttttgtaagtttagtagagatgaggtttcaccatgttggccaggctggtcagatgcaggaattcttgacttaaataaagggttttggatgatcatggatatatttgttcttctcttaagcatggttaaaggcaatctgtaggtaccagtccagctcttcccagccttactccctctttcaaatgagttatcatatatacttgctttaaataggtgaagacatgaagatctggagttataaaacacaaatcagtctttcaatgcagtcttcctgggtctagcatagcaagaaagcttaaatcaattgtgctgtgtttggaaaaagaatgtgctaaaaggagatggtctatatgtcctctgttataggagacaccagagaaatcaagtgatgcttaagcttgaacacagggcccagttctattctaaagtagagacaggccaggcatggtggctcatgcctgtaatcccaacatttgggaggctgaggtgggaggatagtttggggccaggtgattgactccagcttgaacaacatagtaagactccatctcttaaaaaaaattacaggcatggtggtgcatgcctgtagtctcagctacttggaaggctaagatggaaggataacttgagccgagtctaaggctgcagtaagccttggtcatgccactgctctccagcctgggtgacagagcaagaccctgtctcaaaaacaaaaaaaggagtagggacagatatatgccctgtgagtgt

SEQ ID NO: 57979 - DNA, 1325 bp, Homo sapiens
cctttcagaccatagagggtaacttctagacattgctatggcatttgtaaactgtcatggtgccggtaggagtgtcttttagcatgctaatgcattctaatgagcatataatgagcagtgaggatgactaggggtcactctcgtcgccatcttggtttcgatgggttttggctggcttctttatcgcagcctgttttatcagtaaggtctttgtgacctgtatcttgtgccgaccacctatctcattctgtgactaagaatgcctaaccttctgggaatgcagcccagcaggtctcagcctcattttacccagctgccatttaagatggagtcgctctggttccagtgcctctgacttacccactctgaatcatgctgaacttccatgaaatgtgggtctgccagaattctttactcataaggcactgcaaaaactatatataaatgggaggcaatggatgatggacatgcatattatgagtatcttctcttcccatgtgcattctccattgtcccaacagacttcatttacaaaacacgagttcaaagataagaatttctttcaaaggtaagaatttcaagatggcaacatcacaatattaaaccaagtgcagggcccttctgagtgccaggccccatgcaactgcttaggcagcacgtccaggaagctggccctgcatgggaaattgcgctcttgtgaagggcttcaggttcctttcatttcccctggagagtcaaagaagcatcggagataaaagaaaaagttagagttttctggctatgttgtcatattcttctgaaatgatcctaactcttcagggtagaaacagacatctaccttcccagtctggagctgggaatgctgaaggaaacgattggtaagaggaaagggaggcctgtttacttccatttctctctaacttcaggggagcaggacaccggcttattgactgagagtttctggaaatatttgcaagtcagtataggccctcagcccacaggaaacccagaattgacgataaagcctgtcatagtaagggggtgctgaaggagaacagatgccagagggacagcaagacctcatcttccattcaccattagagggtgggtgcttctagagggaaggagggaacttagcaaacctctgtattttgtactaaacagtatcctgaatgaagacacaatcaatataatgtaggtttgggtaattaattcattttatttaactaattaaggaatcaaaatgggttagttatctttgtttgtttgaggcagagtcttgctatcacccaggctggaatgcagaggcaagaatatggctcact

SEQ ID NO: 57980 - DNA, 8129 bp, Homo sapiens
gtaaaaaataaactaacaaatcattctacattgcatgcttaggaaaagtacagtttatttctaaattaaatgtatacatggtttgggagatttactcattaagcaaacactttggtaagaataaattgagcgcttactgaatggcagtctcagttcctgcggccctcccgcttattacctcatttgatttaaaaacaaaaacaaaacgttatgaaagccggcttcgaggcattcctctgaagggaagggactccccgacccagcgcctcccccgtcacgtgaccctgtgacccggagcagccatcttaggcatcgcctcatagaggaactacatcttccagaatcctcgcgccctgcgtcgtgctggcacttttaccggccgggccttagagcggagcctgtagccaggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctggtaactagacccgtttttttgattcccgggtggcttggggccggggaggtgggggagagggcgaggggagtggcagcggcctcccctcgcccctgggtcgcggcctatcccgggaagtcagagcggatccttcagcttcgccgtaacgacccctcccccccacctcccggtcgcggccctcgccggggctggctgggagccccaggctcccgctcacttttcccatcctccccacccccaccccgttcaccccacccccacggcgcctgctcctttcccagccaaccttcctcccctcccccacatccggtgttcgctaatctcgaggagcccggagcagccccgaaaaccgactgttcccccgaatcccgaagagagaactgacactagattgctttcttcggggcaacagtttctctagttgagcggaccctcactgcctaaatcaatcagactgagtgccgggcgctgaatttacctactctcattcctctccagggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaatagttaatttcagaattaagggaaattgatgtcgctatcatgaggcatcataaaaatatgtattttacaaggtgaaggcatttcaagtagatatagttcttgatgaagcaggaagaacatggatctgggatttggaagacctggcttctagctgctactaaccaactctgtgactctgggaaagggggactcagttcttacttctgtaacatgaggacactggactatttgaattcagaacttagaaaattggaagggaccttaaagccctctaagaaagagttcgggaatgttctccattgctgtcagttttcctccaaaaataacctggcttggaagttattggtccagtgggaatttgattccccatagaaactggagaaaaggtaatgcaagtagagaggaacagctgtatttctgcttgagtaataaacccactaacagattctggtacgaattgtggagacataaagagaatgagtgtatgtactctaagtgtaccagtttcttcactctctcctggcagaagatgcaacacttttagtgattctgggattctgggatgtgttcctattaattctaatacagatgaagaagatgtggtagaggaaaagatggtagcagaaggagtgaataaagaggcaaaacagcctgctaaaaagaaaagaaagaagggtttgcgaattaaggggaaaaggcgtcgaaaaaaattgattcttgccaaaaagtttagtaaggatttgggatctgggaggcctgttgcagatgcccctgctttgttagcttccaatgaccctgagcaggatgaagaaagtctttttgagagcaatatagaaaaacagatctatctacctagtactagagccaagacctccattgtgtggcacttctttcatgttgacccccagtacacctggcgggccatttgtaacctctgtgagaaaagcgtcagcaggggtaaaccaggtagccatcttggtacatctactcttcaacgacatctgcaagcaaggcattcacctcattggaccagggccaacaagtttggagttgctagtggagaggaggactttaccttggatgtgtctttatctccctcttctggaagcaatggaagctttgaatatattcctactgatccattagatgataatagaatgggcaagaagcatgataaatcagcatctgatgccctaagggcagaaagagggagatttctcatcaaaagtaacattgtcaagcatgctttaattcctggaactagagccaagacatctgccgtttggaattttttttacactgatcctcagcacatctcaagagctgtgtgtaatatatgtaaaagaagtgtgagccggggtaggccagggtcccacttagggacttcaacacttcaacgacacctgcaagccacacatcctatccattgggctgttgccaacaaagacagtggtgctgttgcaaatggattagatgaagctgagactgagagaagtgatctcttgagtgataccttgcatggagaaaagtctacaggcagccaagatttaacagctgaggaccttagtgactctgattcagatgaacctatgttagaggttgaaaacagatctgaaagtcctattcccgttgcagagcaaggcactctgatgcgtgcgcaggagagagaaacaacatgttgtggaaatccagtctcaagtcacataagtcaggcaattatccaaatgattgtggaggatatgcatccttacaactatttctcaaccccagcctttcagaggttcatgcagattgtggcccctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattttagaaagtgggcagtgctttgtgttacaggtttggctaaagactgtttgataaccaatattttacaagaattaaatgaccagattggtctgtggctttctccaaatttccttatccctagcttcattgtttctgacaattcctctaatgtggtacatgcaatcaaagatggtggttttacccatgtgccatgcttcctgcattgtttaaatatggtcattcaggactttttctgcgagcacaaaagcattgagaatatgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacacatctggggaaacctgaaatcacacaagggctgaaaattcctcagaggcaatataattttgataaaatgaagattaaagatttcatagctataactgtggcgctagcacttgaaaattttgcttataccaatgagagagaagatatttttaattaaaaaaaatatagtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacactatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggagttttttttcatgatcctttaactctcaagttcatctttaaatgaactctttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatggattgagtgttggttcgacctacaggcgtaatagattggaactcagtgaagacacagatgttcctgttcagagcaaccagctaatgtaagtggggaagcaggcatttttcgcatgaaaggagtgaacattcttgtcatttaaggcataattttcatggatcagtaagaaattaaaaggccattgttcagacatttttgcttgtacataattgtttacaaatttttagttttgggatggaaacatatttttttctttcttttctttttttcttttttggagacggagttttactcttgtcccctaggctggagtgcaatggtgccatcttggctcactgcaacctcctcctcccaggttcaagcagttctcctgcctcagcctcctgggtagctgggattacagatgtgcaccactacaccggataatttttg

SEQ ID NO: 57981 - DNA, 1070 bp, Homo sapiens
ttttttaagagatggggttttgccatgttgtccaggctggtctcgaactcctggactcaagcgatctgcccaccttggcctcccagagtgctgggattataggtatgagccactgcacccggcctatttcattattaaaacaagattgtgataacatttattgtgcattgttacctttaatacttttacatattataatacattctagaaatggaattgtcgaagggtatgtaaactttaaacatttgggtacatgtttagtacccatgttcagtgtcagactcttaatccaggttgttaacatcaaggtgacttttcatcatggcataccattcttgcattaggaattattagtgggagatatgactgaatttgatttaattgatttcaagttgtagatcactatttctgaaacctgatcttctggtatgtacgtttgtggaaaccctttccatattctcgtatgtgcttttgttatatgcttttgtagaagcttgcttggacgttttagtgtggagatcagggtatgccatggactaggggagaaaatatttgttgttttgtggaatcactattatggaaagccccaaagactacttttgcgtcttgtttgtaattggtgtacacctctagtcgtcttcattaacgtaagctagatcgatagaccttttcagaagtaattgttttcatcagttattctagctaaacagggttttctcacctagttatgattatatacttttggaataaaaatgcttgtgaaaatatttgaagtttttcatttagatgaaacattctactttatcatattttgttagcaagtattttgtgttagtaacctaagtcccattaataatctaaaatgtatgtagtcttttgagactttcaaattagtaggcaaaaatacatatatacatacatatatacatatatgtataatgtagatcaggctgggcgggatggctcacacctataatcccagcattttgggaggccaagtgaggaggattgcttgaggcaggagttcaagaccagactgaacaacatagcaagatcctgtctttacaaaa

SEQ ID NO: 57982 - DNA, 1050 bp, Homo sapiens
ttgcacaacagtagcgttttatttcagatattaccgttgcataaagtatgcagtggagcacagttatattgtatatatgttaattatatttaaattctatttactttctgattttccatcaaaagctagagttacacaaggcgagatgtcagttttgaagatgaactgtaaaatacatttttaaagaggacctaacactcctacttgtctttttcaactctttttttcagcttgtgtcactcatgccagatcaaacgaagggtactgtcaagaaataggttataggaaataatttgttgctctcggtttgttcctgtcattccatgtccattgttttttaccttaccagtcctttcttactcatttgtgcttgtctaaattccaggagctcttgttatggatattttacctaggatgtatttcaatgctacaaatagagtgttctctatttgtttacagggtgacagctgcccattccgtcactgtgaagctgcaataggaaatgaaactgtttgcacattatggcaagaagggcgctgttttcgacaggtgtgcaggtttcggcacatggagattgatgtaagttttttatttccgttatcataataagtagtctggagacctggtgggccaataaaaaatatagggacaaaagtgacttttaaaaaatatattaaggctgagtgcagtggctcatgcctgtagttccagcactttgggaggctgaggcgggtagatcatgaggtcaggagattgagaccatcctagccaacgtggtgaaaccccatctctactaaaaatacaaaaaattagctcagtgtggtggcatgtgcctgtaattccagctactcgggaggctgaggcaggaaaatcgctcgaaccagggagttggaggttgcagtgagctgagatcgcaccactgcactccagcctggtgacagagcaacactccgtctcaaaaaaaaaaatatatatatatacacacacacacacacacacacacacacacgtgtatatatacatatgtatatgtgtgtatatacacacacg

SEQ ID NO: 57983 - DNA, 1061 bp, Homo sapiens
ttaataatagatacatagtattacaaattatgagttcatatagatgcttccagttcatcaatgccacaggacttagtctagacttctccttttccatacctgtaactcttctccagaagtgagaaacttggttttcattgttcataatacttttatttatttgatcagtctactagtataaaaaccaatattgtgtcacagctttttccttcctctcaggctctgacatgacacacacagcttctccacaaggacacctttctcaccatgtttcaactctagtactctgtgctaagcctccctgcttgctttaccatagggacctctttctcaccctgcttggaccccaacatcctacttttgacccccaacacgatccctataatggatactgttttcacacctttgggctgtgatactttgtgctgagcggccctcacatgtgagatgctgtcctgaccctgcgcacatactccaactctgtaccaggttcccttgggaataccctgccttcctaaccccacttggtctttgatgccattctagactgaccctacatgagtatatattcttcatcctacattgtgatctcttctgcacagagacattgctaaccctgctcaggctcaacacttgtcagggtaccctttcatgcacatgtcctcttaaccctccaaccctccgtgggttccaacaccctatgccagttccacatggtcatgtggataccttcctattctcagtcagactccaataccctgctctgggccaccatgtccttcccttctcccatctgaatgcctgtctccctcaaccccatctaatgactttggactgaattgttagagtgagactaaatatgcagttcatgtgcctggggtcagctactccagtctggttttgtatttcttgtctcttaactacattctaagctacctatcttgcaaatagcagcagatatcaaataaattgataaaggagtactctgcaacttttatattttatgttataacatgaaaagtcaatgttgtaacatttttagtggagtgtatattggcaca

SEQ ID NO: 57984 - DNA, 1077 bp, Homo sapiens
tattaaaattaaaggtctagaatttgtgaacaggtactatgcttcttctagtcttctgttgattctgttttgagtgcccactttgtgtttatgtacagtggagagttagtggagagttaattaggtaaaagcacatcttttccctccctgggactttagaacttaaatgaggaaatttagtataaatgctcataagacaaatacactatagttttcataggtggtcaggaatttttggtaagttggggttgtatcttctgtttttaatttatgactgattttgtgcgtttagctgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatggtaagttctgtctggctccttctttaaggcaaataaatagggtctcatagtgaattgggcagaatcaggattaaagctataggcgtatttttaattgtgaatttgccttaaatgttgatatatagatcagttttctgaggaaggtgatgaaaccaaaacacctaccctgcaaccaactcctgaagttcacaatggattacgagtgacttctgtccggaaacctgcagtcaatataaagcaaggtaagaagaggctagattggtgcctcttatagcactgttgaaactacctttgaaatttagttcacaatcattgacctccctcttctttttcccatgctacacgcatacttacctatacttagtttctgttgatcatttattcaaaaataaatgcctgctatgtacagataaaatacaaagatgaaaaggctcccgttcctcataaaatttctatttgaattttcaggtgaatgtttgaattttggaataaaaactcttgaggaaattaagtcaaagaaaatgaaggaaaaatctaagaagcaaggtggtaagtcatcacgttttggcatggatagttgt

SEQ ID NO: 57985 - DNA, 1067 bp, Homo sapiens
gatcgggccactgcactctagcctgggcgacagagtgagactctgtctcaaaaaaaaaaaaaaaaaaaacaccaggtgtggtagtgtgcgcagtagtcccagctacttgggaggctgagacaggagaattgcttgaacccaggaggtggaagttgcaatgagccaagatggcaccactgcactccagcctgagtgacagagcaagagtctattattattatcaaaataataataataattagtactatgctattgcttctgtttaggctgtatgtttggctgtttattattaataggtttgggttttttttttttttttttgatataatggccttccttaagactgagacctgattttcaagagactttctgggtggatttacactaatatcagaacatactttgtacccattagtagttactgaatacagaaaaattgactaaggatagagaaattctgcttttgccatttcaggagaagaacccttggttagattgagtcttactgagagactggggaaacgaaaattttcagcaggtaagataagttttgtgtatatcttttcttttctacttgtttgtgcattaacatgatagcttctccaaactctttttatacagatctttgttattggtgcccctgtattggctgaaagcacttataaattcctcatgttttcatgagtgcattataccttttattgaagatacagagatttaaagtgttacaattgaactagattatgaccatgaccagcgttttggaaggaactagattttaaaaatggtaaagaacacctctatttctctgaacaaatttaaatgtgagtttttagaggcgagaaaaatgattggttaatataatgtgtgtctcttagaatacaggaatccctaagaagaaagaagaaagtatgtatatataaaatttgagtccttgagtctattggtgcttgcttatttatttatttatttagagacaagagtcttgttttgttacccaggctggagtgcagtggtgcaatctcagctcactgcaacctccacctcctggactcaagtgatcctcc

SEQ ID NO: 57986 - DNA, 1050 bp, Homo sapiens
acatttcaaagtttcagacagtgagagatgggaatgtattgttgaatcagttatgcactttacgctctaagtaataaaaaactttcagcgatgagataatgcccatgaatgaaattaatatttgctgtggctttgctgtatatcaaagaacattatgtaaattctcatcgaatccttggcaaccatgagtaaaccatgcacaatgcttggcacttgatatcagtaaatattttctgcactgagctcaaactcaggaagggttaaataacttgcctaaggttatagtcagatgaatacattacacgttatacagtcatttacgaaaaaagcttagaagagacagaaatgaggcagtctttagaaatctcttctagctgtaaatcaagaaacaataacagttctagattttaagagcagtattttatttttgtttatttatttatttacaatagcgcaaatccacttttactgacttttcattagcttaaacccttgtggtgtacagcgtcactcagattctgtgtccaatagcattagcaggaagattgctttggaatttggcatgaaccacaccactgtttccatgggcttgagttacctttccccagatgactctggttttgtttggtttgccaccaggagtcactgtgttgtcctttgctttgtatacataagcacatctcttgcccaaatagaattttgtttcatctggggcataaacaccttcaattttaagaaaagctatgtgctccctttttttccggagaccccacttatagccagcaaaaatgcccttggaccacagccttccagacatacttcctttaagaagtcctgttcccaggaggcctccacaggatccaagatggtggggagagctaagagcagtattttaatatctcagcatgtatttagagtacaaaccaaaccagggttccaaattaataggactttcagcttggataaagctgatctagaaattttaggtagaaaaaaataatactaagccaggtatggtggtgcatgcctgtcatcccagctgcgtgggca

SEQ ID NO: 57987 - DNA, 1043 bp, Homo sapiens
gactcattattgaatgtgaaatgtgcagcacagaccttggaaaaaaggggtaaaggcaagtatttctatactgtgtattgctttaggttatcaaaattaccaaattcaacccaattgttgccagtaacttcctggcaacaattgggttgaatttcatttgccttctatccacaggtagatagtaatatttctgatatttttatacagaggcaaaacgagatgaattcttttctcagaatttaaaattgctatttaaaaagctttgtgtaaaactttctatggtgcatctttcctctggtattgaataaaaacaaggaatagaggaatggtaacaaatttaagtggtattgtatctacatggtgaccacctgtagtgaccaccatgtgaccacaaattgcctttgaatcgttttcagtctctttttaaatgaattatttgtggtatttctagtactgaaggagttttgatattttattctgaattattccccatttaaaagagtctattctcactgcttatcagatattttctgccctttgtagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggtaagaagtatattcactttgtggtgctttattctgtgtggtaggaaagcaggaaagactaactctccactagcattctatcttgagtatatcacttcctggcatttcctagcattttagtaatttgggttactactgtattttatacttacagtttgatatttgtgaagtagcaggacaggattttttaaaagctaatttttaggtggcaagatattttgcttatttatatactcaacctttagattatcgattcttagattcacaggcttaaagaatcatagccacaattctaagaaggcagcaaaagaaaatgaatatgctcaaattaaa

SEQ ID NO: 57988 - DNA, 1467 bp, Homo sapiens
ggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcat

SEQ ID NO: 57989 - DNA, 1136 bp, Homo sapiens
gtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcaggtgcggagtgaaaacgggagttaacggttttgggaaactccagggggatgaaagtggaatggatgttctttagtctttagaagacccgtaacgaatgcccagctgggcacttgttgtttgcgtaagcaccagacctcgcgtttagtaaacaaaggtgagacgggaatagcgtcgtccggttgtttcaggaagcagagtctatgctgcttttgtattttttccttagccactgtggtgcagaacctcatcttcagatacttacaaaatgtacgtaagttgcttgtttcgtaactactttttaaataagaggtgaactgatttagttttttgtgttaacctgagcgatcgctgtgttctagaatttaaaaatagatgtaactggagattggagggtaattgaggggaaggagtacttagaaagcactaatgtgatgaagtggtgtgtatccatgccacttcccaacatgcaaagaattgtatccattactttgcaagatcaaaaatactttttaattccaaaaagtattattagcagacttgaccatggtatttgggcatcagtagttttgttagtagtgattatggctagaacattggaacctctcccctttaggatgaaacattggaagaaaaacccagccaacttaaaccatgtcaagaggtggtgtgtttaatacctgtgggaaaacttaaagacgaaaaaaggaagagagaaggggtagcttcagaggagtttagtggcagctgctttcctttgagggaaattttagcaacttaaattttatagtgtgataacacaactgaaaaacattaatttcaggtgataataattcttaaccacctgaattga

SEQ ID NO: 57990 - DNA, 1035 bp, Homo sapiens
catgatgaaaccctgtttctaccaaaaatacaaaaagtagccaggcatggtggtgcgccctgtagttccagctacttggggggagctgaggcagaagaattgcttgaacccaggaggtccagctgcagtaagccgaggttgcaccactgcactctagcctggaagacaaagtgagatcctttctcaaaaaaaaaaaaaaaaaaaaaaaaactttgggtggaaggtggggtggggcttgagaagagtgaatctttgaagttagttggagtttttatctgcataggtatactcatttaaaatggtttgaatgtgattttctttgaagataacagtttgtttatttttctagggttttgatgagtatatgaaccttgtattagatgatgcagaagagattcattctaaaacaaagtcaagaaaacaactgggtaaggatagaagtggtcttacagaattctagaaatattttattcacttgcagaattcagtgacctgcaactcagttcatgtttgaatttattttgcatttgagaagttattattcagagtagtagtacacttttgaaatcatcctctactactcactcctcaccacactccattttggcttctccacccagagagctctcaccaagggaaccaaagactagtggtattaaatctaatgatcagtactaatcctcattttattaaactctcaacagcatttggcactgttggctgctccctccttaaagcgctttgttcccgtgtctgagtggcaggaaaaacccaagtagatttttctgtttcctcagttgacaataattaacacagaagacttctgtgaccagatgtatgggcatatttccccacacaccaagcaagcaatcagttcggcagtggacatcagctcagagtcgtcaagttcagttcagttctaacactatctacctgagatagcgtcagttcccagaggttgagggctcaatccccaagattgccttccatgcccctcagtcctccaccagatgctaattgtcagctccagattgt

SEQ ID NO: 57991 - DNA, 1140 bp, Homo sapiens
tgcttcaccgtaagtgtatgagtcatgccttttttgatcccagtgtgctcagtacctaactcaatgcctggcacataatagaaactaaaaaatatttgaacaatgaatggtatttctttcttttgtttttggagacagagtctctgtcgctcaggctggagtgtaatgacgtgattttggctcactgcaacctctgcctcccaggttcaagcaattctcctgccttagactcccaagtagctgggactacaggcgtgtaccaccacgcctggctgattttttgtgttttagtagagacggggtttcactgtgttgcccaggctggtctctaacttctgagctcaggcaatccacctgcctcggcctcccaaatgctgggattacatgtgtgagccactaagcctggcaatgaatggtatttcttaacccagttaatgaatggtcttaggattcacggtttcatcaagacacactgaatcatttctgttaacatcccattcacttgaggtttatttaggcattttgtctttatttgttaaatgctcactaatacttttatcagtggtgggtttcaggtgtctctctttcagaccctcaggattctcttcaacctgaactagatatatggaaagtagattctgagaagcagtatggtgtttcgctggctgcttcctgcttagactatttttatgaaagcctgggttttttagatttattgttatttatttatttatttttttggagacggagtctcactctgtctcccaggcttgagtgccatggcacaatctcagctcactgcaacctccacctcctgggttcaagcgattctcctgcctcagcctcccaagtaactgggattacagggcatgccaccacacctggctaattttttgtattttagtagaagacggggtgtcaccgtgttgtccaggctggtctcgaatcctaagctcaggcattccacccaccttggcctcccaaagtgctgggattataggtgtgagccaccatacccagccgggttttttagatttaaagatgtcttgccaggacgggcaagcttagccttactgaggtcatattattcataaattatttaccaactgttgaattcccatggtagtatttatcctgtag

SEQ ID NO: 57992 - DNA, 1788 bp, Homo sapiens
catcttggctcactgcaacctccgcctcccggattcaagcaattctcctgcctcagcctcccaagtagctgggattacaggcacgcgccaccaggctctgctaattttgtatttttagtagagatagggtggagtctttaatatactaacagctttaagaatggagttataatatgctgtatttcccaaacttgacatacgactcatttccaaacttttattacaaattcagcattgggaaatgttgtatgaggcctattgagttgacttagtccatagaaatgatatttgtcatgaaatgtcatctacctatgttagtctcttgaaaagataaatgtattctaatggagccagaaagcctttcactatatggacacttgaaaatgttcacatatttttataagaaagcattttcaaaatattgttcaaaaactggatacaaaattctgagagtaaaacatctgagtgtgtggctattaatagctttttgttgtttttgtgttgcaggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgctggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatatgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggccatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaacattt

SEQ ID NO: 57993 - DNA, 1051 bp, Homo sapiens
ctcactcctggcaagagcacattgtggtgctgtcagggaggacctccatggtctcagatggaacagcagcagtggtcagacctcctagaggctgtgaggtgaggaggaagtggctgaggtttcccctgcctcctcctaaggtcatccatgggcaaaccaaagctgcaggatgtgctgtgtgtgtggcctggtatctcagagtcctgggtgtgcacagggtgtgcacagctaggagacgtcccgagatctgtacccacatgttgagggcttcagccaggggtgttttttgggggagcggaatttgtgtggcatagtagaggaaaagaaggaagaagtggggacagtatctccagctgccacctttcttcccaaatagctttggatacccaggcccttttggtcacaggaagtctgacactgggaagtcatcaaatttggaattcagttccctccactctccccccagcggtggccttagcatttaaatagccttggcatgaagccctataaactgcccaagggattggggcagggttagggggaggggtattggtgttacccccaacattgtccccctgtgtcttctggggacatgtccaagctagggtgtcagtgttttggcttgagaggagagaggggaaggggccacagactgggcaggagccctcctggctcccctcccgctctggtggttttgatcgtaatccctgcctgccaagcctggagctccctgggggatccgccccagaggaggcccgactgttctcctcccctctgccttacctcccccagtccccgccccctgcttgactcagaatggaatgtgcagcctgtggaacaagatggggtgagaactagttcccagagggccttggtcccgcccctcccatcccccaacaaagggggtgaggaacctggaggcagggcctgctcccaggtatggctggtgtttccctgatgcagactcaggtcctgtgctgagttggtgcagaggcaggcaggtgctgtgggggtccaggactagccatttgaaggttttcatataagtcca

SEQ ID NO: 57994 - DNA, 1093 bp, Homo sapiens
caggtgtctcaggagctctgtagacacaaagggcctcttgtctcctcctccctggcctcagggagccagccccttcctccctcctctcaggccccgcccagagatcagtgaccaggtcagccaggggatgctgtcttccagattcacccccttgcctctcagggtttgttgttgcttgagacagaggtgagactagaccatgtgggggtgaggtgcattagcctgagaggtaggaaatctgcctctgagcgaatccaccagccctgaggtctctgtgtgtttcagtttccctgctggaaagacagcaagatctctcccactgggacacccaaacatgaaatggatgggagatgggaaaagcatctggagatttggggaagaaagacgtggtgaatgtcaggagtgatggaagctaagatgagacttaagggattccaggtgggatttagggcaggaggtggccagggtgtggcaaccctccttcctccttacctatttctaaagcagacctttacagagcacctactgtgtgccagccactgcactagggactggggaggacatggagaataatatagtaccagcacagacagacaggcagcttctggagccagactgtctgtgtgatcttgggtaagtaatctagcctaaccatagagatgataacaattgtacctgccacaggctcatggggctattgtgatggtgaaatgtaaagatgtaaagtatagagaaaggatgtaaaactgcccgacatatagtaagggccatttaaaagatgcctgttattgtccctcttcttgagagcatattaagggctcaaatctagccagagtctggcgggtacagaggtaaacaaataatggcaggttggttaagtactggacaccagtgatgtccaaggtctctaggatgccctggagaaataatgaactcttctaagattgtttggaagggatttataaaggacatctaggctgggttttgagtgaggtatgggagttcgctggtcaagaatgtaggaattacaaaagcagaaagtgcatatttaaaaaaaaaaaaaagatccaggcctggtggctcacccctgtaa

SEQ ID NO: 57995 - DNA, 1024 bp, Homo sapiens
gtccagagggtgggaggaatcaatttccctctcagcgattgtgaccagggaggcatttctttctctgcttggccttgcaggaaacagtgttgagaatgagaggagcagaaaggaagagctaggccttgtattaatttgtttttcagattgagtctctgttactagcaatttattacatccgggtctccagccaagcacattctgttctccagtgttgggggaagatgcatgggggggtggggaagaggctggacaggaaagaggagcagatcaacaattttatgactgagtgtgtggtgtcttggcgtgcgctagaggacggttttagcacagggcattttgagcccagccccgtgtggggaggcactcctctggacagcatggcattcccatgcgagcccagacagccctggggagcaggatgaatgggcttccctcccactctcatgcccgccggcctcagggtccagatttctctctgtgaaatgaggtcaggacagtgatgcctggaacaaaatcatagtttcttgaggcagcggggcctggggagatccctccgaggaacaggggagcagctgtgtgaggggaccccggaagaggggtagcaggcaaggcggccaccctgtggaaagaatggtgcacaagcaaaacaaccccctctctgcaaaagtgctgagctggtggaatttcacttggcggctgtgagatcagggcagtagatagagccctgcgggcaccagggctgtgtgggtgcagggggtcccggaagagagggcaggggcagcacctgtggcaccctctcccctgagctggcctccacattgcccagggctcatcactggtccccattcctggaggtgcgtcccttatctctatccacctgtcacgtaagttggtctcattcttcccattttccctcattctcttcccaactgtggctttgactagaagtagctacatcatctagtcttcaaggggccagcattgcgtagagggccatggtgccagagggcagggaactctg

SEQ ID NO: 57996 - DNA, 1038 bp, Homo sapiens
tctccaggcggggagggcatcaggagtaaacctccttccacggccctgagccgtacagtaagtctcccagggttgtacggcaaggcaggggcagagctgttctgtaaacaggcgtcagttcagttgccttgaaaccgccaactctaagatggacatccgaggggaaaggatttccaggaaagtcgaggaactgattttaggggaagactaaatctctttctctatccccatcttcttgtcgtctgggtcccttgaactccctgctgagaaatcctaaatacaccttgtctctgggttgcgcatggaagcctttaattgtttctagaggcagtgagggaaggccttctagttggtcgggcaggtctggcactgtctgggtcttgctgcttctagacacttcaattagggatgttaattatggccttgtgaacacaggctctcccaaggcagccgctctccagccctgctgcccccatgttgtcccctcaccagtcagtgaggctatgtttatggtctcgcctctgtccatctgcagattaaagatgccctgaaagcataacttattagcagttttttgttctctccatcttttaaaaaattggattaaagtagacataatgtaaaatttacaatttgtaaatgtgtagttcagaggcattaagtccattcacattgttttgcaaccatcaccaccatctgtccatggaactttttcatcttcccaaactgaaactctgttcccattaagcaatagcgtccccttcctctctcactccagccctgtaactctattctactttctgtctctatgaatttagctgttctaagtacctcacataagtagacacatacaatatttgaccttttatgcctggcttatttcagttaacataatgtcttcaatatttgtctacatcgtagatgtgtcaagattgccttccagcttagggctgatgatattccattgcatgtatatatcatactttgttgattcattcatccattgatggacacttgagttgtttcccattttggttg

SEQ ID NO: 57997 - DNA, 1071 bp, Homo sapiens
gccacacatctagtggtatataatagagccagtcttcagacacaggtccatgtgacaaagtcctttttccattagccacaccaggatgcctcccagcaatgctgggtcatcacacccacccacctgcctccggaagagctgggctggctggggaggagaatagggtgtgagtccttctcccccttgccctgggggcagggagggagagggactccttcctgctttagggctctttctccttacctccttccctgaacatatattctgtaccagattctgtaattataccttatctcttactcacaaaatagttcttggaatctctattttacacatgaagaaatgggggttttgagaggtgaagtctttcccccaacttgccagagctgcctgggtttcttttgactaagttttccttggctatgactcaagtcagaaacaactgcaatcctgtaagaggtgaagacagtggccattctatctctgctggaccagagcctgttattttgcaccgaggagagtggccagggcatcagctgataaatgaaaggatgtggatttagacatcagcgaggcctgagttcaaatgctacttctgctgggccctcagtaggacgttctagcccccgagccttagtctttgtagtgttcttgtgaggattaagcaggaatgtgaatgaagagcctttcacttagtgcttgcagccaagtaagtgctgtagcattgcatgcttgctttttgcctcccattcctttggtcagtattcagggctatcccccaaggggcctttgacatggccagtcagcctcagctgcacaatttctgcatctcccagccctaggctgggcactgtccctgcaggaagccagatgtgctcacctgtccaggacacaggcttggccttgccattgggaaacaaggatgaggcctacccctgccttctagcactgttggggtgcaggagaacctggagacaggcttgggttctagaggcaggaaggcctccagagaagggcctcctagagacactgttgacctcttctcggtttgggaccttctggaggcacaca

SEQ ID NO: 57998 - DNA, 1096 bp, Homo sapiens
tgggagcctcaatggcgctttcaagcagtcccatctgtctctttctcgacccactcactgggttgggagaagactcaggtgcctctgaggcctgaggaccaggtgggaacatcacagctacagtctctccctggccactgttttcctttgtgcccttgggccagggtcagctgagtcccggcagccacagaagctcaggctggactgtgattctgtacctgaggtgctgtggggaagtgcctcttctcccatgcttgggagttgacccagcctctgtctgatgttggccactctaccaggtgaatgccaccctgaccagcctggaaacagccgagggagtgttggctgtggcccccctgagctgggctagaccagaccggccgtgccctggatctgataccccccagggctcacagaggctggaaagggtgagagggactcgcaggaaagctttgtcccaagcctgcagccagtccagctcccagctctgagtaaacattagagataggatcgggtgtagccaggaagggtggcagggtgtggtctgtgagaagaatggcaggatgtggcaccggggcactgttctgggcacccacgccttggcctattgtttagggcagcctgaggttctcagctctctgggggctttcagaggaagtggcattcccctgggactcaagccctgccccacccctgctgcatggatctctttccctggtgatgccccttggcaccacccactcagagcaagcttgggagtgggagccagcagtggagggggattagtgtgtgcccagcggggaagtgtagccattggccctctcagagggtctgcctgtctgttcaggcttcctgtaccccagggtctgagtcacccgtcatgctacgatgactggaatttatctctatctttatcttcatctagatattttttgtagggtgggggaaggctgtcgttgtggagggaggaaggactgacagtaaaaactcctttgattccaatccaacagggtcagttgttgactggttagaagaggaagtggctggtgatttgttttgggcagaaaggggctaggtttgtgtgcgcctgtgggtt

SEQ ID NO: 57999 - DNA, 1061 bp, Homo sapiens
ccatcttgtggtgctgggacctcgtcaagcagggtgtctgctgttctgtgctcatccaggacttttctccttgctgccttttccatagtggagtatccgctgcagctgctgcacagcccccctgccccagtggtgaagaggcctggggccatggccacccaccaccccctgcaggtaccgccctctacccactggcctggggctccctctcgagcttatgacggccggctgccgtgttagggaactgcggggtgtggactggtgagccctggcatcctgtgttcttgttcacccgctccttctgcgtccacttttctgtctgtctccttgtgtgttctgggtatgctcacctcacttcctctctgtcctgctgtgggagtgtcctttggtgtctgtcatcctctgacctgctgggtctccctcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggtaagcctcctgctgcctgcacttgtccctcagccctcttaggggagagccggcggcatgatgcgaccttgagcaggtcccttctcctccctgggttccagattttatcaaatgaggggttagacttgctcttagcagaagatccccttcttcctctccctcatcatatctgtctgggcattccaagcatcagggattcaggccagagtcacatagttccagggggtactgttgtcatttctagtctattgacatgcacaataactagccagtgtaagtggcatatccctgaggacatgcaatgcagccgccctgtggaagaacaggagggaacactaactcaggtgcctcatgggagtggcatggcgggaagctgatggagtttgggctcatgctgggctgatgccctcagcttctctcgcttctcttccctctcttctgccctctcccacaggcttccttggtgaagggga

SEQ ID NO: 58000 - DNA, 1039 bp, Homo sapiens
cctggggatcaaggtcttctcaggtcctgcatggggctgggggtggtcagcagagcccagcactgactgcctgcccctggggggttgggtcaggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatcccgtgagcaggcccccccgcaggcagccaggagactgtgtgtacatgtgtagctctcatgagtggctgggtgtcagtgtgtggcctgcctttgtgtgtgaccccaggggtgctgtgtgtatgcgtacgtgtgtgtgttatctgtgtatagctgagcctgcacgtgcgacccgactgtgtatggctatgtatgtgactgtggtgagcactcagtggctgaggatgtaggaatgtgactggaggactggccacgtggacctggagaaagtgcctgtagatcccacggccgataaactcaatagaaattcagaggtgctagaaatcaaagtattcatcacacagaaaggttcctgacttgactaaagcaagcaccctagtctattcctttaaacaggacatctcccagggcatttaaaatatacaatttctgcctggtatagtgacacacgcctgtaatgccaacactttgggaggctgaggcaggaggatcccttgagctcaggagtttgagaccagcctgggcaacatagtgaaacctcatctttaaataaaattagccaggtgtggtggttcacacctgtagtcccagctactcaggaggctgaggcaggctcaggaggatcacttgagcctgggaggctgacgctgcagtcagctgtgattgtaccactgttctccagcatgggtgacagagcatgaccctgtctctaaatataagtaaacaaaacataa

SEQ ID NO: 58001 - DNA, 1062 bp, Homo sapiens
gctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaag

SEQ ID NO: 58002 - DNA, 1060 bp, Homo sapiens
gccacaaagcaagcatgctcttcattgaaggctttaatgttcctttgacagtgtaggagtgagctaaagaagctcttagtttgctttctcatgtgagccgatggtctgtttgtgagatgagaggttagaccagaccgtctctctgatcccttctacctgtgacatggtcagctgctggggtgagaggggggtgcataccaggacatacctctgcctcctcaagagagctccattgctccagctccctgccagggcactactcttcctcctggggaggatctttgtgggagtcagctcgacttagggagctgcaccgcctcctggggagttttcccagcatcctaagatcaggtctgttttgcatctctccccactgctcctgttgcccttgttcttagtctggaatccccaggtctggacactcgttctcacctgccttgtcctttccctgtgtctccttccttaccctcctgttcctttcacaaagtagcagggatgccctcagtcagtgacttttatgctctgcctcatgctttgacgcccatgtctttatcagcttcctagcataaccagaggagtcagaaggacaggacgcctcagtgccattttacagatgataaaagtgagggtctaagagattggccatttttccaaggccccctgcagtaagacagagggagtgatgaggctcagattcagggctcttgaggccaagcacctgtctatcagccctcctttcactggctaccttttttgccactgcccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtatggcttctctggccctggggcagcagcagggttttggttggttggttagctggcttcacggagctgttcttccggctggcacttggacaagcaaaagttagaccttgatttaggtcttaagttaatttgtaggagggaagggggaaa

SEQ ID NO: 58003 - DNA, 1095 bp, Homo sapiens
ccaagctaccatttttttcttgaactctatagagactggagactcccaaggttggggacagagaggagcatgagtgactgggctaaagcactgggggcttggggtggttgtgctcggcattcaaatgagcacctcctgctggagctacagagcccaggagagagaccagagagatcctgccccacccacccacccacgcactgtcctctccccatgctagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggtgaggagggtgccagggcctctgtctctactattcttcaggccttgggcttggaaatccttggcatgtggggtccatggtggagagttgtaagatctgtgagttccctgaaattgcatgaaaaatgcatgtttatatgcattgctctgcagagaggggctatcgctttctgtagattttaagggtgagttctgggggaggaaaggaagaattgtgatgaacatgggagcagaggacctggttccctaagtgcggcagagatctgcttcctggcatcatgcctcaaacctctgcccactccaagtctgacctggaaacatctcagagccttagaaatgaaatctgagccagatccccagggcactcagggttttctacctctgtctctgtttgtcaaggaaaatgggccctatccagggtaagcatggttttaccagcccagggagatgctatctcttctgccagtctgaactccttcctggctccttgacgaagtgggaacccaggtttggggaactgtcaaggcctcctttcaaaggctcacaagaacctgtggctcctggggagcccctcccagtaaatgcttggatgtgtagggcccaggaactggacttt

SEQ ID NO: 58004 - DNA, 1051 bp, Homo sapiens
tatatatatatatatatatatatataaaaaatgaactactactcagtcacaaaaaggaatgaaataatggcattcgcagcaacctggatggaattggagatcattattctaagtgaagtgactccggaatggaaaagcaaacatcatatgttttcactcacaagtgggagctaagcaatgaggatgcaaaggcataagaatgatacaatagactttggggactcatgggaaagggtaggaggggctgaaggatacaagactacacattgggtacaatgtacactgctcgggtgatgggtgcaccaaaatctcagaaatcacactaaagaacttattcatgtaaccaaccacctgttccccaaaaacctattgaaataaacaagcaaacaaaaaattctcctaaacagccaacatacagccatcaaaattgggacactaacattgatatgtgactatcctccaaccctcagactccatttaagtttcatcagttactccagtagcatcatttatagcaaaataatccagttcatcattctgtgtggtatttaatgatcatgtctctttaaactcttctgtctggaacagctccttggtctttccttggcatgaccttgacacttttgaagattcaggccacttattctgtagccatccctccatttgggtttgtcggatgtttcctcacgactagcttcaggttatgcatcttaggcagaaatagcacaagatgtgatgctgtatttttctcactgcatcctggtaggtggtgcaagatgtcaatttgccccatagctgataatgtttctttattcttaaggcagtatctgccaggcccctcaccaccccatccctgaccctgcaggggatgctttgcctatgatactttgtaccaggccacccctagtgtgaacacccttctcaccctgctggggttctaacaccccactctgggcaccgccttctctgtgttaaacctaatggctttaagactgaattgttcaggaagaggaaggagggaaataaggagagaaagagcctcattcacttt

SEQ ID NO: 58005 - DNA, 1099 bp, Homo sapiens
tttgcaggatgaggcttctttttcctgggaaggttggctggagtccttgctcctctgtgcagcactcttctcactccatttcttttttctccagtgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgac

SEQ ID NO: 58006 - DNA, 1051 bp, Homo sapiens
ccaccattccagtagcccaggcaagaaccaggccatgagcaggttagaaccgtggctcagaacatagtggaagggatggcgtttcatgttggtgattgaggaggttcaaattctggtgctctgaggctccatttcctcatctgtgaaattcaaatcaaaattcctgcctccagtgctggtggtatgaggattggaaacaatgtgtgccaaacacctagcacagtgcctggcattcagtaagtgctcaatacatgctcgcgtgccgtagtagtggtgacagtagcagtagcgctgtgttgctggtagtagtagttgaaatagcaatagatgaagtagaaatagaaaccatttgtcattttgctaattattttaaatatggatattttcagaaaccagattttagctacagaaaagaggatttaagtaagccttaatgaagaaccttctgccagttagggtgtaatggactttagaatgggtgtccagggagagccttggaggtatttcagggagaggctgtctttaggctggagttgagggtaagagaagggatagcttcagagagccccatcctgcagccaaaaggcagcaaaaccagtctggccacaaggaagcaggcctctgttgaacctccctgtagtttagctgcaaaatgaacttgaaccttccaaagatcagattccacatgctctgggcaaaaggcaacttcctgtttcaaggggttagagagacaaggctggtttaaaaaccttgctcagccccagccccagcccctggcgctctctactatagttcctcagccaaaggtcccatgaaaacaaaacccacccggcctatccgatttccgtcttgatacacatgggcttacatgtcagggtctgtgtgctgaaaccaaacggtcaccttgcttttgccaaaaccccaactatttaaaaaagggctgtggcagggccagacctcagactcagcccactgttcccaccgcccctggcctgtggcccagctccccagagctacagctctgccaggcacagcaagactggtcctgggc

SEQ ID NO: 58007 - DNA, 1011 bp, Homo sapiens
attcttcaactgtaccatgggagcagtggctcagatgatggctgaggtctcttctagtctcatgtttttgtgagcccacacactaagtgcccttttcatttccctagaatcctggtaccaaggcccgcctggttctgtttgctcatgtcttgggtaggattccctacaggatcctcagagaccccccaccggccattccttgaatctggctcacagcaagtctgtggttcttagtgccagccaagacaaatggtcaggttgaggggcctcctaggggccatgagcaatcattcctcaagatggcccatcattgaccagtcttaaagtgcacgaatgggaggctccagtgcattcctgtccgcctcccaggcggcacacatagaatttccttgttccttgtatctgcaagggtttgagcttcaaccattaaaaaacaaagaaacatcactgggggccaagttcctgacagccatactaacatcaaccatcttctcaccctttctccccagcccaaggcaaactatgaacaaagcaagaaagacccccaccagacattgcccctggacacccccagagacatcagccttgtgcccaccaggcaagaggtagaggcagagaagcaggcagctctcaacaaaggtactttctgtcccatcttcccctagaagtaaggcaaggatgctcagggaggagccctgggtgctcattcacacccaaaacctggtgccacaccctgggctttttaatctcggtggagagtggggctgagattgtctctgagaaggaggcttcctgccttcctgctctccatgaggcccactggctactctgtctttctgcagttggcgttgtgccccctcggacaaaatcgcccactgatgatgaggtgaccccatcagcagtggtaagaaggaatgccagtgggctcaccaatggactctcctcccaggtgggtacctctgcaagctcatgcaggcctgagctgggctgcgagcccaggggcctgtgtgt

SEQ ID NO: 58008 - DNA, 1368 bp, Homo sapiens
gagggagactccatctcaaaaaataataataaaaaataaaagaaagaggctgggcgtggtggctcacgcctgtaatcccagaactttgggtggctgaggtgggtggatcacgaggtcaggagatcaagaccatcctggctaacacagtgaaaccctgtctctactaaaaaatacaaaaaattagccgggcgtggtggctggtgcctgtagtcccagctactccggaggctgagccaggagaatggcgtgaacccatgaggcggagcttgcagtgagccgagattgcgccactgcacttcagcctgggtgacagagccagactccatctcaaaaaaataataataataaaagaaaaaagaaaaataaaataaagatacgcacatgtgctcaaaggcttcactcagggagcccagcatcctatggaccaagaccaattcataggaacatgacggcatatgtctcaacattaagccacatggttcagactgtaaacgccctgatgttccaacagacagtggggcctaaaccaggccacagagcagcaagacagggagaggaacaagggaaaggcattctaggcaggagagtgggtggaagcaaaagggtgggagaggagctgcctggcatgggggcgaggcaatgagagagctttggggaaaacttggggagcagtggggagtggtggacaggtagaggctgggtcaaggaaggccttgaaggtcaggcagagagttggcttcagagctggcactctcttcaggccacgggtgggagtgcagtggtcccaggggcccacccaggtctccagcaatgttgttgtctgcctcctgctaacgctcttttctcctgctctcacagtggctgctcttgttcctcctaatgctctggcttctgtctgcctcaggaacctggcccgcctcggcctcccctccccaaagcctacgtccccctggagtctcctccagccgtccctccactccctagcgagagccgcttctggccctaccccagctccccttcctggcaccgcagtggcgagacagccagggggcaggtacccatcacccttgggtcctggagggtggggcaggggacaatgggcaaagggccaggccaaggggcaaggcagggccctggagtcattttccccattaattttcccaaaggtcggtttctacggcacccctgcccagctggactctgggataaggaaaggatagttgaagccatcatacaggccatctttctgtgcctttttgctttctgtaggtgatggggacatgagttactgctccaaccccaggctcatgggcagccagtgtttgtgggtgctggtattaagccccactccctaccaacatgaccagc

SEQ ID NO: 58009 - DNA, 2010 bp, Homo sapiens
gcagaatccttttccagaaagcctgttgctgactcatttccataacagtaccaggaggccagagtggaggagggctgggcaggctggaggctaggcggctgctccttcccctctctgtctgattctcactctgccagtgtccacagcatataagctttgcccacagcaaacacacgcacccagaaacaaccgatttttccagaaaactcagaaacagctgctaacaagtgctgcctaaattgctctgatgacactcacctctcccagggaggcctaggcagacctaggagagatggcactggggtctgcgtgtgcccctcctctcctggagtgtccagtagagaactactttgcctgcccacatcctcaacccctcccttcctgagaactcctcaagggcagagggagaagcctctccttgtccttgtcgctaactcttaactgctttgcttctttttttattgttttcttttgtgtgttcctgtttgtttgtgttgctgtttggcctctgggcctcgggctccgggtaggatgaacttttagatcttcagttgcaaagaaacctagagtatttggatcagcaggtaggcagagctggtgccccccttatcatcccactgccttcctgtcgcatctctccactcctccccacctcctcatcttccagccatttgacaacctttgttggtgcaagcaggacacaacaaagtggcttatgttttggtttgcgcctacacaccccttctcttcaaagccctttaggacagctgggagtttcctggggaaagaagcataataagtaggcacatgaataattaatgccacctcttatttctccagtgctcagctcagatggaactgcccccagggggcaggtgggaatttgcattttttctggcgagaggagggagtcgcagagtcgagggagctctaggctgggcctaaaatgctagggatttagttcagcctgaatctgggaaatcatcttatcatattttacaggttgttgttaaactccataattggtaaactgaggcctgcagaccctccctaggatgatttttaaagtaatattcactcagtgtattcattagttcctccaaaagcccttttgcataaacagctcgtgcattcctgagaattcagtgcaaacagagggagtattatcaacccagttttacaggtgagcaagctgaagaggcagtgaatgttccatgagctgcaagcagtggctgcctggtctctgctccggggttctaaccctttcttgtcttttaagctaagggagctgtgagactgagtttagacaggctgggggtcaatatgctgggtatttatataagcacatactcttaagtttagatctgtgctacaaaccacgacctagaagtacacaacactgtcctgtggaggcagcctggaggggtggaaataataataataataacaacagctacaataattggatgcctcctccatgccccatactattctaagcatttttcagatcttaactcatttaatcttcactataaccctgtaagatggatgctattattacccccattttacagctgaggaaactaaagcacagagaggttgaataacatgccaagaacacacagccagtgaacagccgagcttggacagtgactccaagcttctgacccagtttacagctgaggaaacatctaatgtgtgacaaagctgctgtcaaacctcattaggatgagttcatgctcttaaagttacagaaaaaaaaaattttaaatgagatgctatagctgcaactgttggttcttctagtcacaagccatgtgacccatctcaccagggcttcatgtcggtgtcgcaattcgattttgtaataggcctcaggcactaggaagcaccaatgtccacagttcaataaacagggatggctcctggccctggaggccgtggcattccagctccagaagcagctcattgtgtccacaccatgagcattctgggccatgtgggaacaga

SEQ ID NO: 58010 - DNA, 1030 bp, Homo sapiens
ctaccaccacccaaggagagtgccctcctggttctccagagccagagccaggaggagggagaactgctagagactctgccaccaatcactctgcatctctgccacagccttacgagttggaccagaggacttacttctcagaggcatggtaggatcagggtggccggcgggtcctctgaggctgccaaactggggacggagctgccaaaaagatgttgaagtttcgggctgatcgacgggtcaggtagggatgtcttccacggatcatgagccaagtcaagtcagagcaagctgagttggcagctcatcctgcttggatccgggggcttcagagtgaggggtctgcttgagatgacctggagaaggaagcatagttaggtcaatggttgctgcattgcagtgcttgtgaaggggaagctattttgaaattggtagtgccgggatagaatgaggacgtcatttgtaggggttgctgggtaggaaagtctggggctgggagagatgtgccattccctagaagtcttgtgatggttggcagcagactgtgtgtgtatgcttctgtgtgtgtgtgtgtgtgtgtgtgtgtgtgtgtgtgtgtgtgtctgtgccagtgcctgcagggaagattccagcagttaccattgggaacacacagagcagaaggagactggagggtcagggcagggggcgggtgccctgcaccactgagaaaaagcagacaacttgacacctcaaaggacaccgtagttgccacagactgcttgccccccagaccaccagatgggacagatttaggggcagacaagagtaacgggaaacagttgcccttccttgcaaagatcccctgtgattaaattgaggagtgtgtccttgttggacctgggagggaggtgggaataaagtttgggaagtggggagtggattatcaacgtgctagactcagaacccaggcctggtggacacgcgcctggtttttgggtcctggctggcaagcctgggctgcgaagcccagatttccacatagactgta

SEQ ID NO: 58011 - DNA, 1006 bp, Homo sapiens
cacccacccccgccaggttctgtcttaccctacatctcaccacacctgactctgctaagtaaaaggataaaaccaggagcacagccatgccagtctcctgtggctctgtcccctccaccttcctcccgtggccccatccaggaaatcggcccacaagagaggccgacgctgcttctgaccagagctaccgagcgcctctctggagacaatggctcagagagaaggaggaagactagcagctccagctttgtgctcagggtggccacacaaaaccattgtcttgacatcaggacagacaatggtttgtatctctggcttctgcgctgagcagttcactcccttggactaagataattttaaagatttccttctaataaatagtaatgatactggaatctggcctcaagctgagaatttgtatctggttgtaacaaaagcccactctggctgatagaatgggtatatctaggcttccttttctgttccagagccacccagacaaacatagaccagacagataaccacttactcaccggctcttctttgctgttccctctgctgcctctagccctgactcctttcacactgaggagtagggagaaggttttcctttaatactcaccaggtccctggtgggtagcaatcattaacagccacacatgctggctggccttaaccccttcagtgctgggttgcctcagccagccggagctggctgatggacagccctgtcccttctactctgccctgagaaagtagcaactcccaccttgatgccatccacctgagtaatgctgccgcctcccatgtggagaaggagagccctctagtcccacccaggccgccccgcctgattggagcacacttgcaacctgaggcgtttggctctggcacgatgcccaattggatgagcccacattatgaaatatttgcctggcgggccaatagaggaactgggatctgggggagggatgatattgttatttattcctggaggaaggagagc

SEQ ID NO: 58012 - DNA, 1051 bp, Homo sapiens
atctctactgaaaatacaaaaattaactgggtgtggtggcacatgcctgtagtcccagctacttgggaggctgaggcaggataatcgcttgaacttgggaggcagaggttgcaatgagccaagatcgcgccactgcactgcagcctgggtgacagagcaagactccatctcaaagaaaaaaaaaaagtctgattactgagtttttggatgccccttaaactttgtgctccctcccccactcccacagtgtgggcttgctccctctcccagtcatcccaccctcagaacaagttgggggagagaggtggggctccatgccaggaggaggaaggttagggtacagagaagaggcgggaggggaggggtacagaggcctggaacgcagccgtgtgtctggccgggagctctctaacactaacagcttccagctgcttccacaacctccagacttccgccttgggagtggcatttggttgttttttattccccctcttcacatcaaatgtgtgatctaattagactttgcatccctcatttctatcagtcttccctgtcttgcagtgctccccttagttgacctgtcctgaccctgtttccatccatcccaggagcctctcaggtgctgccactggcatgctccaggagcatccacccagtgctgggtgagcaccacaaagaccaagccagggcaagagacacaggtaggcgtcagccagggtgagggaaatggggggcatcagccagggcgagggacacaggtgggcatcagccagggtgagggacataggtgggcgtcagccagggtgagggacacaggtgggtatcagccagggtgagggacatagtgcccgggtgagggacataggtgggcatcagccaggtcggggcagctccttgtggccctgaggaaagagcttcggactgaggttaacagaccccgaggttagccttgcctcaggtatatgaggtgggttatctcagccaacacttccagcttcagggattttgttttgtaaaatgagggtggtactaacacttttctgcccacctc

SEQ ID NO: 58013 - DNA, 1040 bp, Homo sapiens
ttttggaaatgagggaggtcgtcttctatctttggaaaagagcaaggagatctgtggattggattttgggaatagtgtgagaaacatgttgttaactgggtggttgaagtcaagaacatttaaaaatcttgatatcaatttttgaaatggtgggtcttcttgaactctcaagaatataggctaagcctggcacagtggctcacacctgtaatcctggcactttgggaggctgaggcgggcagatcgcttgagctcaggagttcaagacaagcctgggcaacacggtgaaatcccgtctctacaaaaaaatacaaaaattaaccagacatggtgacacacgcctacagtcccagctactcaggaggctaaggcaggaggatcgcttgagccaaggaggcagaggttgcagttagccgtgattgcgcctctgtactccagcctgggcaatagagtgagactcttgtctcaccaccacccccgtaccccaaaataatatagattggagcttttgtaaatttggaggctcctgggggtattagagtgtctgagtcttctaccttttgaggattcagacctggaattacaacaaatatgtgggaaaccccagacaggtgcccagctgccagaatctgagacacatggttggtgtgcacatatatgcagacttgtatgagcaaaagcttttaggaaaaactcagtttgaaaccaccctaggacttgaactagatgctcttttttgaggttcattctaggacacttttcctaaaagcagatacccaggacttctttatataagaaaactttctgattttttcatcccattttcatgtcctgaaataagagccctcctagcctaggaaagtggttaagattcctaaattaggaaggttgttcaactgtggggagagggtgagagggtggcagattctcgagctttctcagggcaaagaggcatagggaaaatgactaaagggaagattggctccgatctggaagaccaggccaaggtgtgtgagattttcttttccagacagtttcta

SEQ ID NO: 58014 - DNA, 1053 bp, Homo sapiens
agggctgtcattctcccatttctgccagagtgaacccacatatcttggtgtggtgcaggagtgtgtgccagcgttccgagccaagctggcagagctctggatcacatgagggcaccgaggcctacattgatacctctaggggttggatttggagtcactgaagcccctgtggaattagaagacctagatccatccctgagtactattccctactccccaaataccagcatacatgctgtccctgtgaaaagcttgtgggcatccataccagcatctctaccgcccctgcgccattgtggaggtaagagatgaagtggataaaggtctctgaggcagggagataagggcctagaagaaagacaagcttgactcagggaagggcacaggagaagaagttaaggaggattctgctatttctcgccccagcttggttgggatactcatctgacacctgagagtgaggtccgccaggagctacagaggcagcaggtgtctgtctattcccctccagtctccttggttagaccatccccaggccagggggagtggtggccagttaggatcagtcttgtcgttccaggatccttctctgcacttactgttggcccagtcactccattgtcgtctgcaggagtattagatgaaattccagagacttcagtctctaaagaagaaagcttttctagaacagggaatttatttctctccccgggctcacaggggaagtggaacattccatttgaagggtgaaacaggaacaggtgagctacagttcagacaacaggactctgagacacaggttgagggagtggctgagccactcatgctgtccacctctgtctctgccatcttattatcaatctgtttgagggcaccttgcttcctgtgccctgatctcaagatgctaggatggcaggatatggctctgggacccctaaggaagacaggtaagaggacatccctcagaagatcctgtccctccccatctggggaccctcactttcccacccaccagtgctgctgtgtcccacaattctgagggcaccgttcaca

SEQ ID NO: 58015 - DNA, 1023 bp, Homo sapiens
ccaacacccactctccacatcctgtatcgagaaagtcaggttcttacccaaccagggcctctcctccccttgtcagtcccgatgtttcttttaatagtttaaaaagttagaaaaatatttttcagagctttagttgctcctgagaaattctagcttcctcccactgggagtgagccttcaaagatcatttatccattgatcaacgagaaaatatttattgagcgggagccacctcgcgcattgcattacatgcatcgtgggactccacagtctggcccccaaatacccgtccagcttcatttagttatgaggaataagcaagcttataaataggaagcattcccacagtgtccatagtaaacacacagtaaatgtttatagaattatcgttacttcccaacacgaacctttacctagtccaggtaccccagtaatctcccgtctccttaatgtgactccctctaaaacgcccagcctcctcctctcatgctgtcgtctccatgctgtggcctcccctgggcatctccccggctccccactcacgctgccctcatcccaggctgcctgtcacgggaggatggttttgttggtttgcttttatctgtatccactctctagattagggtttccttgaaggtggggaccacatctctgctcagtctctagcactgtcatgctcaggacatttctagggaatgactggctaacatatgcctacaacttcacggcggagggggttttctgtgggctgggggtgtttaactgaagctttctggaagaggtggcatttgagctcagccctaacacggtgtccacctgccttcccctgggagatttggatttaacaggcatctgggggagagggaaggggaatgacgctgccagagcaggaatgcctaaggcctttcggggaaatgttgcaaagttcagtcaggttgaactagaaaacttacacatggagccatagaatatgacgtttgaaagatgagtggggacgtgccgcagtgggccttggatgccaaa

SEQ ID NO: 58016 - DNA, 1029 bp, Homo sapiens
gagaaaattaagtggtctcaagccaggggaagcatggctccctgtgctggatgcattagggagacggctgggcagggtgaggaatggggcttgctgtgggcagagggactctgccccttttgtgttcagcccagtctatatgttaatggcagcccagcggtgcttggctttggcagcctggaaatggcagctactacttctccccatgctgcccttccaccccttgttcgcctgggccctgagatctctgcaggactaagtgaccttagggacaggcagagtagagtcttgcgccaaggcctcctgggtttgttcacaggctactctaagaagccaccaataaggaactttctcagggctcagggtcctgagcacctttagaagtttctaataggattttgtcttccagataggaaggaaaacccatccagatcttatagaggaaccaaagcccagcgaggcaggtacttgcccacagtaacgtgtgtgctgagggctcaccaagcaggcagctgggcattcgggctcctagtcctgggacctgagctctcaatatttctgagcatgaagatctcatgtggtgcccattggttctttgtcaaaccagatatttatttacgtgagttctttggtaggacaaccaatttttctcagtgtgcctgagactgtcccggtttgagcactgaaagtcctgggcaaactgggacagttgaccaccatgtccctaaggattctccccctggcagccctctaaacccagtttgcatttctctttattgctttaattgcaggaaacatttcttcctggcattcgttttctatgggctgaccccagagagctgaacttgtagataactgggaagtaacgttgcctacccaaggtgcctgacactagactttcctatctctcaggagctctaagacaatcaaaatagttgcatctctctaaatgcaattggggtaactgaagtacagtgtggaggtggctcctgcctctcccttgctgaaagctctgatcaaattctgtat

SEQ ID NO: 58017 - DNA, 3901 bp, Homo sapiens
attttatccaaatgccatctaatctgaacttttttttttttgagacagagttttgctcttgttgcacaggctagagtgtagtggcgcgatattggctcactgcaacctccacctcccaggttcaaactgttctcctacctcagcctcctgcgtagctgggattacaggcatgtgccaccacgcctggctaattttttcgtatttttactagagacagggtttcactgtgttggtcaggctggtcttgaactcctgacctcaggtgatccgcctgcttccgcctcccaaaatgctgggattacaggcgtgacagaactttttttttaacttcaaatatagctgggaccaaatattcctaataataatatgttattcttagttgggaatattctgaaagaattggtagcataaagggttattgacctcaatgctgattgtaagatcctagacagttattaaaattagtctttgtttttgtaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaatgttaagtgatattttggttcaactttatattatatgtatcatagtattttacaatggttttggaattactaagcaggattagtataattgcaaacaacattttagtaatagaagaacttggttcttgcagtattatgagaggcccttctaagaaactgaagatttgattctgaaattggccctagcttttcagttttgctgcaaagaaaattaaactgggtattcacagaagcaataacattcagatgctgggcttagcctagtgcttaagtagcagggaaatctctgttttgtgcattattattattattattttttgagacggagcctctgtcacccaggctgcattgaagtggcacgatctcagctcactgcaacctccaccttccggtttcaagcgattctcctgcctcagcctcccgagtagctgggatcacaggcacctgccaccatgcccggctaaattttgtatttttagtagagatggggtttc

SEQ ID NO: 58018 - DNA, 3516 bp, Homo sapiens
tcctaggagaccacacagaaacgactgcgcatgcgtgcattcccccccccccccccccccccccccccgccccggctgatgcaacctcacgctgccgtgcggctctacctcgagtaaggaagccgacagggaaatctggcaaaaccaatcggcggccacacggaagtgggcggaaaggcccgccccccggggattttgcgagtgacgttgggcggcgcggcgctagggacgtagacgcccaacagtcctgcgtctcttccggcgtctaggggggtgtcctgccggcgcgcgggccctgcggccattttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctaacaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtttgtttcttgtcttttaacatgcctgatatgttctgactgtttttatatgcttaaatatagcagcatgactttggaggcttaggagtgcatgtatttttgaggaaggcctctaaattcatatacttggattgagaaatatgtaaatgacccttctcctcctgtccctcaccccccaccccaatgcacattgttgctgtccaaaacgaacataccagtgtgtagatgttagcaggaaagtgccatttttatttgggttggtagttctggactgtttccttacaagcttcaatttttcacactttttaacggactattaaactttgtgtgtacacgatttaatttttctagagattgaaaaggtcctgttacagccatagagttttaaaatgattttaaatgtatgttgtctgcaaatacttaatattttttttgcatataacaagagtgtcttcattcctgtccattacaacccaaagggatgatgatatcaagtagcaagtcagatttatctggtccaattggccatgaaattaaatagtaatttcactggttttgacattacatggttttaattgaaagtcaaagccagtacaggaagtggtattgccttttcttaggaatgcaatgctagttatcagtggtcagctacaggttaatattaataataaacagtgatggccacttacttggtttatcttgactagttgcttccttttcccaggctagtcttaaaacttcatgcagcattttacgctttaattacattgtcaggttaaccttattttgggagtctttagagttggtttgtttttctttatagttgattcaactaaagttattaattgaactcttctccaaactcaaaggtgtctattattgtagag

SEQ ID NO: 58019 - DNA, 1036 bp, Homo sapiens
gaagttcactaccagggccaggcacggtggctcacgcctgtaatcccagcactttgggaggccgaggcaggcagatcacgaagtcaggagatcgagaccatcctggctaacacagtgaaaccccatctctactaaaaatacaaaaaattagctgggtgtggtggcgggcacctgtaatcccacctacttgggaggctgaggcaggagaatcgcttgaacccgggaggcggaggttgcagtgagctgagattgcgccattgcactccatcctgggcaaaaagagcgaaactgtcttaaaaaaaaaaaaaaaagaagtttactacctagaaatatttgaccaactccattttataggagaaaaaactgaaacttgagatgcctcaaaactatcaagccactacagcataaccatagcccagaagggaatcccccaagtgcaggatggaagtgaagtgacccttgttcaagcattgtacccagaagtcttcagaactctccagtggggagtcatgtttcatactggggaattctgtgggggcttccagggatttttcagtagtaaacagtaggaagtgttactgctttatttctaagtggtcttgaggtgtcactgcagttctgggcaagtccctatggactttttaaaggttagtacttgaatctgccaagagtcttagtgaaggaaatttcgtggccaaatgaggtagaaatctgaaccctcctgagggaatgggaatgagagaggtggggaatgagagagagaggttgcccaaggagaaaagaaacaaaggcagcccagggggcccagatttctgagttcaaagagaggtgacaaaaatgaagcagcccagcttgccgagatttggggagcaaagattagactggatttgaaaggtgaaaaaatgaggcagcattttaaattgggagagaattttctggtggctgggacttgtctaaagtgtcaacaaacaacactaatggcttactctgggtgaggcgaggtgtccggtactgtggctactcagataacaaaggt

SEQ ID NO: 58020 - DNA, 1072 bp, Homo sapiens
cttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactccctt

SEQ ID NO: 58021 - DNA, 1051 bp, Homo sapiens
agtgaaaacagggctggctggttcctgatgaaagaagattagattagaagtggagctttcctgggtggtagggccctggtagcctgctagggtccgtggcctgttcccagcatcacaactctagtctctgggttaattaggttgaggaaagtagggacactgggaaggaacaaatcacaataaccaaactcacaagagactggctataggccagaatgctaattcgtataattttaacttcaagggacccaaatactgatttatattgatcaatgtactttatcctggagggaaaaccagcatgggcagccaaggtataatcagaacattgtttagtgaatgtgtaattagatgatcttaaatggctttcagtgtttgtgttccccggggcttaattcctggcctgctgggccctctttgcactcttcttgtgccagctcatcctcttattacttcaactaccacctgtatcttgatgacctccgaagccattcctctagccctcttcccttcctccaggtggttctatagccaccttcttgctggacttttccacctacgtttcacccacgtctcaaactcggtgtaggcaaaactgagcctgctgtctctcctttgcctcttgaaacctgctttttgtgtttgctatcagtcaatggtgtgactctttctgtgcatttacccaagccaaagccacggtcttcctgatgcttccctctatctcacttctgtaccatgctctgtttattcttcttcccagctatctctcaaatctgtcctcttcttcctattttgttaccattgattttgttcagctctttgctgtcggtcccctgaaccactggaatgcctctcctccatctagagccagcctctgcttgatttcagaggtgttttgttgttgttgttgttgttttgagacagagttttgctcttgttgcccaggccggagtgcaatggcacgagcttggctcactgcaacctccacctcctggattcaagcgattctcctgcctcagcctcccaagtagctgggattataggcgtgcac

SEQ ID NO: 58022 - DNA, 1226 bp, Homo sapiens
tgtaaccaagagccactgagcggttctggtggcacaggaccatgttaaggatacatggaaaagcaatgcttgggtaatagatcatctggtcttgtcattggaagaaccttagaggtcatctagcccagcctccccacctcatgaaggcatccctgccaccaggtcatccagaccagggtgtggttagctcacaagtcctcttggagggcgtaagcttttacaggacttgggagaaggaagaggctatggtccacggtgagaatgagaggggagttggatgatggcttcaaacagaaaaggcagatttttggattgggggagcagtagaaatattctctgcttagccactttagcagctcttcccactctccctccttcttagggtcctgacctgtggccggaagcttctgggtttgtggccagcaacacaggaaaatcccagcgcccgttggagtgcacctaatttccaccagccagacagtgtcatcctgcaggtgaggctttagcccttccctcccagtcaccagcaagaccattccagtcaactctacatttttctcctggagatttgggctgggacagcaggagagagtgctagaacttcaagcatgggaggatgatgtgactgaagcaactgagggaatatggttagatgtggattgtgaggtgagctctggggtatccatctcccatctcctggaggttaaattgatttcgtggagcctgaagatggggtctgagaccctctgcattcagggctcagcttctgagtcccttgtattgaatcttcatacgtctaagtctgatcaaacctgacctgggtcctcttggggcctgaggggacacctttgcccctgccagtgactcagtgctttggcaggatggacctattctccagggagaagaggaggagctggtcacgcccaaggtgcacttctcagttcccagcttccccttcttgtggttatgagatactttggtatggagtatgaatgttgacatagaatgaaagctccctgaggcaggtttttttttttttttttttgagacaggatctctgtcacccaggctggaatgcaatggcacaatcttggctcactgcaacctctgcctcccaggcacaaatcatcctcccacttcagcctcccgagtagatgagactacaggcgcacaccaccacgcccggctaatttttgtctgtcttatttgctgctttatgcccagac

SEQ ID NO: 58023 - DNA, 1013 bp, Homo sapiens
accatgttggccaggctggtctcgaactcctgacctcgggtgatctgcccgccttggcctcccaaagtgctgggattacaggtgtgagccactgtgcccagctatctgggcttatttcaaatttaaggatattgtggggtcctttctggcctctgcctcctcatctcgaagctaagggaaaggaaagaggcagggttctgtatggtacaactccagggtacccttcaaatgtgccccacctttaaactcacttatgtacacacttttcccctagaggaacaggaggggtcctagactcagggttgcctggcagagagagtgccaggtggcctgccactgttagaagggaaaaaggggacatagtggataagttggagctcctgctgacgccattacacaggtttgaattcggacttgccacttactagttgtgaaggctgattgatgctcagggccctctgtaagctgcagtgagggtgaaatgtgagaatgacctgtgagcaatcagtaaataccagcagggaaggagcagcccacggagagaagtcctagggctctgggctgcacagatactgccatttcccttgcagcaccccaaatcctggagcccctgggtccggaggtagtgggagctgtcaagttctaccttcctgctaagactcaggtgaaatattcttagtgaggtgggacagggtcagcggtcctcagatcacacccctcatactctcacttgaatgcacagagaggaaggccttccacagagaagatcaagcaagtccccaggggacctgtgtgcatgactcctggcctaggagccccactcccacccaacagaaaagcacaatgctgtctcctggcccagcccccagacccccaacacatgacaactgcctgggatgggggtggaaaggacgctccgggggttccagaaatctgctagttcccaaggaagccctgagattttctacccctgcctggcaggaggggctgatactgagggggtgagtgggttc

SEQ ID NO: 58024 - DNA, 1432 bp, Homo sapiens
gaagagaaagaccttatggatgcatgtgattctgtaatagacctgccatcaaaaaagcttatagagctgtatacaacctgtgggttttccataaggaagcagggatcagatgcacatctgttggaggctgggggagccggcttgcttgaccttaatacacctccctgctgtaggagtcggattcctggcagtgtgttgatgttccctgttagagccgggctgtgggaggggcagttggagccagcggcatgtgtgtggagtgagatgcgaggcagggtccctggctgcaaaggaggtgggattgggggtatgggtgagtgtgggtgctgggggatggacagaagtggaggtcctctctgaagagaaaaacctggacaccaaagggtttaagtcctaatggcctctgactccctgaccctgcctgtccttaggggaagtgctgagggtcccttcctggggaagtcctagagctgagtctcttcccttagtaaaatctactgaaaatcaggatgcccaagactgggggcttgaaaccctgcatattcttcaccgccttgcttgagagctttccattttccctgcccactgaagatggtccaagacatgcagtaccttcttgcttcctgctttacaccccaagaggggattgaattctttatgtatgtgtctgccacctttgctagattgtaagctccctggaattgtgccatagtcatctgaatacttgtagtctttagatatgtatgtgcctggcctggcatgtagctggtactcaacaccctttgggatccaatctgtggctcagggtatggggaagagatgacccagacccctctagattctcccagtcccaaggagaacaattctgttagggtgccttccagcaagacagcaggaaccctcaccacccactggctccagtggtggcccctgggctcctccctctctggcacagggactaaacagagccagctccactggagggagtgccctctcctttctttccatcctttgactctgaaccattgtgtcactctgtcctgaccccatttcctccccggctagccctcagccatctgtgggcagctgtgagactgagtttggtgcctggtgcagctcagaccctggcaccgacctgcttggccataggcatgtcctcttgtttcttcagctgactggtgctttttggggtgcctctacccaggtcttcttgtcttcctgagagttctgaaaccctcttctgtggggtcaaacctggctgcacatttgaatcactttaggggctactgaagcatccagcatccagggactcaccctactgagtcagaacttccagaggagaggtcgggaatgtgtatatttttaaagcttcgcagatgacaattgcggtcactcaaatgtggagtgtgcattagataatattattgttgtc

SEQ ID NO: 58025 - DNA, 1159 bp, Homo sapiens
tggctcccagctgcagggcgatctgaaccagtcaatggctttggggtttgtttatttaagataagaaataaaaaaagcaaaacctgtcctgtgatggggttagtgccttctgtggactgggtgagaagtcggcatctagcctggggaatgtgtacgtttcttagtcgggcggagggtagaattggattctcccttataaggatactgcagcaaaaggagactgaaagcttgaaagagggagagggaccctcaggcctgagttcgccggtgctgggagaaggcgctgctctcctggcctatacttgtccctcattttcagctcccgacagcggtgactttgatgttggaggagcaatcgcagcaggaagcacaagcaaggctgccaagctggtgtggggtggagtagggtggggagcccaggggcttggcaggcttctggattgtgggaagaggttaccaaatgtatgaggttagtgcacacaccctagttggctgatgttgaagtgtgtgtgtgtgtgtgtgtgtgtgtgtgttttctgccattgctcttgctccttcaggcctgccttttctcctctccacccgcttctggggtcttcgtagcttccctgccccagcccttccaatcatgcctgggatggaatcgctgtattgtctctggcagctctcttgggctgttttttctcaactctgttggagagttttgtaccctgggctggctggtcccagcatggcaccagattctttagcaggcggctacccgggctccaagaagtgggccaatgctgcccctcctccttgctctaaactacctatttgggatatggccaggcagatgtaagcaatttgtactaaattccaaccctgaatcagtgctgaatgaaaacttactctgttgctgcatcaggctttgggaagatattaggaagagaaatggcccaggaggtggcaatgccgacccccaaatacttccctctccccaactccagctgccgatcccagagcagacaggcagtgagactttggaatcccagctcctccagagtctggctggcccatcttgaggttgtgtccatggaaaaattaagtcgaggcacattttatagctctgcttggcagccagcatctgaagagatggtggctctgagctggagcccta

SEQ ID NO: 58026 - DNA, 1021 bp, Homo sapiens
tgcggcttcattactcgccatttcaaaatgctgccgaggccctaggatctgtgactgccacccctccccccacccgggctcggcgggggagcgactcatggagctgccgtaaggtgtggctcttggccttcgtcggcggggtgccgggagcgggagctggagagtgaggagcaggcggccgtaccgccagttgtgcgggtagcgggcgggaggagcttgagaggtgggtcgggcggcgtggggaaggccgcgccaggcggaagaagggctcggggggaggggaagagttgtgggatgagggctcgcggaagataaaagtggaggtggggtgacgtgaagtaactttggccaacaggtgacaaacctaaagtcgacgtagttggattgagtttaactggacacaacatttgaggactgttgaggcaatttggagaaaggaggtgggagagagggaaccgggtagaatgacattgacgtgtcttaagtttttaagttagtttttaggtctgcggacagtctaccttagaggcacttgagtgcttgtttgaaaatgcttgttttggcttggcgcggtggctcacgcctgtaatcccagcacttcaggaggccgaggtgggtggatctacctgaggacaggagttcgagaccaacctggccaacctggtgaaaccccgtctctagtaaaaatacaaaaatattagatgtgtgtggtggcgcatgcctgtaatcctagctactcgggaggctgaggcaggagaatcacttgaatccgtgggcgggggttgcagtgagtcgagatcgcgccactgcactccagcttgggctacagagggagattccgtctcaaaaaaaaaaaaagaaaaaatgttcgttttggggccacactgaaacctacagacagtatcgagatggggctcagagaaatatattttaatgagcacacctcccagtgatttttgtataccttaaagcttgaaaaccacaggtttttttggttgtgtttttgttttgtttttgtttt

SEQ ID NO: 58027 - DNA, 1052 bp, Homo sapiens
gtcctttgtcaagacatgttccaacatgttgtagaggttttcctagaagtcctgttggaatcttaaaacctgtgacttaccttggtaaatccccagtcttgcatctagagagtgctctacctgataaccattggggagataatgatttgactttcagctaaaacagtttactgattaacatcagttggaggttggagcgtgcctgaaactgttactgtttcagccttcacctgagagaagcttggacgattcttactcttaattaaatcagaactagaaagtagtcagaagatatgcagaacctcagcaagggtatacagcatttgtgtacggtgctccattatatgtgtcatatgtgtcttttacttctgctggttgcctttgtgtgaatgctaaatagggaattttctgcattagaatagatgttataaatttttttttctatttagttttaccaacagactgcagtttcttcactaccaaaatgacatcattttccacctctgctcagtgttcaacatctgacagtgcttgcaggatctctcctggacaaatcaatcaggtaaatcattttcggtatttctagttttttggttttttttttttttaatttttaaaaagtttagctgtctcatgactgtaatcccagcactttgagaagtcaaggcaggaagcttacttgaagccaggtgtttgagaccagccttggcaacatagtgagacctgtatctctacaaaacatttctaaaagaaaaaattagctagatgcagtggggtgtgcctttagttctagctacttgggagcctgaggcgggatatcacttgagcccaggagttcaaagctgcagtgaattatgatcacaaccagtgcaccccaggctgggcaagagagtgagaccttgtctcttttttaaaaaaagtaggggaggtgggggttgtgctgggcgaggtgggtcatgcctataatcccagcacttcgggaggcggaggtaggcaggtctcttgagcccaggggtttgagaacagccagggaaacatggtgaaaccccctc

SEQ ID NO: 58028 - DNA, 2968 bp, Homo sapiens
aaaaagaattattatgtgaacacatatcaaaagcctaaagtcgtttatgtgccctggactgggaaaatatttttataatccaggcaaattacttctagtaatagaatagacttctttatttggacgtctgagaaaatttttaagaggatactaggtaaattcactgctttttctcattgtcagatcagttcatttctgtgctgaaaagtctgggtctgttaattgtcagaaagacaatgagtagatggacctagtagttgggagcggctttcctgttgtaggaccccttacacaaactttgacagtcttgtaaatatgttatttctttctttagcaaactaacttaccttacctcctctaatgaatttgtgtttttggtagcagctggacagatcacaacatggtattttattccatgcaggtcatgcactatttaggtcagtacataatggtgaagcaactttatgatcagcaggagcagcatatggtatattgtggtggagatcttttgggagaactactgggacgtcagagcttctccgtgaaagacccaaggtaaaaacagtgagggcttgcgtatctttttgggtgcttatacctagccacttaatttctatgggttattaatatttattacttcactcaacaaatatgtaagagcctacatatgttaggtagcctatgaggcactgagaatatggtaatgagcgacacacagtctgattttatggagtatacagagtagtgagtcagtagatgctcttgcccatcttagtcaaataatcacactaattcatggtaaacctacactatggcaagtgctacagaaaagagatacatgaagcagggagtgggtgggatttagagtgttagaggtcaagaaaatgttcttttgaggaagtgaaatttcagccaaaagctgaaagatagataattaagtagtcaatcagagagtttgaggttgattgaacaccatgtgtaaaggcctgggtaggaggaagcttgatgtgactaggttagaattttgtgaaataattgttggagagggaggaagagtgagcagatgagagaaatgtagaattgctgggcagttagaggttgatgatgagcctggtaagaatcacagtagggctaacctgacctgttacttttctccagctgcatggggtgtaagttattagcttatatagtcaaaagctaattagtaatttagaagctctctttctctatagctttgatgactgctgcttctgagctcattctgtcttacactaagacttcccttagctgggtgtggtggctcaagcctgtaattccagcactttgggaggctgaggtgggtggatcacctgacttcaggagttcaagaccagcctggccaacataagtgaaacgccgtctctactaaaaatacaaaaaattagctgggcgtggtggcgggcgcctataatcctagctagtagggaggctgaggcaggagaattgcctgagtccgggaggcagagattgcagtgagctgagattgtgccatggcactccagcctgggcaataatagcaaaactccgtctccaaaaaaaaaagactcccctccacccccactttccaattacaatgtgaaacttcagtcctggaaggaaggaatagtttccaaaagagatttccccacttggattactgttcgctaatgaaataaaatgtaaattaatcagttttttaatgggggcagagtaacacaggggcctgggcattaacatcttaatatttaaataattaaaaactgttctgggaaaaagattctgcctttgtatgccttacagagagacttgggagataacatcagaaatacatttaatatttaacggcaaaccactgatatcttcatagtggcatttggggttgttaattttttatcttctctctttaacagccctctctatgatatgctaagaaagaatcttgtcactttagccactgctactacaggtatgtcacatcatatttcttcagtctgtatcacagctttgagttcaagggggcaaatgatgggaaaacaaagaagatgaaggtggaaatggaatgctatctttggcatgactgggagaaatacatactacctgtcacacagaatgttatgttattaactttttactgaaaaatcaaacatagagtagaaggatttccactttctagacgtactgttaacgttttgtcatattgcttcatctagacacacttttaaaaatctctagcagataaggacttttttctccaaacattcaatatcattattacacataacaaatttaacatgtaattccataatcctatttcatagccagtttatgtatcatttcccccagttatctcaaaaataccttgtatttttgtcttacttgaattaggatccaaagtccacacattgcctttggttgatatgtctcataagtgtctttaatctataaaacttaactttccttttgttttcatgtcatttacgtgttgaagaaatgggtcatttgttctgtagaatttcccacgctctagagttggcagattgtatccttgtgattttgtttaatgtgtttctttaccctctctatttttggtaaactggtagtgcttgaataaattcaagtttaaattttttgccaagaaagctttataggtaatgctttgtacttctgtttaatcacatcagagtcatgtaaggtctgcctgtctattttagtcagtcatgttaataatctgtgggctcaggtggtatcagtctgatccatctgttacacaggtcactcaagaaccttttacctaatggctttagccatctcttatctgaatgccaatttgtctaaccctttgcttgattctagaccttctaaatactgctctttaactattaggtatgtataggaaactggctgtactggagtctggagtctccaaaatggtggtctgtaagagataggt

SEQ ID NO: 58029 - DNA, 1119 bp, Homo sapiens
cactaaaggtttgagatacatggaggattttataattgctgatctactttttcattaaaatttgtttttggattgatctgttttctgaatatctataattctccttttttctctcattttctttcttgtactttctctgcagaatttaacatgccatataaagaatattttgttggttttgttttgttttgtttgagacaggatctctctgttgctcaggctagagtgcagtggcaagatctcggctcactgcaacctccgcctccgtggcacaagcagtcctcccacctcagcctcctcagtagctgggactacaggagtatgccaccacacctggctagttttttgtatatttttttgtaggtacaggttttctgcttgttgcttaggctggtcttgaactccaggactcaagcgatcccccttcttcggcctcccaaagtgttgggatgacaggcgtgagccaccatgcgtggcccatttttattttttaacttgtcgttttgaaaaaatttcagacttaataaagttgcaaaagtattgcatagagtttctctataccctttatccagagtccccaaatggtaacatcttacataataatagtatgatgatcaaaaccagaaaattgccccaagtaattctgattggttatctgttctgacttgcaattgcattggtgcttgtggatggccatctctgttgatttttgtgatttgggttgcttgtgttttatttgaaaggacaaatgagagaagtgcttttcatataattttatacctttgcaaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccgtgttagccaggatggtctcgatctcctgacctcgtgatctgcccgccttggcctcctaaagtactgggattac

SEQ ID NO: 58030 - DNA, 3347 bp, Homo sapiens
tggtagttctttctaaattgtctctccaaattttcccatgtatacaaatgaaataaatatgactaactttgtgtgtgtttattaatttttgagactgagtctcgctttgtcgactaggctggagtgcagtggtgcgatctcggctcactgcaacctctgcctcctgggttcaggtgatctcctgcctcagcctcccgagtagctgggattacaggtgcgcaccaccaagcccggctaatttttgtgattttagtagagatgaggtttcaccaggctggtgggttgcccaggctggtctcaaactcctggactcaagtgatccacacacctcgacctcccaaagttctgggattacaggcgtgagccaccacacccggctaattttaaaacttcttttttacattgtggtttcaccagataatttatttttgcttgtaactgttttaacctaagtaaggtagtaaggctttggaaatataaatgacagtaataggattgctttattaaagaattgctcctggcctgtgcggtggctcatgcctgtaatcccagcactttgggaggccgaggcgggtggatcacaaagtcaggagtttgagaccagcctggccaagatgataaaatcctgtctctactaaaaatacaaaaattagtcaggcgtgcgcctataatcctagctacttgggaggctgaggcaggagaatcacttgagccagggaggtagaggttttagtgagccgagattgcgccactgctctccagccagggtgacagagcaagactccgtctcaaacaaacaaaaaaattgctccatctgcattatatgttagtccaacttcgctttgaagaccactgtggtcagaaaatgctgtctctcaaactttttgttgtctccgtttgtccacaaaaatgtttctggaaataatgttttttataattagaattttgaaaatgtttgcttttttcaatagaaccgcattgacagatcagttgtaggatctgtatccttcctctagcagcctttatcagatggtgatgatattttccatattttatctctgaacctggtagtggttggtgaacctgacccacagtagacttattttgggtctatctcattcacatagcctcaaataatgaatagtccagattattaaattgtttgcagcttgatcttttcgtgtagccaagtttttgtcttttgttctacttgaaaaatttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaaggtaaaatcaccacacggtgacttcttttgttgtacagagtggccccttctctgtacctatggatcttggactcccaagacctttccctgaatgtggtaagaatttaataagaaaggttcttgggagttcacagaccagggacagagtgaaccttctctgttctgcccataacagagttccagtctctgaacctttctttgggatgtagcacttctgatcttcagttcttccagttgcatttttctttgggtttgtgtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagcctgtttttaacagtagattttggcctttgtgcagaggttttttttccccccaggtttgggattcttctagctttgctcacagtgggttgaggagaggtgttgcctttatttgatgactgttgtgaacttgagttctctttcttgtgtgtaacccattgtgttgcacactaactggtgagccagaatggaactgctacatcccctggtctcagttatttctactgcactgatggacacctttcccttctttcagcaaagtgcagaggaaagttccacttccagaaaaagaactacagaagacgatatccccacactgcctacctcagagcataaatgcatacattctagagaaggtatgttttggattaaggctatatagacttttgttctcttcctcttccaacctttttatttttaatctctccgtatgtgaagtaggagagggatatgtcacaatttctcatccttttctgaaaacctttttatcagcctagttactaccattgttagctttgaagaggtagtgctattttagcaacccgtgagtactaggatggtgcaagacccttccatgagctagcatgctactagaaaatagctacacatttattgatttgctaccaggtgaattttctacatacatgaattcagctgccttagacttttcaatcttagtattcttgtatgtatatgatttggttagaatttttattttgatttatctacttgaggcaaaggccaattttcatacttttttttttttttttggagtcagagtttccctgggtcacccaggttggagtgcagcagtgcgatctcagctcactgcgacctccacctccttggttcaagt

SEQ ID NO: 58031 - DNA, 7334 bp, Homo sapiens
ctaaaaaacactttctaggctgggcatggtggctcatgcttgtaatcctagcactttgggaggctgaggcaggcggatcacctgaggtcaggagttcgagaccagcctggtcaacatggtgaaacactgtctatattaaaaatacaaaaattagccggacatggtggcaggcgcctgtaatcccagctactcgggaggctgaggcaggataattgcttgaacccgggaggcagaggttgcagtgagccgagatcgcgccattgccctccagcctgggggacaagagcaagactttgtctcaaaaaacaaacaaaaaaaacactttctaaaattagttttttgtttctgtttttgtgttggcgaagatgtgtaaaatcataaattccccaaagtcattttatggcatgatggcttctagtctaggcatgtggaccaatggcaggttaagcctctagttatgtctgagaaactttggctgctgaagttattttaaaagcttaaatttgaataagtttatcatgctggattgttttctttacattgcatttgagcataaactgaattttggtctacctagttactttgtaactattccagtctatatgatattaaatgtgtaattttattccttaatgcaaatccttgcttattttgtactcaaaaggcaattttaagatatataagaacatggctgggcactgttagaaaatcaaggctgggcatggtagctcgtgcctgtaatcccagcactttgggaggctgaggcaggggcattacttgagctcaagagttcgagaccagcttgggtaacatagcgagacctcgtctctacaaaaaatcagcccagtagaaaattagctgggcatgatggtgcgcaccagtcgtcccagctactcaggaggctgagatggaaggatcacttgagcccaagaggtggagattgcagtgagcggaggttgcagtgaatcaatatcatgtcactgcactccagcctgggcaacaaagtggtgccctgtctcaaaaaaaagttgggggcaagggcaggtatttaagaatagccaactcaaggggggatatgtagtttgtgatgaaaatttgggaataaataatagtattttcaggaagacctataggtagaagggacagaatttttatttgtggaaagaatgacctattttcatttccttcataagttgtagagctcgagtagggaagaataactttaatatggcaccatttcaagaatttggcttctgatagtttcaataatgaataagtggaaacataattgaagtttccctggccacagataagccttttagtcagcaatattgacataatttataagtaaatagggtaaccttatgttctggcaaggacccatgtattgcagaaattctttcaccatatgtacttcagcacacgttaaccccatggttgctatgggcaggcctaatgtattgggaggaggtagaagagaatgagaaagtaagaaaggagcagtagagcccaacaaaagactggagtatgggaaagaaaagagtatcatgtgataacaacagacttatgttaattagctgccctcagtgtcattcaaatgtacaatgtgagatcttttacttgaaataacgtggggtcttagtatttgtggtatgtctagatacttaactctaagagcccattgatccagcgagggcatatgtatgtatttggacaacctagagtttagtgttttatagtggttgttacctactaaaacatacgaattattgagaattgacccagaatatgtggtaccagtgagattgcctggacaaccttgtgatcacctattatggtttgtattgccttgctttgatcttaagggttagaccactatgttaccatcatttgcaatgctgttaatcaaactattatcaggcactatgtactagagcaagtaattctatagtttatacatggtaggagtgtttaaaataccagtaaatgcccatttagaaattcttttagcacaaggtcattgttcagatgcttttagagtcttttttttttcctgtcttctcatagaagacaatgcttttagagtttaaacttgataaacgatgatctgtttgtagtgtcattacttgctaatgaagtctaaacaagggaggagatttgagctctgccactaagacagatacttgatttctggttctttctttcttagaacaggaatttctttttacctattttataaagaagttttaagtattctaaagatagtcttagttattacgtattgtgcatagttatcattcttttcatttgacttctatagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtaaatttcacatttgaagggaagtggttttttttcttttgaaagggtaacattcttggttactcttgaccacacattatattctctaagaattcttatttactcctatggcgttaaataccatctgtatgcatgtgatacccaaatctgtatctctagtccttacctcttccctaaatgcccaacttcagtttccagatgcctatttaactaacaactctacttagaggatttgacattgaacaatttcaaaatggagcctttggctgtgcgtagtggctcatgcctgtaatctctgggagtcccagcctataacactgggaggccgagacaggaggattgcttgagcccaggagtttgagaccagcctaggcaacatagacaccatttttacaaaaaattaaaaattagccaggcgtggtggcgtgcgcctgttttactatagtaataactgattcagccccctccttcctcacttcctgtcattcttctttgttcactacatgcgttttggatatactaggctcctttctgacactgtagcccaaaattgctgccttcctcaggcaccttaagtttgttctttactctttctggaacactgttcccccacattctttctttgccttctcatgatttaggactcacctcaaatgtaatttcttcaaagaggtcatccctggccacaaaggctattatgttacacagttccagtaggatccattcgctttttgttttggagctgtgtagctataggtggtggccctgccaaacccatccctagttaaaatagcctcctctctagccactcttctcttttatcctattttattctccatagtacttctcactttgtaaaaatattgctatattttatgtatgtgttgtctgtttaccactgaaatgtaaggccagggcttttgtattattcactactttttccattacctggtacctagaacagtatgtggcacataataggtattcagtgagtatttgtttaataaatggatgagtatttaatagtgtgcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataaacatccttgaccattttaagggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtatgttgtggaaaaattccatgttgattctgtttgtgtgctcatagtatcatctgttgagatttctttgtatctgtttttacaacagattgctcacataatcccctttttaactttaattaatttttcaatccaattttaagattcacattaagtaatgttaaccagggctgccttaaaagcccctacttagtcaaaagcagtaagctactcttttttcccctgattatagcaacaagctaccttttctctccctttgctaacaaggtaaggtgctaatcaagcttgtccaacccacagcctgtggaccacatgcggcccagaacaactttgaatcaacacaaattcataaacttttaaaaaacattatgagttttcttgcgattttttttctccttttagctcatcagttatcattagtgttagtgtattttatgtgtggcccaagacaattcttccagtgtgacccagggaagccaaaaggttggacacccctgttgtaaatgaacagcagtctgtaggagaaaacttatttcttggaaatcttgatagcttccataaccatgttgtacctaaatggaaagataagattatttctttgtagctattttagtgttaaaatagtagaaaagaggggagattgaactctgagtacatacatatggtatgtactcatgaagtactcatgtgtatggtatgtactcatgtacagatgaagagtcatacaggcaacttgctcaagactcagaagaaattggggaggagatccagtggccagcatgtagaagagtgttggtaaacatccatcggataaatacagcaaagaaaaaattgggtcatcctttttagttatttaagggattttcataagaattttgagttcctgaaggataccctagtatattcgttgtagtcaaatggtacctgggttctcttagactagttatatgggtagcattagaaggaatgcaggtggcttgaattaagacaaaagtgacatttggaaacttttatttatttatttttgagatgggatctcactgttttgcccaacctggtcttaaacttcttagctcaagtggtccttccacttcagcctcccaagtagctggggtcacaggcatgtgcagccatacctggcctaggaaacgtctatagagagagatgggacttaaaatacttggccatttgtgagaaggttgctgtacagaggttcataattgtttcataattggttttattctttttattggaccacaaaactagggctttaaatttttaaattctaaattttaaaatttagaacactccttacttttgaaacggactttttttgtttgtttctgtttctgtgggcatgtttttataggacagccagagtatcacataactagtttcacttttgaaagtgaaaagtaaatttttaagatactttgtttcattcttcctgtctgcttagataaaaaattgcacgtttaacaatttggagcttttctactctgaaattatttatttatttatttttaaattgttttagagacaagctcttattctgtcacccaggctggagtgcagtggtgagatcatagcttactgcaagccggaactcttgggctcaagcgattctcttgtctcagcccccaagtaactgggactacaggcgtgcaccaccacacctggctaattttttttattttttgcagagacagggtcttgctctgttgcctaggccagtttcaaactcctgggctcaaggtatcctcctgccttggcctcccaaagtgctgaaattataggcacctggctgtaaaatagccaccatgcccagctattttctttaaagtcataaatatgggcatcttctctcttctgaatgcaaaatttatttggtaactcttctgggtgcttttctgtcgtttgtgctactactgaaatgccaactagaagtacagaatcatgtgtttggtcttgcatttaagctgtctccttaagtgctagagatgggagaagaatgtgagttttaaattgaagcagttgtcttttttgctttcagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggtttctttacatttttttaagagatttttattggaacttaagaagggaaggggataatttgatcttatcctctccctaccttgaaaaggatgagataaatgcctctgtgtgcctttctccctgccatcaaatctctctggagacacaaagttattcaaaatagtcttgcactgctttccctgactcaacacctctctgcaatcccaaagacagacccataggctatctaaaattatttgttgaatataaaaataatattgtcattgttttcttaaaaagaagcaaatggaaaacagcttaatttccacacagattagtattaatggaggactattaaagaagacttgatattccactcttaggttaatagggatggatttgtcactagttgacaactcaagtctagacccaaatgtataccttgcttttttgttgctatttccccatgtttcttttagtcttgccacaggtaacacactatgggaaaaaggttggtggaggaaggataagaaggggattttacattttgctgcttggaaagagaaacatttttaggttgtttctggtgttgatccttcccccattcccaccacaccactgttgagcattatggtagttcattgccaatgatctgtgtgtagcttagtaataaagtaaaatatattggtccagtaagtgttcttgactgtaatacaaataacagagataaatgtttccatctgtttttttgagatggagtttcactcttgttgccaaggttggaatgcaatggcataatctcggctc

SEQ ID NO: 58032 - DNA, 1060 bp, Homo sapiens
agttacacctataattctgggtgcaatgagagtgcatgagtaaatttagtcgttttcaaatctcatttgttttagctttcttttttgccaaactttataacatttgctattagtgtagaaaagaatgacagagtattctcttcattcttcagcctcttgcccgataaaggagtaagttgtgcaaagaaaaataactccaaagaagcccataaggtacagcaaacaatgtaaatttcaccgagatgaggtagaaagccacctttcttaaagccactttcttaaagataactatatcagattttggcttgaaaatagcagttgtggcactatcagtgtaaaccttccaaagactttccttcatgtggctgtagaatttgctcaaatcctaggctagatcactggtgtggaatagcttagtgagaggatgtgaatgaatttgacctcctttcctttttctcagcatcatattaaccccctgagtattaattggcttcacttgtctttgtaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttatt

SEQ ID NO: 58033 - DNA, 2915 bp, Homo sapiens
ctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttt

SEQ ID NO: 58034 - DNA, 2542 bp, Homo sapiens
ccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgccattgtgtgttgtcattatttttgaaataggtaattttgtgtgtatacagttaaatctcattgctattggatcttttggtctgatagaccaaagatacaacagaaaattacttctgttacttctttggggaaattaatggacttaaaatcagcagcattggatattttcccccagttaccttttagagcaattgctatattttattttcagggtcccaatcctgaagaaatccatcaaattttacagagtattttctaacattgagctcgttgtggttttgaattggggctagtacgagaggtactgagggtttgtcacaccatatgcattaatcagttggtatgcctagcatctgctagggtctctaatggcggttcttaaactttggggattatagtcctccttgaaaagctaatgaacctcatgaaacctcttcttataagtagcacaatattaaacatcaatttcagggcttcattgaaaccactgatccatgaccctcaggttctgttctttggcaggatgccaaagaagagtgaatggcccacaaagagcctggtagcacatacgcttttcaaaaggtcatgcacttacagctaaagccattaaggtgagtgaaacatctggctagttgtcctgagcttgggtaggggcaggattaccatatagttggtgcagattgctgtgaactgtataactcttggggcactgttcataggctgccatataaatgatcctttagagatgtgtaatatatatctgaggaggccttgggggtggggtggggtgataatggacataccatcgtaacttttttttttgatacagggtcttgttctgtcacccaggctgaagtgcagtggcgagaggttcacggcagccttgacctcctggctgaagcgatccagccatctcagccccccgagtagctgagaccacaggca

SEQ ID NO: 58035 - DNA, 1999 bp, Homo sapiens
catgcggtccaagcatttgcatttctatcaagttcccaggtgatgctgatgtttccggcctagaaaccacattctgagaaccactgctgaagtctaaggctaagggggaaaggtttggggagaggaagaggaacagtgggaaatggttaaggacaagattatgaaagcatcatggggatgagaatggatttttgttttgttttactaggcttaggcagatactccaatatttctgacacatacatacacggaaaaccttgcaagagtggagaaaagaagggagaggtgagtgagcacttattttaagtttagggcaaggggtgcaaaaaaatatcttttatagccttaaggatcactttcttgaacacccttactttacaacaacagatgtgatatcaagtatcacatggccaattcacacctttggtctggtaaccagctcttgccccctctcagtctagggcttgttccccttcatcattaacctctaagagaatcactagtgggaaataagctatgcttttgattcaaggtaaagagactcgaactttccagtgccctaaactgggaaatcttaaactccagcaaagtacaatgctcaaaactgggtaaagctgctaccttcgtaggggatacattttggagaaaattgcatctactttcttctttgtcttttctttttgtgtgagtgtgagtgtgcatgacagtttgtctatgtttgaaaacctgaccatcagcattcctggaattcttggcaatgaattaggattgccagttagctgcctgctgggtgaccttaggtagttcacctcgtgtctctaagcctcagcttcctaatctgtgaaacaggctgatggaccagtgagataacgcctgtgaggtgcttatcacctgatactgcctcttcttgctggcacatcaagctggaggattgcagcatctgaacacgaatgaccaatcaaatctcgggcctataccccacagacgtaacctttatctcccaccagagggcaccagtaacctataaaaatctaagggggcgggcggtccctcttgcccttaacatcgttgaatctgcttgagtataactcccttaagtctattgaaatattcttacccctggtgttttaagaaatcatttgaaaaatacctctcacacccagaaggaaaatatggagtagaagtgtagggtaaatggtgctccaactccccaccagccaccaagagagctctatttccattttgtattttgtccatttttaccattcagtctccatctcctcgagactatctgtaacctagttttacaaattattctctcagtaataacctattgcagttcccttcttcctggtttattcaaatgaactgaactgctgttttttttccctttgatgtacaacctcccgcctcctagcctatcgggccagccttccttccagcaggcagtagggggagggatctatttctgagcctcggtagagcctcagaagctgtttccctgaatccctctgtgatgagagcctagtggtcaacaggtacctatcacaaaaggctgtattccaggagaaaactctttccccatctaaggaagggaaacgactagaagttgaggctacccaccaccacctccctgaaaacattacagacttcagggactcaatgataaccaatgtgtatctgtgtcctgtatacacatagggtttgttctttgtctttgttctttaatttgctggggaaggaaatacagcctcgggctagctttcaccattgcacctgggagtgctggccgagacaagaaaagccaacaagaatattgactagaaaaagggtattggccaggcacagtggctcacgcctgtaattccagcactttgggaggctgaggcaggcggatcacctgaggtcaggagtctgagatcagaccggccaacatggatttgtactaaaaatacaaaaaactagccaagtgtggtggtgtgtgcctatagtcccagct

SEQ ID NO: 58036 - DNA, 1070 bp, Homo sapiens
gttcacgcccactctcctgcttgggccctgataactggggaagattcagggcagagaaagaggagtttacaggtctcaggaactgaggtgggttacacccagtaaatgacttcctaaaggtcaactagccaaagccatgccctcctctgtggcctgggccaggtggggcaggccaggtggatgctgggatggcccagagggcaaataatggacaatgaaccaggccagggcagcatctctgctgggcgggaaaaacaggaagctcaggcacatgcaagccaggtaagtgtgtgtcttgaagatggatgagagttcccagacaagggtgaccttttctttcacctcgtccagctagacagacgtggtggttccaaggccccttgtcatctgctgattgctttgtgattaatgtacaagtcacttattcccatctcctgtccctgctccattctcccccagctcccgggcagactcttctgcccttaggtaatttacttagaaatgattgtccctagaatctctccatgtgctttgtgtacagatagtgaccaggttctgcatgtgatttccctgtggaattccaaccaaggacagacaggtgagtcacagcactatggagagacttaaatatctgcaatgagcaaagcaaggctcagccgggggcagactcagtcctgcaggaattgcccttcttcctgcatggttttggggtcagctggagagcaatgagtttgcacatgctggtcattcaccagagctgcctgtggggtctcaacagagttccacctagaagggacagcctgaccctggtttacctgggaaccagagaaaagcagctggaaggctactctcaagtcaccaataccaagccaggtagaccctatcccctacaaatacaggaagccagtggtctccaatggacattattacttcattttcacacatattttattcactttgacctggggctcaaaacacagactgcatataaaatgggtttgatgctgatttggctacatggacttcataattcatcagagcaggaaagacagaatcataagctgttattc

SEQ ID NO: 58037 - DNA, 1048 bp, Homo sapiens
cgctgcccgggcttgtccccccaagcctgtgcgtgtgcgctgggggttactgctctcctcccatggaaatggccttggatttcctctaattaagacttaacatggctcctgacagacaggaagaatgagggtgagaggtcctggatactttatctgactttcctaagtcccaaaatagggaagggaaggggagtcaaagtgtattcgggggacgacgggacggtgggcgcagaggaaggatgggtggggctctgctcttcctcagccgccaccttgctctgtcacgtccctcttttctgagggacccagagtggccattgcgagagggagtctgaagagctacagtcctcagagaccttcagagactccagctgggcctccccgcctggaggagggaagggaagttctgtgttctttctcatcacaggcatttgtgctcccgaagcatcatagctctgcagcctggtgttttgcctgtaactggagaaatgcttgctgcaaagcaattttatgtgtggtagtagaaagaggctgagattccagtctcagctgtgtgaccgtgggtagatcacctaacctctctgagcctcatatttcccatctgccaactgcagagacaaatactgctctgctcacctcacgggattgtggtgtggatgggaaaagcctctgtgaatggctttccaaatgtgggggctgtagggacgaggatgactacagtggtggtgatgagcatgttagcactgacatgccagtttgccagcgggtggtgggctgggagcttaccttttgttaccacggcttgcattcagagttgtcagttttaatggctattgtgggagacagggtcctttagaaaaggacacgacgatgaggctggcgccaggtcaggagtaattaagagcatgtatatgtgcatacctgcattttttttgaggggagtgggctgggagtaccttcgatgctagataaatctggccagactccagccctggccaggccacctggccacctctagtctaggccctttggcatcagagaaccctga

SEQ ID NO: 58038 - DNA, 1066 bp, Homo sapiens
agggaacattttttagttctcagaagcattttccactcatttttttttttgacactttcttttcccttggcttctctgaccccacattcttggcttctctggtactcctgagtcgtctttgctgactcatccttcccgtcttgatctttaaatgttggtgttccttatggtctggctcaaggtattctcttctgattggatactctgtccctgggccatctcagccacacgaacggcttccgttgtcatccacatgcagatgacacccagcttcctagttggtgtcttttcttctgagccccatatccttatattcacctgcctagctgactaagctggatgtctcaagaaacctcagacttgacatactgaaagccagagtcgtgattctcctgctacatctcccactgccttctcacccgctgcctgatcctcctccagtgctgcctgttttgtgaatggcataacctcaaacctcagttctgcacgccatcaactgggagtcactgtcagctcttcccttttctctaccgccttacatccagcccatcaccaggccctgtctacctcctaaacagcacctgggtccatccactccactcctccccatctccacagcctccacactagttcaggctgactttgccttttcctcaggctgctggaatcaccttctcattggtatggctgtatccactcttgcatctccaattgtcagagaagccaagggaaaagaaagtgtcagaaaaaaacaaacaaacaaaaaaaaaaacgagtggaaatgcttctgagaactaaaaaatgttccctggctttggtaactgggtctctgaattgctgctggactgaccttttaaggacacaaatctgacctagtcacattatgttgtactctcaacactcttaagtgattcccatgctctttaggatggccagtgggatggtcccttgtggtatctgacctgtgcctgcactgaggcatccccactcccctccctcatgctctgcactctgcaccctggcctttttcagctctgactgctgagctccttttggcctcatggcc

SEQ ID NO: 58039 - DNA, 1051 bp, Homo sapiens
gactttgctgcatcccttttgcagaggagcctgggctggtgggcctggcagctgcatttgcctggccctggtgtcccttgaaccctgtcatttactcacctcccccttctactccccacacccttatgtcgtttatttgaaaggaaaaggaaactccatggcttttaaaaaaatgtattcattcaacaactgtttcttgagtgcctactgtgtgcctctcatgattttagaagctgaagatacagcggtaaacaaacctccatgtctcaagctgaccacacttgtatctggacttgccagctgattagctctgttcccaccaggctcgttcaaagacccacagcttgagggggcagaggtgaggaacatgaacaatgctagtgaattatcacactgagtgacctctaacatgccaggtaccgcttaagtcatcctgtccttaggatacttttctgacctgaaaggatggaccaggtcacatctcaccatttatctggcagcccagggcaagtagaaggctggtgcttcagacagagaagggggaaggaatcaaatttattattgaatacctattatgcaccagtctatgtgaggaacattacaaaagttattctgttcagtcgtgctgacaaccttctaatgtctgcattaccatcccctgtttcctagccaaggaaattgaggcctggagaggagaaaccacttgctccgggtcatatagatctccattttgaaatcacttgtatctgcagttgatttggccctatgatatctgtgacatctggtaacttgtacacttatactaaggcttacattctaacctaacttttcatggggccttatctcccagttagactattaatatgtataaggatttgctgaacggttgtgtgaataagctttcttaagtgatcaaggaaggcttcctgaaggaactgggaccctgaatgaggaggcagggagggcaatgacttttcctgtgtcatcctacacaggtatgtgacaacttgtaggcaggaagtccctcatcccacaccccacctgcattcag

SEQ ID NO: 58040 - DNA, 1141 bp, Homo sapiens
cagcgcgccaggcggggctgcgtccggagcatccttccctccgcctctgtcctggtccccgctcagcggccgctaggagcgcgaagggaggggcgcgggggcgcgcacgcagggtgtcgggggcgcgccggccgcccggggacgcgcacgggctggtctctgccctaatgcggcggctggcggcgagaggcgctgcaggggacgcgggggaagtggcggcgccggcagcggacagctcggacagcgcccagggccggagcccgagcccttggaggtaggcgagcgcgaacaccggagagatgggggtagagagtcatggaaacccacctagcgacacccccttgttcccgccctcgtctgtctccatcccctgacctgccccctccccctccgtccacattcccatcccttcccctctccacactgtcacctgccccgaatccatccgattctgttcgtatgcccaccccgtccccgtccagctcccagccccctgcccaccccaacaccctttctatctcgttggccgcgtcccctcccccttcccgcatcctcaaccctttccctttcctctctgtccccgcctcatccgtgagccctgcctgcccttgtacttctgtttacctcgacaccccactttggatgaccccatgcctcctgtatttcctaccgcacacatcagccccttcttgcctcccctattctcttccccatctcatgcccctaccagttggtgtcctgtctctccatttgctccctcagtttctgtcctcccctggttcccccttgcacgccctgtcccagccccttcccagctgcctcttggtgtcctcctgcatcacagtccctctcaagaaccccgccttctcccccctttggctgttagctggcctgacacccgtcaccttccctagctgcccttcctggtgctgtgtggagccatacagcctgtacccagccctccctcagtggcctctggaccccccttccctgggtggggatcttggttgtggaatataacccctttctgcatgttcgatcctatttgtggcttggggaagaatgctgggggttagtaggcctctctcttatgttcctctccagccatgcagccactctactcctctagctgttcaggttt

SEQ ID NO: 58041 - DNA, 1084 bp, Homo sapiens
catggctgaggggtcatagtgagcagtaggatctggagtgattgcaccaaactgtctggacagacccctgccttggcttgagcaagttgatgacaaacctttgggcacttacaatgcccagctaaggcccaggtctagctgcaagggcccaggcctaactgtaagggcagatgttggatgcatatggcctggtccctggactgcagaagagggcctgggagttaatggctgtgcggggtgcttgagtaggcacttccacagctttgctgacccaggacattggttagattgtgccagcttgagaactctcaggccacccttttttcattaggtcttgaggcaagccagaaaaaaataaaagtggcgtaataacaatagtcaccattatcgagttctttctatgtgctaggcaccctactctatgctttatatgcatcatttcatttcatcctcaaagggttaaccctacaaatgagatattgttaagttgctggttttacagaaaatgacagattcagagaagctgttacttgttgaagattacagaacaggtgagttgcagagctagaatctaaacctttatttgtttgacttcaaagcctgtgctcctctcccatatgtcgtactgagccccacctcccaccccctccccgcctccaaccccaggtagaaaaataaaaagctaggatgttttatccacatgcacaaggctttctaggaaaatctgttagaaggattcagttagaaggcatttttgaatgccttactttcttctgaaagatagaaatgtggttcctgctttcaaatagaagaaataagactgagacaggtaaaacaccttgagaacaagacaatacagggtctaattaaatcttcattggtgcctcagacctgggacggtaaaatttcaaagaaaagcatgatttgttagttggattaggttgttggagtcatggaggtgacatggcacagtagaaaccattcagcctttgcaaccagacagatctgcattcagaccctgcttctactacttgctagctgcatagctgcagctcatctgcaaaatggggatattaatatgaac

SEQ ID NO: 58042 - DNA, 1024 bp, Homo sapiens
catcttacttccaggtgtgttgtcaacagaatgtttatatcacctggtgccagtccccccatcctgaggggtcggtgactcctctcctccagtaggtttagcactgagatgaggtctgatgtctgctctcctcctgtccacccctttggcttcagctgtgatgctattgcaagggcacttcctggcagaagtcaccctagctaagctcttcagtaaaaggaaacaggaagggttgatttgcatggtctgaccagttagcgggtggagccccagtccaggtgcttatacatctatacctggagtagatctttatctcaagaccttattaggtatttgctgaggctaactgaacccacactgaaaagagaacaatatatagcttaccagactggaaactcaagcctgactacctaggaactgcagatatgcaatgggcttccaatatacatttctaatgcttctccctgaggtctgactaagcatatctggtccacatttgttctcttgatatcttctaatttggctgattcttctcttatgtatttcctgaaattcttcagggccagttttacaccacccagaactttcttaagctttgcttatgaattgttcaaagtttacttaaagtacagagtgtttaagcactgtattgcttcaatttgttctctgctaagtccccgcttttacattgttgctttctcctccttttttctctttgagtgtccctagagctttctctgtctgaaaactctttgtcccatttttgagtgtacatggtcagtatgttgctcctctggttggaatagaaacttccagttaggcctgggcccaaaacaaatcccctgtcacccagaagcctggcccgttctgtgtaacaccattaaatgctccatctgaccacagaggcctggggttttaatgcttaatctttttattcccactgacctgtggttattccagcacaacctgtccttttattttaggaatcagcatgaagcctagtgggctcctgggacatggatgg

SEQ ID NO: 58043 - DNA, 1005 bp, Homo sapiens
ccttcctcccttcctttctccctttctctctttctctctctttctctctttctttcacggaatttcactcttgttgtccaggctgaagtgcaaaggggtgatctcggctcacctcactgcaacccctgcctcctgggttcaagcgattctcctgccttagcctcccgagtagctgggattacaggcatgcaccactatgcccagctaattttgtatttttacaaaattagtagatacgggggtttttagtacagacggggtttctccacgttggtcgggctggtcttgaactcctgatctcaggtgatccgcttgcttcggcctcccaaagtgctgggattacaggcatgagccactgtgcctggccccaggtttgtttctctaaggctacattgtgcaatgccagagtgcatgcatctggtcttggaaatagaatatggagcaagagccagggcccagaaccacactgcctgggtttccatttggctctctgttcaccagttgtgtgatttcggcaaatgacttacatcttccctaattttcatttgtaaagtggagagttaagtagggcttacccttcatgggttgttaggattaaaataagtaatgcacatgaacccctttgcctagtgcctggtaaagtagaaatgccctatgaaagttagctgttgtattcttgccccactcccttcctgagggtagcttcatgctctgccttattcaagtacacctgatggctttggtgagcaaccataaaatgtttttgagcctcaaataagtgcttaattgtacgctagatactgtgggtattacagtggagacaaagaggcagtttttgcctaaaaagcccttatattccagtagagaaagtatgccaggcatccatgcatggtaaagataactacacaggtactaaaggacaactgcaggctgggcgcggtggctcatgcctgtaatcccagcgctttgggaggctgaggcaagcagatcacttgggctcaatgt

SEQ ID NO: 58044 - DNA, 1368 bp, Homo sapiens
gtcttatctgtgttttactgtccactctttctggctgcttgtagttaaaagagaaatgttttccttgaaatgcatgaggctagaaagggagctggaacttaaagtggcggtgtatgtccgagatgatggtgctcctgctctgtcagtcaggaattcaaaaccagcctggccaacatggtaaaaccctgtctctactaaaatacaaaaaaaaaaaaaatagctgggcgtgatggtgagcacttgtaatcccagctacttgggaggctgaggcaggagaattgcttgaacctgggaggcggaggttgcagtgagctgaaattgtgccactgcactccagcctgggcgacagagtgagactccatctcaaaaaaataataataataataaaataaaggacaactgcaaatggctggttgagaccacagaagctcctggagtgtaggaaagggagaggacattttaatctgtggtacctagaaagacttaaaggaggagatttggggtggaaccttgaaagatgaaactctggccaggcatggtggttcacacctataatcccagcactttgggaggaccagtcaggaggatcccttgaggccaggaatttgagaccaacctgggcagcatagcgaaatgccatttctaaaaaaattttttaaaaatcagctaggcatggtggcacagctatagccctagttacttgggaggctgaggcaggaggatcgcttgagcccagaagtttcaggtcacagcgagctatgattgcaccactgcacaccgcgtgtgtggtaggctgagacctctgactcttgctcccaataagctcatgaggttatggctccacgggggaaggggctggaattcggaagaaatggacaatccagttatcctcaagccctgattgccttcatgctggccacacctacagggacaaaggatggaaggaggaagggatgacttctgatttaaaaatggggcccatggctgggcgccgtggctcacacctgtaatcccagcattttgggaggctgaggtgggaggattgcttgagcccaggagtttgaggccagccagagcaagacagtgagaagtgagatcctgtctatacaaaaaaaaaaaaagagggccagggagggtaaggagactgacacaagaaggttagtcaacaaaacaggtagaagtgaggtgttatgtttcagagtagggaattggaatccatttctcatagtaagccattttcctgtgatctaattgtgtccttatacccttgttccaccaggttaatacactaagccaatatattatttcctccataaagatggggaaactaatgcacagagagcttggtggccatttgggagtgcggca

SEQ ID NO: 58045 - DNA, 2394 bp, Homo sapiens
ttttggactgtttccacctttctgctattatgcatagtgctgctatgaacacataagtacatgtgcttgtttgagtacctgctttcgattctttggggcatttatatacctaggaatggaattgcagggtcatgtggtaattctgtgtttagcttgtggaggaaatgctaagctgttttctagaggctgcaccatgttatgttcccaccagcagtgcatgagggctccagtttcccctcctcttccttgctagtgcttgtcttttgacttgaagatgaccccttacaattttacacactgaactcagcacagcaggtgccaccttttcctcaaagtgggcccaaaatcccacccagcttgggccaggagccttggccacttctcgattctgcttcccatacttgctctggcatcgccaaccttgtcttctcttaggttgggagactggacttgtagaagttggaatatcctgctgtgatggtcatcggagcagaataacccaaaatatatgcagtttcctgcacggcgtgcccctgcctgcctagcaacaggtcaattggctggtttctgggctgggctgtcctgcctgcccctcgagtgccctctgtctcccctgtcgcagcccccagaatcccattgtgtgaccacgtgggatctcaaagtctgctgaccctgctgctgggatgttttcagtcctgcttgggtgccccaaaatgtcagctggcttgaagggatgtacactgctagtagggtggtgtttttgtttgctagggctgacaaaacaaagtaccacaaccctggtggcttcaacaacagaaacttctttccccacaattctggaagctggaagcctgagatcaaattgttgacagggttggtttcttttgcagggtcctctacttggctgcagatggccacttctccctgtgtctccatgtggtcctccctctgcaaatgtctgtgtcctagtctccttcttcttcttctttttttttttttttttgagatggagtttcactcttgtcacccaggctggagtgcaatggcgcgatctcagcttactacggcctccacctccggggttcaagcaattctcctgtctcagcctcccaagtagctaggattacaggcgcctgccgtaacccccagctaatttttgtatttttagtagagatggggtttcaccatgctggccaggctggttttgaactcctaacctcaggtgatccacctgcctcagcctcccaaagtgctgggattataggtgtgagccaccgaggctggcctaatctcctcttcttataaggatgccagtcatattggattaaggcctacccatgtgagctccttttaccttaattacctctttaaaggtcctgtctccaaatactgctcagtcatattctgcacccataccgggatagaacaccaaatgtgcataataataagggagggggaagggcatctgggagaggccttgtggttcctctgggctcctgttttggtctgagtgactcatccaagcaaatacagaacaggtggaggggaagagagtcatgatggcaacgaagagggcactggggacttcggggaggtgggagaagcagtgtccatgatcaataatttattcctggatactaggcaggagggcgttgtcatggcaacaggcagctccagcagggactcctctggagtcccctctcctcactccctccgctccccctcctgccttccctgctttctcttgccgcttcccttcctcatcattttccttgactgtctcaggaggctttttgcggagtggagactgcctgcacctgctccgtgtaggagctctggggctcccaacagccatggcagctccttccccaccggggtcgtaaccctgactcttctttctggaaagaccccagtgaggggccatctcactgattccccaccgccaggcatcttgctttagtggaagcacacggggcactcctttatctcacagccggttttaccacccgtctcttgccctccgctattcagttgaatgcactgactttttttttttttttttgagacagagtcttgctctgtcgcccaggctggagtgcagtgacgcagtctcggctcactgcagcctctgcctcccgggtgccagcgattctcctacctcagtctcttgggtagctggtattacaggcgcatgccaacacgcctggctaatttttataatcttagtagagacggggtttcgccatgttggccaggctggtcttgaactcctgacctcaggtgatccacccacctcggcgaatgcactgacttctaaccatgctctgctcactgtgccaggtgcttctgtcctcagagagatcccccaagccaggcagccgggcagggtcttcc

SEQ ID NO: 58046 - DNA, 1086 bp, Homo sapiens
ggatatgattccagtgtggatggggcttttggagctatgccgagcccttgagaggtcagttcttaggtaaccatgcttccaagaattaagaagctggcagacctgtctcatttgaccttgaaaaggctctttcagctaccgatcctgagtccagaaagggtaaaaggcttttcccagccctacagcaccctggggctggaaactctcaggcctgtgccttatacttgctcagctctaaaggccctgaggcagtgagcactctttccactcacagcttgctgcataggtgaactcaagtttagtaaacattcactgcaagcctgtgtgtgcaatacatcaaactaggcaccttggaagctgcaaaggacataatatgaactccctgactataagtttttcatcatctggtagaggaggaaatatctgcacatatcattacaatgaatctttgcttagtgatggagatacataatgtcctttggaagccagggcaggagagttcatgtcccaccttgagagatttggtgtaccatatccatggttagtgcgtggacatgaagggttggattggcttcctggaggaggtggcattggtactgggccttagaggatgaataggatttgttgggcaaattttactccagagatggagtaaaggaattgtaggcaaagaaacaaaaaaagcagcagtgtagatgttactatcctggacatttggagaaaaacaggtgcagtcggattactgaatgctgacaaggggggacccctagatgtcagcctggaggagctagatttgattttgcagaaacagggagtccctgttggatttgcacatggaagatttatttagtgttgctcctaattggagagcattctggtaacaacagggagaccatgggactgctccacccacacagaaacagaaatacaatacccatatccagataggcatatgtgcccacaaacacacatacaggaactaggacaaacaaacacactgagacctagagacccacatatcaaaacacatagtcatactatcagaactcaccacacacacacacacacacacacacacacactaca

SEQ ID NO: 58047 - DNA, 1247 bp, Homo sapiens
tttctcactgaattctgggagaatgtttaccatgtgcttttctattattttaccagttaaaagacaaaacttctcttttgcaattctaatttgaaattgaaagatgtttttcataaaagtggattttggtttcttaggatagtgtctctcacactggggtatatagacgcccggggttctcaggtatgctcatgggagtctgggaggtattctttcctttggaatacgcctacatatgagtcaagtttgggaaaacccgtgtatagctgctggaggccatggataagggctgaaggtcaagcataagggctagaggtagggtgtgttggagttgtctccagagaactttctagaaagccgatcttaaacagtagttacaaggaaggggtgagcctcaacacaggatagaatggcactggatgactcgcactgggagcccagcttatgtgaatgcagagaagctatatgtggcaagcactataggccataaggggcttggctgaaacacggcagcctgactgaataggagtttcaacttggatagaacaaggtgcagagttgagggcacttcataccccaaaagtcgaaatttgagtgagtgacagctgtgcagggctggggcggcactggagcagcgacccataaactctgctttctagccccttccccatcacttacatcccattgaagtcatgtcagcatgaaggccccaccagggagcatcgaccccgctctgtggcctgtgcagctggggtgtggagtatatgtgctcaggagtcagctggcaggtggaagatgacccagccctccggaggatggtccccagctcaccagcttgcagtcctttgtttaaccaggaacctagcaggccagaggtcagcatttttcttggaagactgtcaaagcatgcctgtagctgaagaggagcagggtcagattcccagggagtgggccagcataaggtcctatcactgcttagttctgcactgtctgcagtctggctggtgccagcagcatgggattggcagggcagcttccatagtctggccatagaaccacaggcctgagccactggaaggccctttacaagccacacagtgacctccatgctgcagggatgagtggtgcctgagtcccagagagttactggaagatctgagacctgaacccggatgtcctgacacctagcgtggtgctccctctgccatctcctgatcaggacagggaacccaggtgggtaacccagt

SEQ ID NO: 58048 - DNA, 1044 bp, Homo sapiens
aggcccagggagacgcaactcccttgcctagtgttatagaactagttactgacaaagttggaactggagcccagggattctgtatgcccattctagtgctctaaaatgatcatttcttggttgaagacttcttagcatgactgtaggttcttaccattttgcaggaccctatcgaattcaaatattccagcctgttatcctttttagcacaactgtgtcatgatttttatttcatcacaggaagagcctgtgtttaatttgcctcattaaaaaaaattgtgataaaatatacataatataaaatgtaccattttaatcatttcagttgtatggttctgtgatattaagtacatgtatgttgctgtgtgcatctacattgccgccatccatctccagaactttctcatcttcccaaaattaaaactctactcattaaacaataactccctattccctcctcccccaagcacctgggaaccgtcattctgctttctgtctctatgaatttgacctctctaggtaggtcatatgagtaaaatcatacagtattcgtccttttgtgagtggcttatttcacttagcatgaatgtcttcaaggttcatccaggttgtagcatgagtcaaaatttccttcttccaaatactgaataatagacctttatttgcatggatataccacattttgtttatccattgtcaatggacatttgggttgtttccaccttttagcttttgcaaatcatgttgctatgaacatgggtgtacaaacagctcttcaagtgcctgcttccaattctttggcatatctgtacctggatatgatgtggaattgctggattatgtggtaattccatgtttaatttttttgaggagcctgattggcttttttttttttttttttttttttttttttgagacagggtcttactctgttgctgtcacccaggctggggtaagatcatggctcactgtagcttcgaactcccaggctcaaacagtcctcccacctcagcctcccaagtagctgggaccacaggtgtgtac

SEQ ID NO: 58049 - DNA, 1025 bp, Homo sapiens
gctttttttgcctggccactttggaatcttcagcttatcaactctttgtacctggatgtatcacctcatagttataagcatcatgtcctaaaatagtcaacttcttggtaggaataagatatcaggcctctgctgtatctttggcagagattaaaaaaatatttgtcaaaagtttccccagctgacttcctcatgcctcattggccaacttggccatatgcccatccttaaaccaactactggcaaaggggaatgttattatcatgcttggcttagccaaatcatgtcttatcccttggagctggggaagaagatgggaatggctgttgggtaggaggaaatgcattttgtcttccatactcatttttaggggatggggttccttgtaatttagtttcaaaaacattcaattcaacatttattgagtgcttactgtgtatcaagaacagttgttttaccattgaggcaaatattaattacaaagagcctagatattagcatgctgagtagatccttctgcctaccacctcttgttggccctctgttattccttggaattctttctagttgggatgctaaaccagtcctctgccctcctggcctccccttcagctcctccctttaaaacattttaccacctattccccttttgatttttaatcagtctccctcagtctcaccttccatcagtcaacctcagtgtcaccttcaagcttgttttcttactgtttttcttcctgcatcatccactgtcttctgagtcatgcctttcattatgccattctcaggagtcatctgctcacctctgctgactattcccgatttggacaccatccctggctccagaagttctagtgattccctattgcctgttacatgaggtctttagcctggcagaaggttatctacctaattactaacagtgttgcctccaaaagagacttgaatgagagaagggagcattgaggggtttattcacttaatctttattctttgaatctttttactgctggaatgtcttctgt

SEQ ID NO: 58050 - DNA, 1049 bp, Homo sapiens
tcctgctttgttccagttctttgaggactaagaaaataatttttaaaacaataaccctccttcctgggctgtcacttgtttgtttgctctggggactgcccagtaactctttggtctctgttatttgtgtttaaactctgtgtttctacccacaagtaggaattggtagaaggaagaaggtagaaggaagaaggttcataggaaaggctggtgatgtattaattgtgccattccatgtgtgttgtacactcaggaagggacacaagccagggtctctcattcatttgttcgtttagtcatccattcatcaaacactttccaggtcttggttttgtgtctaggccattgtgggaactatttgtggcagcaaagaagtaaatatatggtttttgacccaagaaactataatcggcatataaaaaaattattattattaatggcagccgatgccatttattgaattccttgtactctgatcagaaacaaagctagagacattatagatattggtcagtttaatcatcagacatttcttgaatgcttttcatctaggcactgcgctaggggctgggatagggcaagaagcagcccggggctcaagtctggcaggaattacaagagtaatggtaggtatgcaaaggggcctttccattctcaaaggtgctccttctagcagcatcagactacctggagcttgttagaaatactgactgtaggttcccccccttccccccgacccagacatgctgattcagaacctgtgcattttaacaaggtcactgggtgtttcattcatgtgtacattgaagtttgggaagcactggtgagtagcctgggatgtagcttggtctaggctaggatatcaaggaaggcctttctgaggaagtgacttttaagctgagatgtgacaaatgagtagagactagctagacaagacaatgacagatggagggtggggtgagttccaggcaatagaagtgcctgtgggcaggctgggactatgaggtcctgtgtgatagtgatagcagagcagaggaggaaaccccgga

SEQ ID NO: 58051 - DNA, 1032 bp, Homo sapiens
cagtcattaagatatgaatgctgaaagaaagaagtgttggagctggttagcaaccccagacactccctgtcatcagtccgacatgctgcgtcctgcctttgttgctggggagtgtcttccacacctactctccttgcttccagcccagacctcattcagaggaacgaatgaggtgtctgcagcgtggctgcttcatctgaccttctggaatctagggacagcaaccaagtgcctagcaaactgaccatggtctcctccttgctgtgacccagagctgctcttcttgcaaattggaagatatcaggtgccttgttggtctctagtcctccctggagtatcaggtatccttcctggaaccttcctatgcctgagtcagagggacagtctatttcctggattctaagtttcacttttaactaaccctaaagtcctatgactggtgataaaagcactggtggtaattgtgatttcattcatctttaaggattatctgtctgtctatatatctgtccatctatcctcaaatcacagccctcatttgatctctacagcaatcctataggtagatctgatctctcatttttaaatggcagtaaaatatttgtacgaagattttgttttccaagtactttcctctgtgttatctcattgctgtcccctgacactctcatctaggtgaggaaggatttattaacccagatatatcaatgagggtattggagagtcaactgtgtggaatagtgggcctttgagataagaacatgtgggtttgactcacatggattcttttttgttttttttgtttgtttgttttttgtttttttatttttattttttgtagagacaaggttttgccatgttgcccaggctggtctcgaaccgctgggctcaagccatccacctgtctcagccttccagggtgctgggattacaggcgtgagtcactgtgtccagcatcacatggattctttacacctatttcctcaggtgtaaaatggggataataatatctatatcaggctgggcacggtg

SEQ ID NO: 58052 - DNA, 1034 bp, Homo sapiens
agcgctttgcaaccagacttctagacaaatggtgcatcttataactcaggaaaatcctcattctgttggctgcctccccctttttgctcccacctcccctcccccatgcctcctgtattttcacatctcctccagcctgtagaagcctgccaggatagcagttggatccagactgatgtctgtatgggatgtaaatgcagaaggctgcagggagggagagaaggaacaggtgctgctccctcctgctgtcttagttctttcctctctatgctcccgcttatcacatcagacaggaatttaaaaaatgcaaccggggatgtgctgtccttgaaatatcagcagctaaaccaatattggcagctgaattgatgtcaattcagaagacccagctccctctctggggctgactccagctgtttggtggatgtcagagctggtgggacattggtggaagaagctggggtggagtgctttgcttgtagaaaccatggcaaaggcaggagagaggggagcccagaggggatttggctggcctgggattttataggagcctcccttcctctctggtctaaagtagactgcctgtgcagataaccatctgttggctctaagagtaaacaataattccttaggtatagagctagggtatggtgtctgcacaggcatcgtctacactgtagatctacaaagtagatgtgaaaccccatcttgtccaaagccttatcgcaaatcagtataccagctgtaacttgggggagaggagaaagggccaatcgtttattttgtttgctttgttttgttttgttttgagatggagttttgctctgtcacctaggctggagtgcagtggtgcaatctgggctcactgcaatcttcacctcccaggttcaagtgattctccggcctcagcctctcgtgtagctgggattacaggtgcccgccacatggctggctaatttttgtatttttaatagagacagggtttcactgtgttggccaggctggtcttgaactcctgaacctcatgatccacc

SEQ ID NO: 58053 - DNA, 1296 bp, Homo sapiens
acagctttattgagatacaattcatgttataatatttactatataaattatagaattcaggctgggcacagtggctcacacctgtaatcccagcactttgggaggctgaggcgggtggatcacttgaggtcaggtgttcgagaccagcctggtcaacatggtgaaaccccgtctctactaaaaatataaaaattagctggtgcacggcagcgggtgcctgtattcccagctactcgggagactgaggcaggagaatcgcttgaaccctggaggcagaggttgcagtgagccgagatggcgccactgcactctggcctggatgacagagggagactccatctcaaaaatagatagatgatagatagatagatggatggatgatacaattcagtgatttttagtgcccatagacttgagcagccatcatcacaatggattttaggacatttttatcgccactcccagcccccgcaagaatctatgccattgttagtcactcctcttccccacctccacccccagccctaggcaaccactgatctattttctagagatttgcctattctggacatttcatataaatggaatcatacaatatgcggtctttgtgtctggcttcttttccttagcaagatgttttgagagttccccacatcagtaattcatttctttttatggctgaatgatattcctctgtgtagatatactgcattttgcttattcatctgatggaattactgggtcatactgtaggtctgtgtttgaccttttgaagatccctagaccttttaatgctaattccaaggcccctttctggacttctaccttcagctcctgaagtatttttatactctacaaaagtatactctataaaaaatactctctaccacctgggtccctcctccttagccttcccaaatcttgggtccccacccttagggacctgtcacacaagattatcactccccacctcaccatccccctccctctgaccactcttctttaatgacagagcccctggagacagctgctgcctgacaccttgataccccacgccttctccacccacttggagccgggagggggtggggtaacttcacaagcctctccctccagctgtgaagaaggatgtgtgtctaattgctgtgaaaacttcctccctgaggggagcagacagggagccaaggcaagtgagaagctgggttcttgaattgtagagaggtgggggctcttctccgtggtggtgggatcggaattcctccccagaggggggagttcgcttcttgcttttcagca

SEQ ID NO: 58054 - DNA, 1706 bp, Homo sapiens
gccaagccagagcctcaggatgaaagagaaaggaagagactgagaatggaggtgttgttgattctgaggctgctgcctggggtgtctgaatccctcaattctgagagtctgtagagtggagcaaatagggtgacattgagtgtggccctgacaggtcagacagaaagctctgagagtcagcagggggagatttgagaaagaaagatgagcatgtctgcagagccggggcaggctctgctacagggacaggatgctggttagatgttattgttaggttattgcttttgttgttattactcaggcttatactgtacaacagatctatcccgtgttatagcaaccaaggatttattgtactgattcattgatgagctattaaaatatctcccagtaataggaagtatctgataggatgtctgtccactcatcccacgtgtgtttattgtactgtctcaggagagacaagacatggactctgagcttaacatcagagtctgatgcaggagatggatttgggaataaactcatcccatgaggcaggaggaaatgaccagtggaacagagcatggggcatgctaggaagcacaagagaaactgccacccactttcaatgggaaggcagcaaccctgttgtggaggggtggcccacttagggccttggcaaaaagggaatttgcactgtggagaaggaagagaatagcatttctggcgtcagcaaagtgggagcagagatggcaggaggtgcagaaagcacgtggcctatacaggcctggaggctggtgtggggatataggagggcagatgctgggagaggagaagccacacaggggtcaggagctgggtcataccagggcttgagggctgctctgagaaggcagattttatccctcagattcctggatgactttttctggacaaatcctggagttgtcctggatgacaaatgtaatagaggctaggcccaggcaggacacacactggctccttattctttaagaagaagaaaaaaaaaagaatatgaatgagaatgtagttattataatgttaataacctgagctgctctgcaaacattattactttgtattaggaacaaatttcttgacaaatacatatgatcattagttccaactaaaaggagctgctgcctgtccacatggaaccctccatcccaatgagggataaatctgagctcttttcagatctcccgtgtacccacatgcatactccttaattttgtatacttctatttcctcctatttcagctcctctctctcagtcctgaacaagttgtttccaggcagctgtagtgataagccctgctacatttttttatcccaatgcagaatggctgagttttgcattggctctgttgggcttttattatctctttgttccccaacaatttcctgtggcagtgatgtgtgaatgtatttctcccttggttcttgtagtactattctagtcacttgactagtttattctaagaactaattgctggcatgtggccttggtagcagtaatctgttggtgtatccctaggcactaactcatgtgcacaaccttggaatacctgacgaactgtttcattcatggctcttagacatttcaaactgaatatattctgttccatgcttgtgatctccctgcatcccagtgactaccagactcactctcccttctgtgttcttggtgtcaattattagag

SEQ ID NO: 58055 - DNA, 1802 bp, Homo sapiens
agttgatgttagggttcactcttggagttctatgggtttggacaaatgtattatataatgacaagtatctactattagggcatcatacagagaagtttcactgccctaaacaccctcctctgtgctctgtctattcatccctcaacctgcacccccagcaaccacagatctttctagtgtctctatagttttgccttttccagaatgtcatgcggttgtaaccacacagtgtgcagccttttcagactggcttccttcacttggtagtgtgcctttccttcatgtctttccatggcttggtagctcacttcttttgggcactgagtaatattccattggatgtacctccgtttctccatccgctgatgggagaacgtcctggttgcttctgtctgggttttggcaaaattatcaacaaagctgttaaacatccacgtgcaggtcggttgtgttttctccgttgcacttattgctactggatttttggttcaacatatatttactgtcctccctgctgggatggaagctccatgagagtagagggactttgtctcttgtccatgcatgtgttctctagaataatccctgccatccagtcggctatgtgaatgaatccctgcccactgcatgcagcccaaaagtctgagatggctttccctccaggagacgaagagctgccagctgagccatgtctcgacgctgccagtcttctctccttgtcacttcagatgtgttgtgaccaccaggacagcctgcccagaacgtggctgtgggaatgtgaggagctcccgatggcgacagctcgtgggagccacgggatctcatccatctgccagggacagcttgtggaatcaacaccacgggcccccaatgtggggaaagaaaccagggcccagaagaaaaggaaaaacagaaaagcaggctgtgaccatggatgcgtcattattacagccacttactactcatattggtcatgtcgtggaggtggacagaatgcttccctcatccctttgagctcaaacccactcaggggcagcagctgacattttttaagcatttacgctgtgccccatgctttaccaagtgttttacataggaattgtgtgataaatcctcacagcagccttctagaattggtgctattgttatccccatttttcagatgataaatacaaagcttccaagcttcagtgcttgcccaagccccccaccctgccgccggctcccatacttttaagtgggaagtggcctcaaaccaggcagtctaaccatgcagccaatgctctcgaactagacaagacaccaccatgtccagaggtcttctaccaggcagatcattagcaaactcacatgtgacatcttggacattttgaatctgaatcactcacaagccttgcagatttaaaggccttgtgttcaggcaggttgcccatgtgtgtggaccatccctgtgtgagataacaggttctaagagcattaaaaacaatctacaacctgatttggcccctgcctagaagattgagggcccgggaatctgtatgtttgaagagtgtccaggtgactctgaaaagcatccagccttcctcctgtgtgggaatgttgtcagtaacacacctaaccaatgccatttggagtttttatgaaacagtacttaacatggcagaacatgtcaccttcaggtagttctattctcttttcttcctgtatggatggatgtgtgtgtgtgtgtgtgtgtgtgtgtgtgtgtgtgtgtgtgtgtgtgtagggggattgggagacctcagatatacatgagctgaatt

SEQ ID NO: 58056 - DNA, 1012 bp, Homo sapiens
cggggagcatgtgttcagaagccatagatttttgctttccccctggacttttcattcctttgtctcctgcccaggcagccctgggcaaatggcgaagcaaatgtctcttcagtcttctaggggccacacgaaataattattttggatcttttcatgagtcttagtctcaagattttccttcatgcatagcatgtacggcagggcccttgtcctgccacactctgcccctcctctgggatctctcttcccttccctgctgtggctcttcctgcacctcttgttctgagcttaactctggcttctccaggctgccctctctaagcccccagaatcctcgccacatctcactcaagtcaagtaggaaggcttcaaagtcaccatggctttgccctgatgctggcagctcgcagctccccacaaggagccctcactctgaaaaagtcagcctgcaacaacagtacagtagtctgcacctgcatgaaatgagaatgccatgttactttctgatatattcatcaggaaaaaacatttgaaagtcacagcaacacatgttcccttttctgcacattttaaccaagaccttgtccccacaaaaagcacaccatctaaaaccttcctatgcagagtgtggttcacacaccaccagcatggcattgccccagcacttgtcagaaaggcagagtcccaggccccaccccagcccaactgaatcagaacctgcattttaaccagcccccaggtgatgcatgttaaaatttgagaagcccagacctcagatacatacatccacctgcacaggagcacacctatacaagcacatgcacacttcaggtaggagctgggggagatttgtgccacctgcctccttaccttctttgtgaaaagcacagaaaggagctgtagcctctgcttcatctctggagcctcccattgagaagcatgatttctataaggcaatgtaccatgaatagaagcaatgtaccatgaaaggggcatttgcctctagagtctt

SEQ ID NO: 58057 - DNA, 1048 bp, Homo sapiens
agaagaagtaagggatgtttgttaattcttcatttctaggtcctctattccactgaaaactctttcctccgaatggcgagagaccccctaggtgattggaacagagccccatcagcttcctggagttctcccaggggcagctctggctgggagcaagttctgggcatctgagccagcccagaattgggcacacttgcttaaaatagcacagtggtgctctctctactttcctgtctggagaggacacaggctttctcttgtaccttcagaaccaggtctggggtgggaggcaaagcagtcaggcaggggcagcttcaaaggccctattctcaccaggcactcctgtcacagtttgcccatttgggaagaaataaatctcatcatgtcccatttttattacctgcattgaaggaagttgacaatggtatgtaatgcaaaatactgggtaatctgaaatcatttttaaaacctgggatgcagtcaaagataagcagtggagttgggctacagagctgggcccgtcccactctgcctatgctgtaacaggtgctgggtgcctcctgatgcaataagaggcaactgtggtaagcgaggagggtcctccctaaggcagacaccagggcacaccccttcttcctccagtgtctaagtgacattcttggagcagtcaaagaagtttccgtgaatttctcacatgtgctccagaattcacaaaccacgaggtcagttctgggcgtgggctacttctctggagagagataggttacatttcacctggtgatatgggagcatgaaggaagggccctgtcatctgtatgtgccaccatccacccccaggagaggaacagagttgcctcccaagcccagctgcagcccccacctgcccttgggccaccccatctcttcgttacattgtggatttattcctgcctttagctccagatggacccaagcagacttcccaaacaggctgggtctttacaacaaaccccatcttaagagagagttctgaataatgaaaatcttcctaccaggtggcaagcagatt

SEQ ID NO: 58058 - DNA, 1049 bp, Homo sapiens
gatcatagtggtgcccacctgggcagactccagtgacacatgttgctgggtgtggccagggccccttggcccaactcttttggtcaatgacctcctcccatttaccaccaacctcctgcagcttagcttctgcccaggcagcactttgctcttccccggagctcactaacactcctttctctttagctgctccaagagctagcctgacccagagtcctgggaactgaggattttgataagaaggagttgttcaaaagatggctacaggacaccactaatccttctctcatttgtttgaaaatatagcaggaccaattaattaaagttcaaacctaatttctttaattttaaaaaaaccattactgtattattgccttcttttgcaggatttaacctttttttctccttttgtgggctgttttgtgttgcttgttcttcactgagcgtattgcctttccaaatatgccgtgtctttcctttgcaaaagaccactgctgccctcctcagttgtttttctggctttgcatttgttttctctccccgtttatgcctctgtgacttctccgtggcctcctgtttgctcaccctcttttgtttgttacagaccacccttataatgactcgtccttaagaaaccaccctgacatgtacagtggtgagtcgcagcggtaaccttgggagtaaccttgcctgtgctaaccccagtttgcctaacttgactgataccacgtcattaactcctgctgggtggcagctggcccagccagggtgccaaggtgacacctccagaaggctgcctgccaggaggcagtgtgggggtttgaggtggctcacctggtggtgtggtctcctctaacaggcatgcctcaagttgctgaattctcaacaagttgttcaaaccagggtaggacttcaaaagaacttcttgaaaagcaggaacttttactgaaaaagtagaagcttaggaatcaagaatggatgaagggagactatcttaaaataggtgagttccatagtgaagagaaaacaggaagtctggttcctattgg

SEQ ID NO: 58059 - DNA, 1674 bp, Homo sapiens
ccaccagctctagtatccttcctagattttcatatgagttcctcctgctgcaattgactgcatttcttcataacctttcctttagggccagccatctcattccttaatgatattatgtcccccaaatcttcttcaagttttccatgcctttaagaatccaactgaggtgcctttagagctgctgaattccctcctcagcttctttttctccaccttgggcccgagttttttttaatagccactgaggagaggtgggatcttagctgagacagtgagaatagtaaaacatagtggaagagtttcaccagagcagctcactaagacagaaatatctttctcctttacctcttttgcccttgcattttctttggtttgaataagaaagatattcctgaagctgactgtcagaagtaggaacaagtgggatgcccatctttagacagagaggcaatgtagagtgggtggaaagcacacgtttttggtgctaaatggcacagaatccaaaacataactagcttggaaccttgggcaagtctgttgacttcactgagcctcagttgcctctgctgaaaatggggatacaaccctccaggtttgctgtgaggattaagcataaatggtggtgtggatggagctgtcagcacagtgcatggtccctagcaaacgttcactgaatggtggccctgattatgacctccaacttttaggatgctcttctctttttttgaactttggcttgtttccagtagcttctccttctttaggataattctattgttgctagcccacatcctacaaatgcaatattgctgtaacctctttatagtcacagctacagtgtgtcaaggcacccacagcagaactctgtgctaaattttcctccttcccatcattattgctttgctgggttgtgcgtgctggtggtgtcgcgcgttatggtgtaaattaaacgtccatagggtcacagattggtttctgcagatttcctcccagtgtggaaggagtatgacgacttagctgggacctacctcttccacagaatcccagggttcccagctcttgacggattcaccaacctgacaacagagccttctgccctagaatctcctttcctcatagtgcccatgtgtcttggttgttttggtgattccgtgatggtgggtgggaggaagctgttggtgtcaggcttccttggtgctgagaattggatgctacaagagttatagacatagatgataaccaattaaccacataatggattaaccccttcagtagtcactgttgtaatgtgtgtgctggtgggacagatgaggcatctacagaaagagaaataatatgggttaaactgctgccttattttttgttctcttcttcccctccaatccattcaccttataaaccttcattgagcatttgctgtatgccgtgtattgtatcatcagcctcgttaccctctgcatatgtttcatcctttcttcttttgacaaaaagataaaatagaagcaaactctatgaattgcactccaccagtgccgagggagagagttgagtgccccagaacaggagccccgccggtgcagccaggccccagcaaacccagcaagctcctttaggaagcaccagttacatctggataaagttcccccgcactctctcctcacgctaccagcaccg

SEQ ID NO: 58060 - DNA, 1217 bp, Homo sapiens
gtcgagccaatggaaaccccaaacccactgtccagtggatggtgaatggggaacctttgcaatgtaagtagcgagctgttgtcccatctgactctcatctctctgctgtcaaaggcttcagatccccatcactgtagccagtgctggtcacactagaagttcaggaagagagaagcccactggtggctgtttctcagctgcccatctcttcagacatctcaagaggcaggaaacctaccctctctttgtgtgagagaacaggaggcctggaactctgtggtcatattcccatgcttaagggatttctgctcccttggggttttttaaatctctgctttctccctctgaacaacttcagagcccagttgatggcctggggactgtggctgcatctctgggtggttgggctttgagtgatggctggggctgggaaggtagaggagaattcagtaacccattgttggttactcaagttccgctctctgctaagggcaaaagaagaagcagggttgtacaataatgtgaaatattatggttagatatgaggaagaactgcccccagaagagcagatgtacaagtgcactttatcgagtatgcttagactttggggacatttagtcctgcccaggtggatggagtagatgactccaagaccccttataatcagtggccttggtcaagttttcacatcatagactctctggttgcattacttttcaaaatgtcctgtccttactttctctaagaggtcagaggaaatgtaaacaatggtatcaaccaaatggggaaaaagtagatggcgagaactcagtctaactcaagagcagcagctggtagaagcaggtggagagggggggacacaggtagaggagagggtaagaatttacctatttagacatatattgtatgccacattctgtgctagatgctgcactccattgttgctttactttcaaacatttaaggtaaggaaataaggttctcctcagtgcaatgagttgcccaaaatcgcatggctaggaagtggtgaagttgtgggttgctgtgagtctgcaatacaactgcaccagctagtactgaacctagttatccccagtaaatgttactccccagctacaagcagagatatggacactgcctgccctctacagttctctccgtcttaataggactttgggggtaagctaggcaattgcgctaaactttacagcaccat

SEQ ID NO: 58061 - DNA, 1936 bp, Homo sapiens
caggaaacagatgcattctcaaaaggaactatttataacgtgtggagagagttggagggaaaacggcaagatacgtgatccaccttaaaggctggcagcagcaggaagccattatgccactctgagcctccatggacggggatagatgagtccacagcaagcaaggaccgcccttaggagccatggccttaggtagaagagtacaaggctgtcaacctgtagcccagcaaagaggaacccaggggaattgatacccacccttcctcttctcctgccctggggcctcctgttggcacctgctattggttaaacccatctggaagcctgagaacaagggaaccccgctgataaggtccagcgagggcagccccccaggagacggagcagggtgaggaagggtggaggacaaaacgaaggggctgatggaaactacccagcacaggagggggcaaatgagtgccctctgaacatgtaggcagagtctcttccacctagactgccacccttttgtcctgagccttccccaccactttttcaagtactgtctcatggaggagatatggcccctgccctcatggaatgcccagtgttgagtggagtgcaggtacaggccagcagagaacaagtcagaagcaactgtagagtcctgcctgcataaccagctctctgtcccaacacattgcagatcccagggctgcgcccactgaagttaaagtccgagtcatgaacagcacagccatcagccttcagtggaaccgcgtctactccgacacggtccagggccagctcagagagtaccgagtgaggaagccagctccggactcacctaactacccagctcactaaccagggccaggggtagcaaatgcgggctataagatatttgaaagaaaccctagcgttgtttattgaatccagggttgactcaagaagataatgtctagggttagatgttcaaaaatatacccagaaaaaaaaattatatatatatgtgtgtgtgtgtgtatatatatatatgtgtgtgtgtgtatatatatacgcatatatatatatatatatatatatatatacacccagatgtgtccaacagatatgctgagagattctgctcagcagaaaatcacgtgaaaggtggtgggtttgggttggtgttgcatagcacgttgcgtttggaatacatgcgtgagtgggcacacatgtatcttcagagcagtgttgaggcaccgctgagctactcccctcccctctcccaatggcccctactgggctccttatctcctaagccacaactaacaggcaaagccactgaaagcatgcaaatgccctccctgttgtcgcagccaactccagataacccagtatatggactatcaaggctcttggcttctcttggtcctccctgcctgagagcagtttctgctctatcatccatcctcttcaaaagggtgagctcagatgggaagaagagagagagcacccagggtatacacggcgctcccttctgagtagcgctaattaaaagttggctggaaagtgagggaggcagtaactgtgattaatgcacgttctgtggcctcagaggtcatcaggagttggctgatggacagttggaggcagagcaagagaggctagtctcttcccaggaaatgaatttggccagtaggggaaagaaggcaacgtgatgtgtacacttgaatgagctcttccccacagatgacttgcacccttaacctacttgcttagagatttttctggctaaagcttccccatgggtccccctctaagtctggaccccttcctaccttgccacaggcagcctgggagacactggcgtggccaactgacctgtggcttcttacccactgctaattagagacttcttgttgcccaaactcattccactgccccctccaacaccaccatcttccatagctgt

SEQ ID NO: 58062 - DNA, 1049 bp, Homo sapiens
ctttccctccccttggtttggttttcatcattggcctctccccaacactcccaccctcccacctcttccggatgttccaccctggctttctgtctccttacccctgaacccaacattctcagctcagaagcctgggcctgctgcctggacccagtgatgagaatccttatctgaggatagggaactgcagcctctgtacaaaacagctgtaagtggttctctacctaggaatggctctgcccaatttcgaggtatctttgcagaatcagagcctaacatgtgctgaatccagagtagttgctagaagaaaacctgatttacttcttcctctcttaaatagcagagtctgagctatgtttgtcctcagacctgaaggaaatagcatcctggatggggcaatgggctccggtcgtctcacggttctcccaggcttcagtttagcagtgtcgagcatgggggttgtccagaggtcaatgccttcatacttgtgctttgttttttgtgttttcctcatcctccctgccccctccccctcatctcccctgctctctcctccttccccaagtacccagtgcccctaggcgtttccgagtccggcagcccaacctggagacaatcaacctggaatgggatcatcctgagcatccaaatgggatcatgattggatacactctcaaatatgtggcctgtacgttctgcccttccctttctcttagataatctgggaaccagaaaccccattctcaccacttttcctaaggactcaaggtagaaagcctgtgggtgcagatggcattgtggagggatggaggggccaacgaaacagttcccaataggattaggggaggcagatgggactcaatccctgctctcctttcatagttctgcctgcagggagcttctagtctcactgatgagacaaagggacctccagtctaatgaagcagacagccatgcctttagggatcttttgtagtctccaacacgtacagagtctaggagagagagttcctcaagctctggagcttccacctgatggggtagatagt

SEQ ID NO: 58063 - DNA, 1033 bp, Homo sapiens
agttcccgccttccaaggttgcgatggtgtggagtgggtgcagctgaacatgctccctctctcctatccatcccactattcagcatcttcccccaaagacaggaaccatccttttgactggagttggtgtcctcccacaccacctactccttatcccctcaattcctggcatcatggagcgtcacccagcctgctcaaaggtcatgccaacctagccagagcaggacatgctgttgaggacagagctgggaacataatgctctgagtggactgtccctgcagccaccttttagatgtccagtccttgaatcgaggtagaaacagtgtgttagaaaggtctccaaggcccaggtggaaaggtttctgtaggaacatgcctgactcaggtggagttgaccgtgaaccctgaatgccagttggcatcctcaggccagcagccagcacctggccacgccgtctgcataaggtttgggctggaaccttccctgctttccttgtcctgtggtctcacttgtgctctgttttctcttcccttttccatcctttctccctctgtctggccatcttgggcgctgtgttctgaagctactccaaccgcaggtaccgtaccagccgcggaggtaatgggcatggcatggggcagcgcaggcggagcccagcccagccagggcggacaaggagggagaggctcaggctgaaagcatgctccagactcaccctttcagtggttgggaagccagactgtcaagagggatgtgtgtggaggatgggaccagaggagagcaagcccactttccccccttcccaaactatttgccccctgctgagtaggagaatggctcagcaggggtcacacacacaccggccctgacctgctctctggagctgcagtttcattctgacactgagtagattacttcccgttaaccacctgagtccttgcctgggcttgacagctcagagcagtgtccccagctgtggccctagaaggcgcgctgcagcaggagcagggacagctggctcctggtggggc

SEQ ID NO: 58064 - DNA, 1578 bp, Homo sapiens
gtccctctactgagtgggtgagaggtatctttgcaatcaccccacttcctacttcccatttagaaaagatctacactcatccagcatgagctcacggtctcaatcaaatgtttcctgggctccagcttccgtgtgacatggcagtggaggcagattgcacttttttggaaatgagatgtgctgataacatcagctgttctcagctttaaatgcgtaagaaccttctgcacaatgagcaggtgccaagcaacgaaactcgggttccatgtttctgacgtgggcctggcgtccggcccactgctgtcttccctctcgtcctctccaaacctgggcactatttccccaaactgccctgttcatctctcacccagtgaagataatccctctcatccacctgtatctgtagtctcttaggattgctgcccgtctgtctgacaatctgtgatttggccggggtagtcaacacgccatgtggacatttttggactaaaccttccaccttggaatgtaaggaagtgctgttctcttctttgacccagctcaggtctgcaaatgtttggtgggctcttgataggtgccctgttccgtggcaggttctgggacagaaagatgaatgacacatgtcatctctcctcagtgttctccatctcatgcatggtgctccctgaaacccacctggaaaacccttggccgcagccagggtgccttccagtgtgcattaggtcacaaacctgtgaggttgacgctgccatctaggaagggccttgtgcttccagccgaagcccactcaggatccccccttagctaacagagagtctctgcccgctgtccttggtcgccaggctgatggtctccactgagcactggccaggattgcttccaaacctgtagctcctattgcggcaggaaatgacatcctagcccagtcatgtgtctgcccagcctggtgctgctctgttggtaagccctacttctcagcttcgttgctcttctatcctctcctccacctcagccccaggggatgaaataatctgaatctccttagacctgagcagtggaaggttttccccatggaacacttgtcctcctctcgttcccacctgtactagccccctgacagctcactgcctgactcttctgcaccttccctcggaggcttttcttctttcctccaccctccctagctctctggaggccctgtcttgccttgggacaatagacacagctaatgagtgggtcggagatgtgccagcagtgaccttagccagctgaggttgtatcctctatggtaacttcaatggtgggagccccggggaggctgccggaaagtgacccctttcctctctctcatctcttgctccctcttactaagcctgagccagacaggaagcagctaggtagccatcatcagagaaaaatgcttcctttctgccacacttggcagaagtggccatcaggggaggggacaatgcagtgtagaaacatcttcagagccatctctcatccttacctctgcccagcagggccggtgaggaaaatgctgtcacctgggctctcttgacacctctgtcccccagc

SEQ ID NO: 58065 - DNA, 1117 bp, Homo sapiens
ctgaggtgggaggattgcttgagcctgggaggtcgaggctacagtaagccatgatcacaccactacactccagcctgggtgacagagcaagatcccgtctcaattaaaataaaaaaaatcagagcagtcctgcccaagtagacaaaataattgctccaggtctgtgccagcagcacagagcagcggaaagagcccatgtgtgtctatggccatgagagctgcagggagcaggcctgggagagaactgacctttgccccatgggtctctcaggctttcccatgtatgatgtgtgcacagtgtgtgtgtgtgtgtgtgtgtgtgtgtgtgtgtgtgtatgtgtgtcggtgggtggggataagtgaattccctcttgttgagtgtttttagtgctgagattatattccaggcctgaggccatcctggactgagcacagccctaaataaagaatctgagagggagagttgccccaccgctcacccctccgcacgccgccctgatgtctgtgggttgaccggggtttggggagtatagcattgtgagctttgagcctgcccaggaacctctggaacgtatggggcatagtcagctgcccagtgtgacttcggtggccagcaccctcggggcacagtagtacctctgatcttattagcagggaagcaggagtattccctccttctccaaagagggacttgtaattttggagacccaagggaatgaaagggcttttgctgggcaggctctggctgagaaggcttaggatcacttcactctcccttaaaaaaagctctctggcaattctttctctggcatccctccctgccctagcccctttctcggggatattattttcctgagagatttgaggctgggtaggattccttgggagtgagagttagctgcctgtgttttaaagtccctgcctactgccccattagcgtcaacactagaaagtggagtgctgtcagatcacaggagatccagtgcaaggaggagagggggctttgtctctctctgcttggcctcattctcatactctcagctttagcaaatattagatctgcgggtaaggatagggcagccctttccatgaccttctatatcaggaaagaagacct

SEQ ID NO: 58066 - DNA, 1009 bp, Homo sapiens
gctgagtgcgggttattccattagctccctcttcccatgttctcatgtgaatagaaagcacctggggtacctggacccaaagttcctagagagaaaggcagttataagaagtgtcactttggattagggtggttgcaggaagggctaccactgagcagagaagggaaagagagggaggagaggcaggggaatgaccgaggagagccaagaccggaggagggcgagggcaggcagaacgccgtgcaaggctcacccgcgcagagtggagattgttccctctctgtcatcgggtttgggtggctgtttgggctcatgcaggcatgacaaagggtgattttggagtgattggttgggaatggcaggccactctaggcctctgctggacagggccccaccgcctgcccacctctaggctggggctccagggctggacccaactggtgctgcttgggcctgtgtctgggtggcatctggccagtgtttggcctggggctccatgccatccctggggtctgagcgattcagcccgtgcccccttcccgtctcatcctcacgcatccttggctgggtgcatgctgggtgtttcgagccacgcagaccatgagaagaaaatgaaacacacacagggcttcattctcttcctctcccatggttgtgtcttctgttgctgcgacccgtctgacccagtccgttatgcttggggaggctcctgatgactaagccccgtctcctcaccgggctgcctgccttgcacgcgggggccgtgtgtccaggctgggcacagccaaaccaaccagactcggctgttttacatttccctctcagctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccac

SEQ ID NO: 58067 - DNA, 1050 bp, Homo sapiens
tttaaactcagccgagcaggctgccaagtggccggtatgctaagccctggggctaagggtaagggtggggaaagagattaagagagaaaaggatcagtaccttgcccccaggggatatcctaatcagatgcaggtcattagatacacagcatagcggaggggaaaaaacacacagtgatttacatgaacttctgaatgttgacttaaatattcattactcctcctgcacctggcctggcgaggctgatcctggtagcttgcatcttgggagtccctgcccatctgtgtaaacgtctcaccccaccccttctatcctagtccttcctggtccagcatcctgtcttcctccgtgtctccgcctgtcctgcacatttgcatgccatcaaggctcagagggtctgagagtcgggctccctgattgaggctagccaggccgactcaggcaggatgtctgagtggccagcctgtcctgtaacaaggggagcaaggccaggcaactggacagtggactgagcagagcaagtggctggactctgtctagctcagatgaggtcccaagctgttgctcactggtatgtgcatttgattttgcttcattacatatttgagtccagcacagcagcaaaaagcaaagatgatatttgaaaatagagttccatcctagggaagactgccaaaaccagggcagcctgctttcagagtttgacttctccaggtgctaagccctagggctgtgggtgagggttcaggccctgccctcagggatgtcctaatctgatttgggatattaagcacacgacagaataatgattgatactgggtatgcttctgaacctaaatactcatttctcttttcttgcacttggtggaaaggctcatcttgatagcttgctttccagtgatgaagcactcagccctggcaagtcttcccagactcctcccagcgagagctggagtgggcaggttgatgagcccagctctgagtacatattgtccacttctctcacaggctggctggaaattactgtctgcaaaccacatagggaaagg

SEQ ID NO: 58068 - DNA, 1050 bp, Homo sapiens
agggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgataga

SEQ ID NO: 58069 - DNA, 1019 bp, Homo sapiens
gagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatag

SEQ ID NO: 58070 - DNA, 1039 bp, Homo sapiens
ggtaccctccagggatcgagacatacagccttagaggagactgcaggggaggggctgggatccaggagcacctggggttgccctgggggagcaccacagacccatcagcctgatcagatgtatattgagctccattgtgtgccacagccttgggtgaacacacacacacacacacacacacacacacacacacacacacacacacacgcagagtctgggctaaaggctggagctccttgcctccctaaaggtgaggcagttggcgtccagtcttgccctgcatccatttccatcacagtgtttattgaccatgtgccaggcattgtgctaagcacaggggagacagtaataaaattactgcctctacagagctccccgaccgcccgagtgcagcctagaatgcgctcatgagttcaccgatcagtcatctccccataccatctgccctattatgcgttctagaatgcccaggatggaggaggcctttttgtcaggagcaaggctggagtggagctatgccaggcccagagctggccctgcgaaccctgagccagccaagcctcgcccaggccagctgccctggtgcaggggtgcaggcacagactggcacaggcaagcacaggctgtcatcagcaggggctggtcctgcaaggcaccagcacatgggggagtggaccactggggggttcgggggcaccagggggagttggctgaattgtcagtcccaggaaacaaagggcctgggggacagctgggggacagaaggctatgagtggggctccaacacacgacaaggttttctgggataaggccccccgcatggagccagtcaaaaaataaaaggtacaccctccaccccagagttctccctactgggatgcccagctcctggccctgaatctgtctccccttctccccagtaatggagattggagagcaatgagagatttggcaacttccgatggatggtggtagcaaaggggagttcagagcccagctgtgggcagagactaagtgatttattatcagcctacaaagt

SEQ ID NO: 58071 - DNA, 1093 bp, Homo sapiens
caggggcatcttaggcccttcccggcagggatgagacatggacagggccttgcaggagagactgccttgcctaggaagggcattacaggagagtgaagatggatgtgctgggggaatgtcggaggggttgcaagtgcagaatgtcttgagttcaagtcgaactgagagtggcaaggacagggaggggcaggtattttgggagaagtggcacctgggcaccctgcctgtcaatcggaagtggatatgaggctgcagtcggggtggaggagggagtgccatctgctccaacgccccccacccccagcaaaacacccagcttctcggcttccttggccatatccttcctgacgggccctggggacaactctcccttctctccccccaggctcctttgggtgccaactgtggctgtgaaagaggcaggaaaaggttgtggagtggtcaaatgtggagggttgaaagggtttgggagctctcttcctgagaaaatagagtgtgatgtgagacagggcagatcctgagcttgcactggccttcagcccctgcacaggcctgagaggcaatcttaggtcctctgcagccttctttctccacacgggtccccatccaggggacagcattcccaagcccttggccactctgcattctgggagcatcaccagagccagaacactgagatccagagatgggacgggtcttgcaggcagttggtgaaagggcccccagccaggctctctccccaagccctgaccccctcccactgctcttaagtttccgcaaagagggcaggcagagcagagcagcagaatctgcagccgggctcgctggcccctgtggaggctctgagcccagtgacccaggttcactctgataaccaataactggaaagcaggcccctgacattccacactcccctctgaactaggaaagtcctcccagggactgggagtgaacggggaggctggctctgcccccgccctcacctcccaagagaaggccccatctctgagactgatgggacaggcatctgacttgctctcagcagctacagggaacaggttcttctccagagctcaatgattgaaccaagcct

SEQ ID NO: 58072 - DNA, 1089 bp, Homo sapiens
cacgttcatctctgaggatgagacccctttggcccacaccttggtaggggccaccctgggctctggggaccaatacagaatgggtttggattcccagggcccccctgtgtcctgcagagcagcccccaaccaggattgcctttgcttaagattttggaggaaagccttcaggatgaaggccgagtgggagccccccaagcaatgctccagggcccacttctattcccagagagcctcccttttcctaaccccgaagggagacaaggtagcaagagctggaagtgaggccaatgatgtggaacccaggtgtcctctcaacctcctcctatggaactgagctgggagatgagtagcgttcccccaccccacatccctgtggacaagtggctggggtagggacgagcagggggcccaggggcagcccaccttcctcagctgagtacacgagtgcagtgaggctctcgggcccatccccgcggcggttgtagctgcggatcttgacctcaaagggcgtgtagggccggacgctctcgttgctgtagacaaagtactgggcatcggcgccaggcacccgggcggtctgccagtgagtgctgccctgcctgcggaaggacagcaggtagccgaagccgtctccgttctggtactcccgtgacatgggctgaggggcaagagcatggcatgggcgagggtccgcggcatgtgtccctgcccgttccctggccccacccaacctttgccaagagtagcggccctggacgcctacgcctgcagcgtggattcgcgtaaggggcagcgggtgcgtggaagggggacaggaagttatccgcgtttgagtcagagctgtgcagtggtcctttctgcagctgctcaagcgggagaggggtcagggaggaggaggaggacatctgacccttgcagcttaccgtccagttgacgatgagctctccgggggctccacctcctccgctgagtcctgagggtgccaccgagggggctgtcaagggccaagggacaccgatatggcttgttaatgagcaaggaaaaaatgaaagccctgagcctgtgcctgtagagcaccgtaagatg

SEQ ID NO: 58073 - DNA, 1044 bp, Homo sapiens
cccctcggtggcaccctcaggactcagcggaggaggtggagcccccggagagctcatcgtcaactggacggtaagctgcaagggtcagatgtcctcctcctcctccctgacccctctcccgcttgagcagctgcagaaaggaccactgcacagctctgactcaaacgcggataacttcctgtcccccttccacgcacccgctgccccttacgcgaatccacgctgcaggcgtaggcgtccagggccgctactcttggcaaaggttgggtggggccagggaacgggcagggacacatgccgcggaccctcgcccatgccatgctcttgcccctcagcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaaggtgggctgcccctgggccccctgctcgtccctaccccagccacttgtccacagggatgtggggtgggggaacgctactcatctcccagctcagttccataggaggaggttgagaggacacctgggttccacatcattggcctcacttccagctcttgctaccttgtctcccttcggggttaggaaaagggaggctctctgggaatagaagtgggccctggagcattgcttggggggctcccactcggccttcatcctgaaggctttcctccaaaatcttaagcaaaggcaatcctggttgggggctgctctgcaggacacaggggggccctgggaatccaaacccattctgtattggtccccagagcccagggtggcccctaccaaggtgtgggccaaaggggtctcatcctcagagatgaacgtgacctgggaacccgtgcagcaggacatgaatggtatcctcctggggtat

SEQ ID NO: 58074 - DNA, 1050 bp, Homo sapiens
ctcctaggctgtctcagtgtcctagatgtatatcatgagttcagagcatctttgttgtttaaggttgttaggtggttctgatatatggctaaggttgagaaccactgactgaggcccaggcatagggagtcattttactgttgctcttattttaaaaaagatcttacattttacacgtacccttacccccattctgtttacttcagaggggatagatttcagaagacctgggttctgggccttgttctgctgttgatggtgtaatggggcaagctacctgacatcatctttgaaataggtgattgtgaggatccagtgagatcctgtgaggtaaactgaagtacgggacatgagttcaggaatattattgatgaagcattcagtacgggacaacttgctgagacattcaggagatagcttgctgtactttaagcaagcagtcttgacactagaagaccataaaatatcctactttaatgaactcaacatgacattgctgaggagggaggaagactgatgggtactatgtcccattttccagatggagagactgagtaacttttgcagtcttctgttgcagccagtagtcaagcatgggatggactattgcacagttctggcattataaccctctatgcattgggctcttgagttttgactccaaggatgtgaagggattgagcagagaagagaacaaaagatgctcagttgtgttagtaaagcaaaacctgttgaagtctgtgcaggtaatctacctttgcagggtcaaggggatgctgactggactaatatttgggttttagagtggctggtgttcccacatcccctttgggggcaaagtggaagagatgaccgttttgtgatatcatactggtgtccgtacaggccccttccggaggcttgttgtcagcctgggcttccaggcacacagctaatgagtattcaggcctccattcaccatctccctcttcgctgaaaaaagctgggggcgtagtcagcatggagccctacctgctttgcactaaaagactcaaaacacagagtcgtgca

SEQ ID NO: 58075 - DNA, 6042 bp, Homo sapiens
ctagttaatatttcacagcagctcatttaacgatgtctctcagaggttgagcagcttctatggaataatcagggaagtgttcatttcattgtactattcaggatattatttatcgatcattgttggtgtatagcaatgtagacagtagctctcacgaacatttcaccatatttgggattctaaggtgataagtatgtcacttaaggaactgtggtgctgggaaaagggtttcttgctcacttgttaatcatttagtgactaatcaatctttaaaatatatgaagggttgaaaggtgtggtaccctaaaatttcttctcctctcctcattgcactttttggaatgttaaacattatttgttagcaccttagagcatggttagcagcttagaaaaaatagaactctgatcattttgcttttcccccaaccctttgggacagtactgaggaaagtattggggtggggggtttggatttggattgttttttgttcaataaagagtaattgggagttggagttggttatgtattttcttaaaaaggggaatttcttggtccacgtgtgcttgtaatgcatcatccagcattcagtatttctgttcttacaagtaactggtctaaattgaagctaaaagaaatctttttgtgtctaatctctttagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccacgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgtttattaaagaacaggtgtagatgtttatttgtaaacactgctcacttctggaactctctggccactttgctttagtacaaaggaaagtgtgatttcctgtgttgatactagatctttcagtgtggaaagatagatctggaaggggtagggagtggacaggtagtctagatttctgcctctagatgagattgtaaataaatgatgcaagtggaaaagttgttgatcaaaaagatcatctaggaatgatctgtcttccaattatttaactcaatatagttttgcaattactctgaagaggccgtagggctaggcattctggaggttacaaaaatgcatgctaggaagttcctgtcttccaaggacctttcttcaagtctaagtaagtacggttgaattcttattagcctttttttttttttgaatgaagcagctttaaaatttattaaatgctcgttgtctcctaaagataagatgtttcacaaagtctatgtaagtctttgattttaatgtcaaatttgagggtctacttattaatcttatgtgattgagaactccatctttgacatcatagctgtttcatagcaaccttgacctacgtgaataatgagctctattctgtaggataaagggagtaggccaagagtcagggagcatcatgcatcctctcactcaaaatatatcttcagtatccttgggaaggaagagtgcctaaaagggggagaggagctgcctttaacacaaccttaaacattctgatttgaaaaggtcatcttggcccttgtctttatgaatttccatttctatttaaaattccttacacattgaacagtgtttcacactttacaaagtgttctcacatacagtatatcattcagtgctctaagtgaccttcctcagataggcaaggaggtcttaagttacaaaggaggaaacagaaattcaggaagggtaagttacttgcctcctagtccagagttcttaatcctttttataggaagtttaggaacattaaaataattcaagttaatcttcctttttttagactttagtatttgttttatttggtgacatttaactggggcttttgaaacccttaatttagatcctagtttatagaggggaaggggaagggtgaggaagagtgtaacttcactatgcatttgaggtaatctggaaatttacttcagtttctgaagtcttttcttctttgtcttcccaagaggtggatttaaagtcattaagagaacacgaaaacggccagcgcggtggctcatgcctgtaatcccagcactttggggggctgaggtgggtgaattgcttgaacccaggagttggagacaagcctcgacaacatggtgaaaccccgtatctacaaaaaatagaaaaattagccaggtgtgatagcctgcacctgtagtcccagctacctaggaggctgaggtggcaggatcacttgagcctaggaggttgaggctgcagtgagctgtgatcatgttactgcactccagcctgggttgacagtgaggccctgcctcaaaaaaaaaaaaaaaaaaaaaaagcgtgaagactagtaggtaaggtggttattttattaacaacgatagttagtaaagcaacaccattgtgatttttttcctgccttgtggcctcacctgtttataaggactggacttttatttattaagttgtgttgttttattgacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactcgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactccca

SEQ ID NO: 58076 - DNA, 1519 bp, Homo sapiens
agtctgttgtctgttgcaacaggagagtatgcatttcaagggaaaattggcagagagaccactatagagataatctggccatctggaatctggggctatagaaaattgtttcctgtcaaacagcttgtcagtgttggctagcactagagggcccacattcatgtggacatttttctatgtgaatgaggacccaaagtgaagcttggtgagggtaaccctgagcttgggacttttgggaaggaccaggctaacatagtctgcgctatctatcaaatgcttcttagttactttaaatactctccagaggacagtcctgagaccagaaacttgagatgtgagcagaatcaccagtcctagttgtctgtgattgctcaaggattgcccaagagctagggctccttggcagtaaaaacatcagtaataaagtgggacaaaggtgtggtcggttacatacacgttctaaaggcctcatgggatggtagacatgaaggggttggtgcacacctgggtctgttggagatggcaagggccaaagtgagcagaagcgacatttctgggagtggacaggcaccatgcagatttccctgtcttgggctgcgctacaccactgccctggtgccagcccatcaccctaaggctctgaaccacctccaagtcacttactgaatctgtgatttttttttttttaatgcttggtagttttgttttctttttttctctctttgtttttctctcccctccctccctcctttccttcttttccttcctttccttgtgaagactaatttatgaattcctgctagaatcaaggtagtctttctcactctgtgggatgttattaactaactaaggtagggtttgaaatcatgattcagtgttctcttaggccaacctagattgggctgctactggaaagtaccaataatagctggtcattttgagctgaattttcctacctgttacattactggagatttcctttatgttgtagctaaataatatgtttccttgggggcagttgctgcgtcaggtctttaaattggctggagtcttctatattgctagttctgtgtatcttatcttgctcatagtactgcttgctctggttttgatttgttgcctgatgcctcaacaagcttttgttttgtttgacttttatttatttattttgtctattcagaaaaacaaggacggtatagaaacatgagctgccctccagtataaggtagctcattagtcatcttgagtgcctattactaatgctgttgattagtgatcaagccactttctcctattatgatttaggtttaaaatggcaatgttgtattcatttttagatgattaccactaaattggtcagggtacctgtgggaatagttggtgaaaattgccttaaagtggtaaggcatgatattgagtcttgtggagtggatttttctatcacaggaagttttttaaaaatcaatgtagctgggcacagtggctcacgcttgtaatcccagcactttgggagtccgag

SEQ ID NO: 58077 - DNA, 1380 bp, Homo sapiens
tccatttaaaccgaaactctacaaaggggacagaggtttacctctggaaggatcagcgaagggtaaagtgcaggcggaactcagccagcccttgacaggtaaggacacattgggagcattgtctggcttgcttcgtggccttgctttgtgtagcccttgacttcatttaactgcaacattttttccccctctcttccctcgtttttcccagcagcagataatttctgaattttaagctgctgctaagggcaggctaaaccagatttggcttaattcagtggctcttaaccttgggtctgtaaatagttttcaataaatctacattcccctgatgttatatgcaaaatattatgtgaatatttttctggggaagatgtccatagctttcctcagattcctgtaggaattcatgacccaaagaagggtaagaacctctggtttaattcatttcttcatccatatttgctcttaggttttttgtttgttttgtctcaaagagccagacaagtagccagaagtacaagcttgttttatatagtccttgactggttcactgtggcatcttttctctccctcttcaaattgttcaaatcccacaggtagtgctttctctctcttagtattccagaagcaataatgaaattgttagtaccatcgtgttaaggaagaagatggggtttgttttggtttttgatttttttccaatatctgaaaacaggaggagatgatcaaaaagacagaaactacagtatctgtgtagtttcttaacacctaagccttttgatacataatatttgagttttctcacttttatattactgagggatttttattgggggacagaaaacaatttctgtttcttaccaaatacttgtgagcctaggctaattggtctcttgtttagaaaatgttaatcaaattagaatccatttctgtgtaaacattgggctttggaaattgtttttttgctttatatagaagcactgctttagttaatacagtattctcaatttttttgtggctagtttggtagactcaaaggtaggattgataacgtatcaatggttgtattcaggctcccccgactttaaaattttaatctaaatgtgtggactagagtgcaaaacagaattctttgtttaatttataacttacatcatttaatcattgtctgtaaacatgaattctcttacagagaagctgaaatagacagttattcatcattttgagtattccatctcgagtttactagatttagactttagtttttgatagcccaacaccataccactgagtaccaatatttttttcccgacaacatttatggtggtgcactgatggttaccacgtccacattcaacccacctaaggctgtgtttg

SEQ ID NO: 58078 - DNA, 3332 bp, Homo sapiens
gggatacacaggaagtataaaacatattcccacttaaaattgtattttggtttgggagatgacaagtagatatataaatattctagtctattactttgatttttcctcaattcttccctagtttattagtcgttttgtagtactaaggaacagatttctgacctctggtgttgatatttttatccttcccgtagttgctttttaattaacacggcagatcgaataatcagagtttatgatggcagagaaatcttaacatgtggaagagatggagagcctgaacctatgcagaaattgcaggatttggtgaataggtatgtatcacaacctagaagaatatgtgatcattcatgacctgggcttgagttccagctctccttggtactttccttgtcctttaggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagctgtgagtacattaggacattgcttttgttagtcacataatccaaaaaatctaaaatctgttcttaacaacctgtttttctttccttcactaaaatttagtggcatcctgttcgacccatcatagcatccatttccagtggagtggtatctatctgggcacagaatcaagtagtaagtattctattttacttgcttcgaaactagttaccccttctttttatcaaagaaccttatacataggaagctaaaaattacatttttattttcttttgcatatgattctcgcaacctaaattacataggttcagtgcatctagttgcactttattttggtgggaaggtcttggtcccaagttggttttctggctcttttcagggagaaactctattgaactttctgttgcatttttctattatttatttgagataacatttttcttttgcttttcttactttcagctcagtttctgttttacatcttaattttactttgaacacctttaaattatgtttgtaatcagtgtacttacaagaaaatttaacattttacctctaaattcctaaaatgaccaaagaaggcagtgattcaaaagagctacagttaataacttagcttatcttaatgtttaagatagaaaatacctaagctagtaaaacttacagatacccatttttttcttgtctgccaaatttaatctaagaattgtgaattcctttcatgctcacatctttcattttatcattaatgtgtagattacagattattgctttcacatatggttaagtagtatatcttgttgtataggaaaactggagtgcatttgcaccagacttcaaagaattggatgaaaatgtagaatacgaagaaagggaatcagagtttgatattgaagatgaagataagagtgagcctgagcagacaggtactatttctaaattgcagacaggatttcctaaagggaaaatgattgctttacttaatattcttcatttgtgttgtaaatttatttcagcacttcatctaaaatgcccccctccaccccacacttttttttttttttttttttgagatggaatttcgctcttgtcacccaggctggatgcaatgatgtgattttggctcactgcaacctctgccccctgggttcaagtgattctcctgcctcagcctcccgagtagctgggattacaggtgcctgccaccactcccagcgaattttttgtatttttagtagagatggggtttccccatgttggccaggctggtctggaactcctgacctcaggtgatccacccactttggcctcccaaagtgctgccattacagacatgagccactgtgcctggcctatgaaccactgtgcctggccttcttttttctttaagcttacacaatttccacagtatttggagagccttaatttataaggtgtttactaagggcttatatgggtattaccagggctcaagcagctctcttaacatatcattgtgtatttcctgattaattgcagatgactaagtgaggacatacatgcagcacctagcaaagaactcaccatgctaagagtgctcagcttttcccatgtattctgtcactcctttgtcagtaagagaagggtcaagaacctgggctctgaagtcagactgccttgggcaaaatactgcttaaactgaatttcctcatctgtaaaatagggacagtaatagtacctgctttttagggttgtggggagtaagtgaaataattcatgtaaagcatttaatatatgcctaggccataataagcactaagatattaatttccattatgattatgactgtgattttatctcttctgaatttctagataggagctccttgagaataaagatttgactttttaatccccgtggtgtctaacacagggctttataacatagtaaggtttgtgcgggtgaatgcttaggatgcccagttggcactgtcagtgagtaattaatgccacagattattgacccccgagatacttgatggtgccaggaatcaggattgggaatgaggttgattctgtttagtgtcaaagtgctggtcctcacttttgtgatattagataacttgcatgcctaatgtgttttaggaggacctccagggaagtagaatgttctagattatagggttatgttctgtcaaaccttcccagatttccacataaattgttcctccttcccatatcctgagcaagttacacataccattactgtattaaattgaaactgtctctctgtctccccagttagactataaaccttttactgaagagctgttcccaactttttctgggtcattgcactattttcagtgcctaggatagggtggaaattcagcacatatttgttaaatgattaagtgaagtgaactgtttggttttcctcctttgtttctctggaatttcaacttatgaaaaccttgaagctgcaaataaaaagcagtttttcacttcttctcaaacatctcctgtgtttctgtcctgcaggggctgatgctgcagaagatgaggaagtggatgtcaccagcgtggaccctattgctgccttctgtagcaggtgagccggcccggaaggctgggcaccttggctactgctgctcctggcctctgggggagtactctgcagtttccctggctatcccttcattcccgtctgcttattagctaaaagagataactcgtttggtgtacaagaaatccaatgtagcctttcttctctagtcctatgttcctttcacttctccctgat

SEQ ID NO: 58079 - DNA, 1045 bp, Homo sapiens
ggcaccatctcagttcaccgcaacctctccctcccgggttccagcgattctcctgcctcagcctcccgagtagctgggattacaggcattcatcaccacacctggctaattttgtatttttagtagagacggggtctctccatgttgatcaggctggtcttgaactcccaacctcaggtgatccacttgcttcagcctcctaaagtgctgggattataggtgtgaaccaccgcgcctggcctagaaagttgatttttaagaaattgtgataaaatacacacagcataaattttaccatttcagccatatttaactgtacagttcagtggtaattaatgtacattcactctattgtgcaatgatcaccatccatctttagaaatcttttcttcttgtaaaactggaattctgtacctattgaatcataatttcccattccctgctctccgccagcccctagaaacaccctttgaccttctctctttatgaatttgactactccaggtacctcatataaggggaatcatatagtatttgcccttttgtgactggcttatttcacttagtttcatgtcctcaagcttcacccatgtgtgtagcatgtgtcagaatctttctccttcttctcaaggctcaataatactccattttatgtttataccacttttgtttatatggcttatctgtggatacttgggttgcttctatattttggttattgtgaataatgctaaacatcatattttaagaatagattggccaggcgtggtggtgaatgcctgtaatcccagcactttgggaggccgaggtgggcggatcacctgaggttgggagtttgagaccagcctgaccaacatgaagaaaccctgtctctactaaaaatacaaaattagccaggcgtcgtggcgcatgcgtgtaatcccagctactcaggaggctgaggcaggagaattgcttgaacccaggaggcagaggttgcagtgagccgagattgcaccattgcactccagcctgggcaacaagagcgaaactccgtttcaaaaaa

SEQ ID NO: 58080 - DNA, 1102 bp, Homo sapiens
ccaaagtgctggaattacaggcatgagccactgcgcctggccctgaatgcgttttttttaatttaaattttaatttttttgagatggagtctcgctgcgacgctctagctggagtgcaatggcacagtctcagcttactgcaccctcctcctcctgttttcaagcgattctcttgcctcggcctcccaagtagctgggattacaggtgcaggcaccacatccggctaagtttttgtatttttagtagagatggggtttcaccatgttggccaggctggtctcgaactcctgacctcaagtgatctgcccgcctcagcctccccaaagtgctgggattacaggcgtgagccactgcacctggcctcttacttttttttaatgatcatgttttattttgtcaagactaattttactcagaattttccctgttattagacctgtggattttatgctttttcactgtttcaaatttgcttgggtgggagaattgatgagggtatggacagggatcagggaaaaggacagggaatcagcttgctgataccaaagcaacagccaatgtactgttcgtatttttaaacaggaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaaggtaagcctaaaagctggcaaatcaggcatcttgtacactggctcatttaatgtttacttgttttgtttcttttgaaaattgtttttattcttggactaagcacagctcctttctgcagcaaatgtagtctaattttcttccatctcttaataataatttttgttctttggatttagagtgatagagattatttgacctagaaaagcatgggaggacctttactggatgctagtaatgaagggccattatgaaattataaaatttcaatgtcatgttatcagctggaacactgctgatcaaaatttctcaatatctggttttataaaagattgtataattcaggccagcttaactta

SEQ ID NO: 58081 - DNA, 1107 bp, Homo sapiens
ttatgtagccattctttagagtatgtctgctagcaacaagtgtctcagtttacccgtttattcctggaatgacagttcttttctttcagtgcttgaaaaatgtgccacttccttctggccttcatggtttctgatgagaaatcccttttcattcatattgttgttcccctatagataaggcatcatttttctcttgcagctttcaagattttttcattgtctttagttttcagaagtttgtatttctcggagtggatttctttgggctcatcctagttgatgttcttgaatctgtaggttttgtatctcttgccagatttaggaaattttcagccattatttcttcaaataaccttaacatcccagtctgtattctctccttccaggattctgatgacatgaatattacatcttttgttatagttctacaggtctctgaggctctgtgtgtatagatacatatgtgtgtgtgtgtgtatatatatatatgtatacacacacacacacatacatatacacacatatatacacacagacacatatatatatatgtctatggtaatttttattccatcttccagtttgctaattctttccctttttttcctccattggctgctgaattcatctattgagtttatttctgttactatatttttcagttctaaaattcccatttggttcttctctgtatcttctgtttctttgctaagattttctgggcttttttccccatctgtttcaggcatgttcataattgttgaagcatttttatgatggctgcattataatccttgtcagataattctaacatttatgtcatttctgtattagtgtctattgattgtcttttcttattcgagttgagattttctttgttcttgagttgacaagtgattttcagttgaaacctgggcattttgggtattatgagactgtagatcttatttattttttactttttcttgagacagagtctcactctgttgcctaggctggagcccagtggcgccatcttgggtcactgcaacttctgcctcccaggttcaagcgattctcctgcctcaagcctcccgagtagctgggactacaggtgcacaccaccat

SEQ ID NO: 58082 - DNA, 1184 bp, Homo sapiens
gttgacattctctagaaggactcactgattgcctgactacaggtattctagacccagtagaagagacacacagagtccttttgtgtgcaggctttaacttaatccctctatatttataaccttagcttacccctgccttcctctgttcctagagtcctgagtctggcagtatatttattttgtctctgatataaataattttttgagcacttattatgtaccaggcattgagcacttattatgtatcaggcattgagtacttattatgtgccaagccaagaattctgtatgtattaaattctttcaacagccttctgcaggtcgataccgtttttattcctgtgttatagatgaggaaattgaagcccataaagcttaagtaacgtgctaagatcacacagctaggaggtagtaatgtctaggcttgagtagaagtctgacttttgagccatattcttaaccatggagattatattgcctgctgagtttctcaatagcacctcctcttgatttcaaaacctgggtaaagtatcggttttgggttacttttttacttgttccatttgttttttgtttttgtttcctgccttcctgtgggctacttggacaagtttttagaattccattttgctttatctgtagtgttttttgagtgtatacccttgtgtagctttagtggttactaggttttacatcatacatttataacttaccacagtctactggtgataagttgtattggtgaacattttaccagttcaagtgaagtgtagaaaccttaccttcctgttgtccccttgtcctttcttgtgtgtaatataattgtcttaaatatttgctctacatacattgacacccacataagacagtgttaaaatgtgtgtttcaaacatcaaaactcaagaagagaaaaagtaattttttttttttttgagacggattcatgctctgtcacccaggctggagtgcaatgctgcgatatctgctcactgcaacctccgcctcccaagttcaagtgattctccagcctcagcctcccgagtagctgggactacaggcgtgcactaccacacccagctaatttttgtatttttagtagagaccgggtttcaccatgttgaccaggatggtctcgatctcttgacctcatgatccgcccgccttgacctcctaaagtgctggga

SEQ ID NO: 58083 - DNA, 1060 bp, Homo sapiens
tatgctatagatgtgctttacttttttaattgtaaaactattttataacacttgaatgtttgaggatagacattgtggttattttaaatagcttggtattgatatgaaataatttgacttctctaatgttatgcattgtaggctattccagggtttttcttttttaattatttaaaaaattcttttaaattctttttgtttaaattctttttgttttaaattcttggaataaattcccagaattacaatgactgcatcaatagatatgactttttaaatacttctgttatattttgcccatttgccctccagaaagtttatacaaagttatagtagtgatgtaagggattgatcacatctgtttccagaatccatggttagctttaataaatgttccttcattttggctattttaatagatataagaagacacagagagattatttggtatgcagtgtaatttatattcaataaaagtatcacaagtgataaagaacctttaggaaataatttggatacctggctattgttgcctctattcttgtatttgtttcaatttttaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatggtaagacattttttaattaatatttaaatatgaggagaatgaatgatgactatatatttgcaaatctcattgtagatattttaatacttagatttttaaatattcagccattagtaatacagtttatcatggtttatgtagatcctgagtccatgctgtccttgaagcacctttcttgggagaaattcattgtattatggatctgtatcaggcgctgagaatatctcaatactgaaatgaaatattttcagattgtaattgtagtataattgtgatattgacttttcatttagaataaaaagtctcggttaggacagaagcttg

SEQ ID NO: 58084 - DNA, 1334 bp, Homo sapiens
cagtcttggctcactgcaacctctgtctcctgggttcgagtgattctcgtgcctcagcctcctgagtagctggtactacaggtgcgcactgccatgcctggctaatttttgtatgtttagcagagatggggtttcactgtgttggccaggctggtctcaaactcctggccccaagcaatccactcacctcagcctcccaaagtgtccggccttaagtggatttttaaggttggtaaaatatcaacaggctgaagtatgaaaatatgggagggatgttcagtaggcatcagtgagagaagacctaaagaattttcctgcttggccaggttgtggataaagagaatgccaggggatgggatcggtgccatctattttgtgttggttctcgaatgcctagctcaaaagtttgggctttttagggaaggtagggtagatccattgaaggattttgacttagtaactcaatcagagctatgagtttgtaaggtttgtctgacagcaatgtggagttgagttttggaggagtgtaaaaccagtttggaggggtagattatatgagtgatgaggaaggcctgagctaggaaatagaaaagacattgaggaggtagggatgacaaatttgagaatagattgcatatagtgctgatgagtaagagagtgacgtgaaaaatggtgagagcaaataatgatgctgttgataaagtgtaaggtcattggaaaaagacagctttggagaagctgaatgtggtctaggggtcaggagacaggtttggatttatgggagagatttgtattctttcagatgggctcattgaaaccttgtgaatagaggacatgatctagagaaaaagtgggagggggagaaaagaaaattgccaagcacacaatctgtagttagaggttaagaggaggaataagtggagataataagttagctaacggttataaagtactttctctgagctaggcagattttcaagtgccttccatgtattaatctatgtagaggaagaagagagtacagattggtgtggcgtcttcatagaagccaatcagagcagttgagtctgagggctgagaatgggttgctctgtttagtcctttggcagcttgggactcctcagcagctggaacagaaaccagattacaatgattttagaatggtgtgggagacaagggcaaaaggttgacgcttacttgtaaaaacttaaggatggaagaaaggtgataacgctagtactttgaaagagtagcaggatcttgcaaaaggcttttcttgaatgatacagaaggttcattaggataaaacttaggaaggaatatttatttttatt

SEQ ID NO: 58085 - DNA, 1232 bp, Homo sapiens
tagaggcacatgccaccatgcctggctaatttttattcttttagtagagatggggtttcaccatgttggccaggctgatctcgaactcctgacctcatgatctgcccgcctcagcctcccaaagcactgggattacaggcgtgagccactgtgcccagccgtttttattcttttttagaacagggtctcactattttgcccaggcttgtctcgaactcctgggctcaagtgatcttcctgcctcagcctccctaagtactgcgattgcaggtgtgaaccaccacacctggcttcctttagattttttaatttcttgtcatgaagtggtacaaaaagtagtcttttataattattttattctcatctctctgctttattttttaagtggcagacttctctaccatgtttttctacactattatacaatgtaaagaacaagggtttctactggtaaatggtcttattactcatctaaaatataaatctttttatttatcaagaatcataagacatattttaaataactatgtgacttcacgaagcataagtaggccaggcatgatggctcatgcctgtaatctcagcactttgggagactgaggtgggaggatcacttgagcccaggagttcgagaccagcttgggctacatagggagacccccccccgcaccatctctaaaatatatatatatagttaaaaaaagaataattagtgtaagagataacaatggctcataaattgtattactgttgatcacttatgatataatctgaaatcacaacgaactgctgagggtttcgtacaaaaaaagtttaatttttatttccaaataactttaaaaagctagaacagcttttagattttgagacggccatctcaatatatttgtttatcttctgcagaatgaataaaaaggattatttttaatttcttaagccagtctgagagcctctgtctctgaagccagtctgaaaaaatctttgcattaattatactgattcatttattttgcaaatattttacaaatacatattaaagcacctgtatgccctttcttttctaggcacaatggcatatctgtgaataaaattgacaaagtacttacctttaaggagcttatactctcgtaaaagggagacaatgaagaaacaaataaatgaatcaatgtataatgggacaagcggtgataactaccatgaaggaaaatgaagtaggggccgggtacagtggc

SEQ ID NO: 58086 - DNA, 1478 bp, Homo sapiens
tcttagaagtatatacagtgaaaagacaatggtaacatctgcctccttttcatttgtgaagccagaacaccacattcctcagcttttacacatctgagacacttttttgctaaagggatagcttggcgcttcagtgagctgctgaatatgctcagtcattcaactcttcactgtccaggagtcatccctgcctgggaaggttccaagtttcccagcaagcaccagttcccttgggagtgtgtcctatagtgaataaatgtcaaattctccccatggccaaaaggtgagggggaaggaaataactagagagtgaaagagaaaggtctttgctttcaagtagaatcatctagtcctctgtttggctgctcagaattggacttgcagagccgattcatgatgccctggagcatgggctggacaatgcccaagagaggcctcttcaaggggtcgccatcccaacaggcttccatcaactgccagcactcctcatcaaacacaggaagacgttctgggcgagcccctagagaaaggagcatggaaacaagatcacagtgagagggacccagcacaacaaagaggcatgaccagctcaaaggctgacttcccagtggggctcagaatactaagaatgcaaggagttttgacttcgattgcaaacatctaggttagaacctaacagtaagagcaattaaaaaaaaaaagaaagaaagaaaaagaaaagaaaaactggaacacattagcatatgaagttgaagaatcggacattttttaaaaaagacttttcgagatagttcaatagagagttgacttgaagcaaaggttgacttaaatatcttttctggattcatgacagtttaaacgtatctacggccctgctatggagtggccagatgggatgacaggagacccggtgacattgcctgggctcagtctgcgctagccaggggagttaggacaaggtagtacttgtggctcttacccctccgcacattgttccagagatggtctttgctagcacacctctcaaatgcctcagggagcttgacagagcctgagcagatataccagaaaagaattccaaaagcgtagacatccacggaattatcgtacttccctgatggcaagaaaggatgaaacgtaatgagccacagagagtcaggcagcagcatctacaccaccttgcctcagtagagggttggctttttccaaagcttttaacaactattatctctcaataacaaccctgccaggtaggcagggtacatttataatgcccattttacaatacaatcaactaagacattgggaggtcacagctcaatactaagagagccaagcctagaacttgacaaaggagaaggaaaataaggcctttcattctgctaggacagtcaaaaagattaatcacaaaaggtcatattagggaaataaagttggaaatacaggtgggtaggtatgttggaaccagaatataataa

SEQ ID NO: 58087 - DNA, 1856 bp, Homo sapiens
gatgactatctacttggttcagatgttgagtacgactacagctgtctcactaacacctaatccttacatgtatcacccagtgaagggctgggggaagactcgtacatgaaatgaaagaaatttaaatatattgctaattttaactcttaccaatactaatgactgaccagggactacctttctatcttcgctggcaatggaacaatcattcccatcacttgggctcaaaaccgtggagtcatcttttagtcattcttttctgttcactaaccatatcaagttagcaccaaaattttgttcattcttcctctgaattaatctcaaatttctcacgtttgtttgttttagcactaacaccagcttaatcatggaggcaaccatagaagaccagctatctagtcttaccttggttcttcccaaatcatctttacctactgttgctaaagctcatcttctatcaacattttcctctgtcccctactcaaaagctcagtagctccttaagtcttgcacaacaagccttgattcttctgtgggaatttcaaactcaatgtattttatctccaaccttgtttgctactattccccaaatggatttctttcctgtcatgcttatttctattctgtgattttcttcattatttccccttctttagcctccagaattttctctccttcatgctacagggttatactatggagacagaaagtcctagtcttaaatcatagctccattaccttttagctcaatggttttgggagtaggtttcttcatcaatctggtctcaattttatccattgaatggacataaaaatacatcatcgtcacagaattaaacaaaatatgtgaaaaacctacccatactgcttaggtcaaggtatatacttaataaatgagttcccttctcacctaccaatttcccaaatctgactcaagttctattcaaaatctcacctccatcacaaaaccaccaaacatttccaccttcatttattccttctctaaacaccaacagtacattatatagcacttaatttagcacttaatcatacgttgtgttgtactgcttcctattttacctcttaatatatctctatgtcaacggtaagttctttaatgatagaggacaactcctatcacacaggagttattcaatcaatactttatgattaaataattggctgattatggcagttatggcactaataaccgagagagatgtccaaatggtgattcccatttgtactttttctttcttactcctttacctcttcactttccctgctacttgccttaggtaggtctcccctgatctggtttctcccttgcctgtgccagacctgccagtagtgattgtggaaacgagctcaaggggtagcactcaggattaaagtagtacgccctgcccagacccactgcctgccctccagccttacctgtgaaaagttcaggggccatatggattggtgtccccacaatgctgcctgacatcatggcctctggcttgcagaatcctaagtcagtgatcttggcacggttctgcttatccagctgccaacaaagcagggcaagagtcaccttgtttctgatcctgcacacagcactgctgcgtacctaagctcaaaggtaggtacctcaaagtagtgtcactggataggattatgctctgaaaatgagttgtcaggtgatttcatccttgtacaaacaccagactgtgcttacaccaacccagatggtatacctgctacacacctagtatggtcttttgctactaggctacaaacctgtacagcgtattactgtactgaataccataggcaactgtaacacaatggtatttgtgtatctaaacata

SEQ ID NO: 58088 - DNA, 1697 bp, Homo sapiens
cttttaaaaataaatttagtgtagcctaaatatacagtgtttataaagcctacagtggtgtacagtaacgtcctaggccttcacattcactcaccactcactcactgactcacccagagcaacttccacttctgcgagctccattcattgtaaatgccctctacaggtataccattttttatcttttataccatattcttactgtaccttttctatgtttaagtatgtttagatacacaaataccattgtgttacagttgcctatggtattcagtacagtaatacgctgtacaggtttgtagcctagtagcaaaagaccatactaggtgtgtagcaggtataccatctgggttggtgtaagcacagtctggtgtttgtacaaggatgaaatcacctgacaactcattttcagagcataatcctatccagtgacactactttgaggtacctacctttgagcttaggtacgcagcagtgctgtgtgcaggatcagaaacaaggtgactcttgccctgctttgttggcagctggataagcagaaccgtgccaagatcactgacttaggattctgcaagccagaggccatgatgtcaggcagcattgtggggacaccaatccatatggcccctgaacttttcacaggtaaggctggagggcaggcagtgggtctgggcagggcgtactactttaatcctgagtgctaccccttgagctcgtttccacaatcactactggcaggtctggcacaggcaagggagaaaccagatcaggggagacctacctaaggcaagtagcagggaaagtgaagaggtaaaggagtaagaaagaaaaagtacaaatgggaatcaccatttggacatctctctcggttattagtgccataactgccataatcagccaattatttaatcataaagtattgattgaataactcctgtgtgataggagttgtcctctatcattaaagaacttaccgttgacatagagatatattaagaggtaaaataggaagcagtacaacacaacgtatgattaagtgctaaattaagtgctatataatgtactgttggtgtttagagaaggaataaatgaaggtggaaatgtttggtggttttgtgatggaggtgagattttgaatagaacttgagtcagatttgggaaattggtaggtgagaagggaactcatttattaagtatataccttgacctaagcagtatgggtaggtttttcacatattttgtttaattctgtgacgatgatgtatttttatgtccattcaatggataaaattgagaccagattgatgaagaaacctactcccaaaaccattgagctaaaaggtaatggagctatgatttaagactaggactttctgtctccatagtataaccctgtagcatgaaggagagaaaattctggaggctaaagaaggggaaataatgaagaaaatcacagaatagaaataagcatgacaggaaagaaatccatttggggaatagtagcaaacaaggttggagataaaatacattgagtttgaaattcccacagaagaatcaaggcttgttgtgcaagacttaaggagctactgagcttttgagtaggggacagaggaaaatgttgatagaagatgagctttagcaacagtaggtaaagatgatttgggaagaaccaaggtaagactagatagctggtcttc

SEQ ID NO: 58089 - DNA, 1055 bp, Homo sapiens
agactgtgagaagctactaaaggattttatttgagtgaaggtgaaaccctcagttggatgttgagtttcccttatctaaaccaccaagagggaattagagaggtttcttttgtctgttccctatgtaggagctgagtagaaggagagaaaagctgacctcagagtctccgagtagatcccttctcacagattcctcttggaccagtttatatggaggcttccagaagtagggcagaggaaaccttagaaatgcttcccagagtcatgaggaatcaatatgatgaagaaaatgactctccaagcagctttccctcttcatttcagaggagttaagcattgtctgatgcatttccacaagtgagctagagaatgtcctttgagcttttgaatgagtgatgtgacattttccagtattcaggagaccctgaattgaagtaatatgagtgactttggtatttgaatccataaaaccaaacctgggctaaccaggcctgtaaagcaatggaaataaatcttcctgagggacctagaaatagtcactttgagcctcaagggcagttccagaattttttcaagtgttagaaatgagctcatgccttagttgtttggttctatctgctagtcacatttgaagttatctgttcggcttaactgcagcctgcaagggattttatctggctttgtctcctttacaacttgctcttccttgcttttcctctacttccctctcctaactgctttttctcccccaaccttttttttttttttttgagacagagtcttgctctgtcacccaggctgaagtgcagtggcaccatctcaactcactgcaagctctgcctcctgggttcaagtgattctcctgcctcagcctcccaggtagctgggattacaggcacctgccaccacatccagctaattcttttttgcatttttagtagagacaggatttcaccatgtttgccaggctggtcttgaaattcttgaccttggcctccctaagtgctggggttacaggcatgagccactgtgcccggctcttcccctttttaaaa

SEQ ID NO: 58090 - DNA, 1068 bp, Homo sapiens
tatgtatagtacttaactcagagttataaagacaccatcccccagccacccagttcttctccatatgttcttctgcacttgtctttttcatttaatatgtatcttagagggcattccataaatattcatacaaatttgtcttcttctaatggatatgcctgaatttattgaactattctctcattggtggacatttaagctgtttgtttttgttttttatttttatttatttatttttttttgagacaggatcttgttctgtcgcccaggctggagtgcagaggcctggtctagtctcactacaacctccgcctcctgggttcaaggaatcctcccacctcagcctccctagtagctgggtctaaaggtgtgcaccatcacacctgggtctaaaggtgtgcaccatcacaccatcatacctgtatttagtagagacagggtttcaccatgttggccaggcttatttgtttattttttattttctctttcgctaatacaaaatgtactgcattaatcatcattgtacatatacaccttgggacttgtaagggtatatctcaagaaaaagaattcctagaagcaaaatagttagatcaaagggtatgtagatttttcttggttggttgaacattttaatagatattgccaaatttcctctgaagaagtggcacccatttaagtttccaccagtagacatgagagtgccttttcaggagcacatctttttgcaagtagtttgacttctctcaagttcttctgtcctctgatttacaacattaatagatgttctaatcctaagagatagtgtggcatggtggggacaattgagttttactttttatttatctagtaattgattagaataaaattcctggccggcggcaatggctcatgcctgtaatctcagcactttgggaggccaaggtgagcggatcacctgaggtcaggagttcaagaccagcctggccaacatggtgaaaccccatctctactaaatacaaaaattagtctggcgtggtggtgggtgcctgtaatcctaggtacttgggaggctgaggcacaagatca

SEQ ID NO: 58091 - DNA, 1378 bp, Homo sapiens
tctgataatttccattacaattcctttttcttccattatttgtcttaattcttcatcagagggaatcagtgggaatgtctaagcaataaaggaaggcagagaccaaaatttttttttaatctgatggctaaaggggttgccatcctttctacttctttgttttttcactctctctagatgagtgcctgccttcataggctgcaccagggagtgttggtaaccgaggaaggaggtggatcaatggctggggtaccgaagtccaattgttccattgtagatcaggattttggtctcagtgtgggactttggggagacagggattggttctgaccctgaggcgctgatatatgacccccttccccttccaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaaggtaggtcccagagagcttgttggggtgctggcacgggaggagtctctaaccattttctagccggaaattaagaacgttaattcctaaggttaaaggaatctcagggtaacttcatccaccccactgttaccagcaggagcccactatttagccaaggtggcctctcttgctctcaaagatcattgtggaagattccaccctcattccttcccaagaacattagctcaacttttggtaaattcatcctaatagctctgtaatctccactttctgcctgtaccccctcaacccctaatggagctggagaagagctgcttggagaatgttagtaaattgtgct

SEQ ID NO: 58092 - DNA, 1116 bp, Homo sapiens
tctttagggcagctttgtaatataaaaaatatttccacctataattctttactttaatgtaactgttttcttttcttttctttttttttttttttttttttgagacagtctcattctgtcacccaggttggagtgcatggtgtgatctcagttcactgcagcctccgtctcctcggttcaagcaattctcctgcctcagcttcctgagtagctggaattataggtgtgcaccagcatgtctggctaatttttgtattttcagtagagacggggtctccccatattggccaggctggtcttgaactcctgacctcaaacgatctgcccaccccagcctcccaaagtgctgggattacaagtgtgagccaccacacccagcctaatgtaactgttttcctttccttttagtctttatctcattgttatatgtgattataatgttgtcatttatgcagttgtatgttctattttaaaccttaaaatttgttacttaccaactttttgaatatgcctgactgaaatgattcatactgtagcatgtgtgactcagggtagtgaaagggggtttgttttgaatagcaagatgagcatcagactagtcttccaaccagaaaacattccatgcaacttgagacacagatgaaacagcaaatttcttcttggcttggggttggataaagggtggattgacttatgtagtgtttgctaaaatgacaaatggtgagatgctaaaagcactttgagctttagggagttcaaagtggccaggcaaattaaagttatgtgacctatctgagaatatagcatagttctttgtgagaaaagaaagtgagatatttgtgctttgttggaaataaaaaagattttaaaaactcaaggctgggcacagtggttcacacctgtaatctcagcactttgggaggctgaggcgcagatcgcttgagctcaggagttcaagaccaacctgggcaacatggcaaaaccccatctctaccaaaaaaaaaaaacccaaaaaagaatgaaaattagctgggcgtagtggctcacacctgtagtatcagctacttgggtggctgaggtgggaggaccacttgagcctgggaggttgagactaca

SEQ ID NO: 58093 - DNA, 1698 bp, Homo sapiens
aaaggtaggaaagactgctgagtgagatcctcagggcaagaagatactgttggaggaaggagtctatggaattgggccaaaaaatggtcaactccaagggaaaagaaacaaggatcatttatatgtacaggacagagaaacaagaaatgatattctagaggtataattaaaattttaaaaactcttattttatgtggcaaaaaaaggaaactgaagtgatatatttaaaaaggatgtggaaagttcaggtaaatgctaaattataaattcttcatggcagtaatcctattttgtttttaatatctctctcacctttaccctagcatgcactagcatacatagtaaaatctaaccatcctgcatacattgctctttaccaaaaaacctgggagttcctgttataggctaatatacctatgaaggatatgtgtgattcagaggcaataattttttttaatccctatgctcactatagtaaccttgatatctcttaaaagaacagcctggctgggcacagtggctcacgcctgtaatgccagcactttgggaggccgaggcaggcagagcgcttgagttcaggagtttgagaccagcctgggcaacaaggcaaaaccctctttctacaaaaaatacaaaaattagctgggtgtggtagcacatgcctgtagtcccagctactcaggaggctgaggcgggaagaccacttgagcctgggaagtggaggttgcggtaagctgagaccgcgccattgcattccagcctgggtctctgtctcaaaaaataactaaataaataaaaacatcctgtgtggccataaaaaagaatgagttcatgtcctttgcagggacatggatgaagctggaagccatcattcttagcaaactaacacgggaacagaaaaccaaacactgcatgttctcactcataagtgggagttgaacaatgagaacacatggacacaaggcggggagcatcacacacgggggcctgtcgggggctggggggaaaggggagggagagtattaggacaaatacctaattcaggtggagcttgaaacctagatgacgggttgataggtgcagcaaaccatacctatgtaacaaacctgcacgttccccacatgtatcccagaacttaaagtaaaaacaaaacaaaacaaaataacatcctgaagctgaggctgtattttctcaattcactgtcagtgattcatctctggccttccagggttagctcttgaggcaaaaatctgacagcagtcacagtcttaatcttcttcttttgtcttctgcctttgctaggattctacctctttcctgcaccaaatggcttcctttctgtttttactatctcacatatttgtttgtttccttctgagtagaggatggatggggtagggaatcttccctaattcagagactcagagattgaaaagtattgtcaacgggcagaaactgttgttaggactattaacaatattttctttttgactgctattgtgatgtctcagccaatccatagaggatattatcttgtttgataacaaagcctttactttgtaaccagcatatacttcttaatacagaaccctagctagaattgttaggacccctgaaagcatctagtctatctttttttttttttttttgagacggactctcactctgttgcccaggctggagtgcagtggcgcgatc

SEQ ID NO: 58094 - DNA, 1021 bp, Homo sapiens
ggatgaaataggatggttcttcctgctttagatgattataaacaggtaattagaataaagcatggtaggtgttctgcagttgagaataaggtatgaaggaactcaggactggcctgttgctacttgttaagtggccacacaagcaatttgctgtgtcctcttgcttttaggttgtagatcaaaagagtagactagtggtctggtgttatactcttgtatttagtaaatacccttgcacagaattatatacttagttaactctgttggtttttgaaaggcactcatctctttccaaggagagtagatttgcttgtttcagtgtctggtgttgctgatgtatatgtgcgggccaggctgatatccttatagacagacatgaaaagaagggccctaatgaaatgcatagagggatctgcgtgaacacagacctctttaacccttttggtgttactgtttgtggaagagaaggatgcttggggatttgaaatcgtagctaggtaggttcactctgaagtagaaccacctcttaattgattcaggcctcttatgcttccaattctggaaacaaacaaaataaatggcctacaaataatttaatgcagcttatggttaagtgactaaagcaaatactgtttcagttagtgccacccaaaatttcagttatgatggatgtgtttggctcaaggattggcccttttgcagcctaagaactgtgtctgtgcttttctgaacaaatgcaggaattgcctgaatcttagagataggcagacactgatactgaaggaataaggaagtgatatagttcaggctgagagtttcagtgaactaatttcggattatttttctcaaacacagattctcattctttaggaagcttgttctgtcttgaacattatttgaacgtgtttggggaagttatccatttagattagtagtagttgccttgaaaggagaagttttttttgtttttttttgttttagatttttattttttattttttttgtacaaaacgtaagggtg

SEQ ID NO: 58095 - DNA, 1031 bp, Homo sapiens
cagatcacctgaggtcaggagtccgaaaccagcctggccaacatggcgaaaccctgattctattaaaaatacaaaaaatcagctgggcgtggtggtaatcccagctactcgggagactgaggcaggagaatcgctttaacccgggaagcggaggttgcagtgagccaagatcacgccattgcactccagcctgggcaacagagcgagactccatctcaaaaaaaaaaaaaaaaaaaaaacccaagagtaggacccttccattcatcttgtggaatttaactaccatagtctcagctcgagcagtgagaagtccagctagactgtcttcacctcacctacacttcctagctttcttctattccctgtcctccccagattttcacataagtgtctacgcatgaatgcatactgacaacctttaaattcctataataaaaatggtttcatcacaaaaagaccaacaaaactaaataacctttgttactgctactaccaggagagtggataatagagaagaaaaccgactaaatcacttttcaggacgagagggagagagcctctgcacctctgaaacaaagtgtcaactacaggacagccaatgaaacaggctgcatcagccaaaaccagagcagacacaccccattattcatctgacccaaatgaacacttcccccctccatctttcctacaaaaagtcaccacaaataaacttgctactgtcaaaacgaccaaagaccagcgcagtaggaaagggtgctgaagttgatcccagtacactgttagaagtccatggcaaacatcaccgtctttgttttccaacatgtcactatccaagctctttgcttctcccactaaatctttagctttttcatccatttgacatctctaccagatttgaacaagggcatggagagaaatgaagttgaaagcagatggttttactcctggattcttgcacactgctcagtgatgtggtggaatgcaatatggaagtgggaacagcacgagaatgaaggcaggctttgccactc

SEQ ID NO: 58096 - DNA, 1090 bp, Homo sapiens
aagtactttcatcctcaaagtgtctaactttagtttcatcagattaagagctttagtgcctgggaggctgaggcagaagaatcgcctgaacctgggaggcagagattgaagtgagtcgagatcgcgccaccacactccagcctggcgacagagcgaggctccatctcaaaaaaaaaaaaaaaagctttagtgccttatttatgccagacaaatttcagtttagatcttttttttaatattttctagtctatttaatggggagagaatttcccagggtttttttgtttttgttttttttaaatcaagtcaaacttgccagagcaaagactaaggccctatcacaaatgcagctaggttacaagactattttaaataaaagctctttctattcaaatgagagggacagtgagaatgaaccagtatggagtttacgttttaggaatattccatatgatatactctagccttagcgtttaatattatggcgatatctaggtgcaaggaggaatgtgggggaatatagctagtaaagaaaagtcattcttattttttagtatataagaaccccactgaggaaacctctttcactttctcctgattgaacaactgacatgctcttctggttctgtcccatggagagaattggaaaagttttgctgctttaacttggaaaagtggtttgttggtataggataaaagtagttagtgtataatggcaatatagtctctaccactaataaacataaggggccactacaggcagtgcaaaatcaaagtcaagcttcctctgttggtttctttctttctttctttcttttttttttgagacggagtttcactcttgttgcccaggctggagtacaatggcgtgatcttggctcaccgcagcctccacctcccgggttcaagcgattcttctgcctcagcctaccgagtagctgggattacaggcatgtgccaccacgcccagctaattctgtatttttaatagagacggggtttctccatgatggtcaggctggtctcaaactcccgacctcaggtgatccgcccgcctcagcctcccaaagtgctgggattacaggcatga

SEQ ID NO: 58097 - DNA, 1066 bp, Homo sapiens
acactttggcaggctgaggcgggtggatcacctgaggtcaagaggttgagaccagcctgaccaacatggagaaaccccatgtctactaaaaatacaaaattagccgggcatggtggtgcatgcctgtaatcccagctactcaggaggctgaggcaggagaatcgcttgaacccgggaggcggaggttttggtgagccgagattgcaccattgcactctagcctgggcgacagagcgagactctgtctcaaaaacaaaaaactaaaaaaaaaaccaaaaaaaaccagtgcctgctaaggtgctatgtaagtattagctattattcaataaatacctgagtgcctggtatgtactgagcaatgtgctgcgtatgggggataaagagtcaaataaagacattggccttggccttaggccagtgaagatcagtctttcccttctatacttttaagaaagaaaaaataattataattatcatcaataatcatttatgtttgatgatggattaaaaaggtctaagaagacctgaacttggtcctctagaaaggtataatctaatctaaaccatatacgtgtgcaacacataaaacacgtacataaaaaagcagaatgctaagggaggttataagcattttatatgagttataattctcaggttttttttatagctctttgcctttggtgagcttacagctatgtttctccaacattcttcaccttctttttgtcacaccttttaaatgtgccagcatttaaaagaaggggaaaagcactagtgtacttatttaaaataggcattttcggctgggcgcggtggctcactcatgtaattccagcactttgggaggctgaggcaggtggatcacctgaggtcaggagctcgagactagcctgccagcatggtgaaacatcgtctccactaaaatacaaaaaattagctgggcatggcggtgcgggcctataatcccagctgctcaggaggctgaggcaggagaatcgctggaacccaggaggcagagattgcagtgagctgagatcatgccagtgcactccagcttgggtgatag

SEQ ID NO: 58098 - DNA, 1033 bp, Homo sapiens
ttttccaatgctggcacagttttccaatgatagaaaaattccattattgactctggaactgggtagaagttgacttgttttagatttgatggtggtaccacagaagggtgtttaatttttaatgctcccctacctcatacctgtgtttggtcaaggcagataagcagttctggtttgcttttgttttcattttaaactttggagatgagaacttttggtatcttagttccatttctgttttctcatgacagctccaggcactgtgatgaattaagtgcattggaagaaatcatcttgagaaaggggcaaaaataataataataataataaaggactctgtgtaaagcacctccgtagaggttggggcggtattggaagaggagagaatttttatctttgccaaagaaatctgaatggtgtttagtgacagttagtggtttcatgggctcctatggtctccctctgttccttcagcactgtggaccatcttactgtacactgtaaatttctgctacagtgccctgggatctgtgattatagggtgggaagggccagtgaaaagtagtagttaagcagcaattttaaaactgtaattgaaaaataacctaaaaatggacattgcctcacaggaggctcatgcagatacattgagggccttctcaactgttccacacacctgtgggaccttcggggaaaatctcagtagacatcctgcaacaggagcacaacaattcagtcccattcttcagccacttgcagcttggattcctgttgaaacactcgagttcatgtttcgattcatttgtccttattgcccagccttttgctgctaacagattccctgcttgttgggaggagatgctggggttgctaagccacagagagtgctggctgaccaaaagtacaccacaattctacagcaagaaaacccagttccattgcatatgggaggagaggtggggcttaggggaatactgcagacagggagcacacattcctgctaagaatacagcatacgggccgggagcggtgg

SEQ ID NO: 58099 - DNA, 1029 bp, Homo sapiens
ttggtaggccgaggttggtggatcacttgaggccaggagtttgagaccatcctggccaacatggtaaaatcctgtctctactaaaaatacaaaaattagccaagtgcagtggcacacacctgtagtcccagctacttgggagactgaggtgggaggatcgcctgagcccaggaggttgaagctgcagtgagccatgatcatgccattgcactccagcctgggctacagagcaagaccctatctcaaaaaaaaaaaaaaaaaaaaaaaaaacacaaaaaaacacacacacaaaaaacaacaaccgaaaaaaaaaaaaaaaaccacaacgtgtggtagatacttctgaggcccaggatgagtggccaagcataagagtgagctggttctatcctgatatgtgatggaagtctgaaggcacgggaggaaattaccaacctccccacctctctcacagtgggaagaattgagtctttcctgaaaggaggtgtctggggatgctggccatgggctttccccctggacttcccctaaggttctctttcctctcacaaaagcccctttaagtaatttccctggagatttctgagcagtattaatatatttccctgaagaaaaagggggagctccaaattccatcattcccctcctggtttgaagcacttttgactcaagactcatttgggttccagttcatgttccagtcacaccatacactggtcttcctgcctacttagtgaagagcaggaaagataattcgaagccagatatctgagagaaagtcacaactgagtcctgtgtggttctccctgctggctctccgcctttcctggtggtcacaggcagcttcctcccactgtgagtggcgtgtgttccttcaccactcctgcagagagcccactagagaagggttcatgcagtcagcagataccaccttcagcaggaaaggtgctgctgaattaaattgtgaaacatgcttataaaagtgcctgaaaacatgtacgcagtttaaataacagaagcaaagcagac

SEQ ID NO: 58100 - DNA, 1041 bp, Homo sapiens
ttgttcagcccttaatgagcagacactctgcatgtagaggcagccaggcccacctctcatgggtgagtcaatgaatacattttaaaaatcaaattagaaaaatcctgtcaagcaggagtctctggtatgcagctattttatgaggagggaaaacgtgaaccttgctgtctttggttgcctagggctcccatgaagacctcctgagcagggggaagacgttggggtgggcagtgggcactgtcggaagctggtgaaggactgtggatgtttgcaggggcctgggggaagtggggcaggctcattagctggggagcttctctgtggggctctgccatgtggctcactgtgcccaagatatccagatgggagggaggaactctttttttgctgcttatggaagacgagacccagacactttgggtgacctgatgaggggacggttccctgggttcagggtgatcatgggggaaatggttgttcttgtgactattttatatccttctttagaaccctcagctttgttaggtgtatggcctggttgatctttataacatacctgtgaagttggcagagcaggtgttatctccattttacagatgagtagactaaggcctagaggaaaagagactgcttgcctatggcacccagctaggtcttggcagggagacaagggatcctagtctgtacccaagactcatctgagaggtgacgtcactgaacccggctggggaccattttatgcaaagtctatggagagcaggtttgcctcagcccgagtgggatgattttatctcttggttgccatttccccttcagttgcatagatttcctgacctggagctgtccttccaggaatgggcgtggccctgggggtcctgaggagagaaaggttgcttccctgtcacagaggaaaaaggtcttccagccatcggtaaaccctgctctgtcagctgactcccccagacccagaggccctgggctggtgtgagaagcagtagtggttctgccctgatctctgggcatgaataggaggtattcttc

SEQ ID NO: 58101 - DNA, 1251 bp, Homo sapiens
tgtaatcccagcactttgggaggccaaggcaggcagatcacttgaggtcaggagttcgagaccagcctggccaacacggtgaaaccccatctctactgaaaatacaaaaattagccaggcatggtggtgggtgcctgtaatactggcttctcgggaggcagaggcaggagaatcccttgaaccagggaggtggaaggtgcagtgagctgagattacgctactgcagtccagcctgggcaacagagcgagactgtgtctcaaatagataaacaaacaaataaataaaagagttctgggctggaggttctgtcccttcctggccgtgtgtccctgaacaacttgtttgacctttctgggccaaaagaggagcagctctgcctagactgcattttggggatgctgtggggacggggtagagagcagatgtgaaagccctgtgtaagtggctgtcagggatactgctcttgtggtggttgtcttcttttggactcctgcatccattttctagatagaaaaaccaagtccagaggcatccaggggcactcctatggtcccagggtttacccatgcttcctctgcctgcctctttccccaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgt

SEQ ID NO: 58102 - DNA, 1041 bp, Homo sapiens
acaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaagcaggccctgctgttctctttggtgactgaggtggggagggatggtgctgagcaggtttttgagccttctcctaatactcgttcccctaggctgccagggatgggaaatagaaaaactgccgaatcaaaacaaacgtgagctcagtagctctggcctgaccctattaagcacacaggtgggaaggccctgggcccagggtcccagttgctcttccggcctttggcactaaagtagaagtggatttggcagattatcccaccctgcccccaccacctgcctccttctcctcccacccctgctcctgtctgcttgagccctgctcctgctgcgtaa

SEQ ID NO: 58103 - DNA, 1065 bp, Homo sapiens
cactgtgggaggccgaggcgggcggatcgtgaggtcaggagatcgagaccatcctggctaacacagtgaaaccccgtctctactaaaaatacaaaaaattagccgggcgtggtggcggacgcctgtagtcccagctactcgggaggctgaggcaggagaatggcctgaacccaggaggcggagcttgcagtgagccgagatcgtgccactgcactccagcctgggcaacagagcgagactccgtctcaaaaacaaaacaaaacaaaacaaaacgaaacaaacaaaaaaagaacttgcagtgagaatttctggaaagggcagcccagaaaggatggcaaatttgtcaaaagttagttagcagtggttaactggttctcaaacttgagtttaaagtacgtaaggatcacctgggatgtttgtttaaaatacttacattctctggttccacacccagagtaatttattctgaaggtctaggatagggccatataatgtatattttaacaagccttttagagcaggtggtttaggcattattatgttttgccaaatccagttgggtgctggttgtgagggggtgtgtgtgtgtgtgtgtgtgtgtgtgtatggtttgccctattggctacatcagcagttacttccccagattgtgtttgcttttgcagccagtagctggtttgaaattcaagaagtcatttcattggtgaaggagagtggatgttggagaaaggggtagattatggccccatcaataggaccgagtatgtttttcctgctatcgcctggcacagtccccagttgcctgctgccaggttacagctattgggcaatcatgtacttcctggcttgccttttctttctctttctgcaaagtgtgagggcccggtgaggctccaggcttgaggctgttggacccaggctttgtcaggggcttagctggaaaatagctgctggtggcttgtgcttcgtgcctcttgggggtggagacactgggtcgtggggactggggtggcccagagactgagaaactgagattgaagttcagagttcccatcaggctcttga

SEQ ID NO: 58104 - DNA, 1048 bp, Homo sapiens
cagctcaccgcaacctccacctcccaggttcaagtgattctcctgcctcagcctcccaagtagctgggattacaggcatgcgccaccatccctggctaatttttgtatttttagtagagacggggtttctccatgttgatcaggctggtctcaaactcccgacctcaggtgatccgcccgcctcagcctcccaaagtgataggattacaggcatgagccactacgcccagccaagaaagcctcctcttttttttttttttttttttgactattacagaagtttatttaacaaaaagtctaatatgaaaatgtacatgacctaatttttacatcatagtaaaacaggacctatggagagagagcatgggtttctctgctgaccagccattatttatactcattccaaggcttctaacatgatgatactatttcctcatattaccaccattccaatattgttctgttgtccactagtcgccatttccacacattcatctatcacaaggttcataaagggatcaaatccccgcaatattccttggacatgtctgccaccatttaatttcaatgataacttcttgtccataaattttttcagctcgggagggtgagctttgctcatggtgtatactccgcgggctcacagatcgaaagcctgctcttaaagtgagcagtgatgatcaaataaaagcccaatatatgctatgtaccaggtgaggaatctctatgtggaaacaagaggaatcttcggggagtggacccttctctcctgggtggggatgagacaacaaatgagcttttgtcttccaaataaggcagttttcctaggaagagggactccggtgagggtgagcaggccagccttttgtttagccttctgtttctagcaggccctctacctctaggcctgcagagccccatggggctggactgtgggtctgtggccctgctcatttagagcctgccagaaggagagccagctcccagtgcctcagcacacacacacacatgcacacacacatgcgtgcgcgcacacacatgcatgcac

SEQ ID NO: 58105 - DNA, 1159 bp, Homo sapiens
gtgcgcgcacgcatgtgtgtgtgcatgtgtgtgtgtgtgctgaggcactgggagctggctctccttctggcaggctctaaatgagcagggccacagacccacagtccagccccatggggctctgcaggcctagaggtagagggcctgctagaaacagaaggctaaacaaaaggctggcctgctcaccctcaccggagtccctcttcctaggaaaactgccttatttggaagacaaaagctcatttgttgtctcatccccacccaggagagaagggtccactccccgaagattcctcttgtttccacatagagattcctcacctggtacatagcatatattgggcttttatttgatcatcactgctcactttaagagcaggctttcgatctgtgagcccgcggagtatacaccatgagcaaagctcaccctcccgagctgaaaaaatttatggacaagaagttatcattgaaattaaatggtggcagacatgtccaaggaatattgcggggatttgatccctttatgaaccttgtgatagatgaatgtgtggaaatggcgactagtggacaacagaacaatattggaatggtggtaatatgaggaaatagtatcatcatgttagaagccttggaatgagtataaataatggctggtcagcagagaaacccatgctctctctccataggtcctgttttactatgatgtaaaaattaggtcatgtacattttcatattagactttttgttaaataaacttctgtaatagtcaaaaaaaaaaaaaaaaaaaagaggaggctttcttggctgggcgtagtggctcatgcctgtaatcctatcactttgggaggctgaggcgggcggatcacctgaggtcgggagtttgagaccagcctgatcaacatggagaaaccccgtctctactaaaaatacaaaaattagccagggatggtggcgcatgcctgtaatcccagctacttgggaggctgaggcaggagaatcacttgaacctgggaggtggaggttgcggtgagctgagatggtgccattgcactccagcctgggcaacaagggcgaaactccgtctcaaaaaaaaaaaaaggaggttttctcatggcctgcctctccttccttgcctccctcctaactccaaattttgtct

SEQ ID NO: 58106 - DNA, 1050 bp, Homo sapiens
tgattgtagccctacattacaattctcaatgtcaaaccctggagatgaagaggtctaacatttagcccagaacctttccagtgatgaaaacaaacaacgactcttttggcattggtctgatattcagtgacagaataaagtttgttccagccgaaattagcaggctagggtccaggttaaaatgcaaacaaagaaagcagcccagaggcagctgggattctgggacacagataagtcacaaagctgggtttatctgcagggttcaggattgatcagctcagcgtatatttccaaggctcttctctactcagccacccctcccagctcaaaaaacaagaggcccacaccaaaatataaaaaggtgctggatctaaaatcctgcctaatttaagctctgctcacaaaggaggccagagagcagagggaggggtggaaatcaaataagtaaatgtcagccctgcagttgggtagaagccattagccaggcagagcatccaattagaagccattgaattagagcagtgaaagaagggcctcacgtcagagggcactgcggggagggccggcacaagtgggcaggaaggaacgcggggtggcgatcaatggaggattaccggaagatgtgcaaatggcaggaacagatgccttccaaatgacagggcacccggtccagatactctacataaaatgcccacatggttcctttgtcctcccccaaatcctgtctgagggagtccagccatctcatgggctattttggaaaacactgctcccttttgcctcaacccagagataaaatgggcagctctcagccactctcggattaatctgaacagacaaagaaggggagcaaatcccttggcaaatggtgcctgggagatttcatttttccgctttgcagtacaaacctactcaaacagatactaaaatacaaagcgaagtttgttcacatggagatgtttttatttaaaactataatattattttattttgtaatcagtaattgtcaatgctcaatctttttttttttaacaaattcttatttccttg

SEQ ID NO: 58107 - DNA, 1008 bp, Homo sapiens
tactctagaagcttacatattgggatgtattttccacacttgtcaaaaatcaagaaagatgcatgatatcatctgacttcttttttttttttgatacaggaccttgctcttttgcccaggctggagtgcagtggcacaatctcagctcactgcaacctctacctcccgggttcaagcaattcttctgtctcagcctcccaagtagctgggattacaggcatgtgccaccacacctggctaatttttgtgtttttttggtagagatggagtttcaccacgttggctaggctggtctcaaactcctgacctcaagtgatccgcctacctctgccttccaaagtgctgagattacaggcctgcacccggcctcatctgacttctgaatatggtagtgagtgtggacatcagatgtagtaaggaagctggttttacaccagaaattaagagagcaaaggcatagagtgtgatgggagaggaggtgagaactatttcactaggtctccattgagaaaactaagaaaataatgataagaattagtagaattcttgaggtaaaagtgagtttggggctagaaaatgcacatgtgtaccccagatctctgataggctctgctagaatgatggcagtgttgatgccattgcacctgcctataggtgggtgtaccctgcctatgctggcatattctggctgggctcccataggtacacaatgtagaaggtcaatggacttatccagatagtttgtcttggccagaacctgttattaagggagatatgtgggggtgggaatgctggcaaacaaagaagaaaaaaaagtagatgctacagactggttacctacagagaggcagaaaacagaatctcacctgcagatgtattttgtttgcccacagtttgttgctttttaaaattttgaattagttgccaatttaaataattaagacatttcacataaatatccagaatattcccttcctcttgaaaagtctgatcacattcctgcatgga

SEQ ID NO: 58108 - DNA, 1044 bp, Homo sapiens
taggcttaactcattggtcctctggcctgagttttagagactcctcctatatatggatctattagagataggaaaaaaacaaaagtgttttttcatttatttgtttgttttggggttttttgttgttgttgttttgtttttttgagacagggtctcactttgtcacccaggctggagtgtagtatcgaaaccatggctcactatatcctcgacctccagggttcaacgatcctcccacctcagtcacccaagtagctgaggctacaggcatgcaccaccatacatggataatttttgtattttttgtagagacagggttttgctatgttgcttaggctggtctcaaactcctcagctcaagcgatctgcccgcctcagcctcccagagtgttgggattataggtgtaagccaccatgcctggccaaccaaagtgtttttttctactcccacccaccacaacagttctgacaccagatgtgtgggttttttccccacacaccaagcaattctggcaccaaattctccatcagacaccaactggatgccctataatttaattcaattccaacactgtctgcctaggcacagcatcagatcccacaggttcggggctcagtctcagaagactgccccccacttccaatgccagttaagaaccctacattgtgacctgtgcttctgaacaaccgactataaatcaaggttcctaggaccctctccttgggttagattaatttcccagggtggttcacaaaactaagggaaacacttcccttacatgtattggtttaataataaagggtgcagatgagcattcagatggaagagatgcacagggtgaagcatgtgggaaggggcacggagctccgcgctgtttctagcactccaccctccaggcatctccacaggttcagctacccagaacctgcttctgaacccactccttctgggtttttatagcggcttcattatggaggcaagattgattaaatcactggccattgatgattgacttaaccttcagttcatctccctttcctgga

SEQ ID NO: 58109 - DNA, 1045 bp, Homo sapiens
ccttccttcctctctcccttcattttggtataacttagccttttgtctttaatcctggagttctccggggctagaagacaggcagagacgaatgccagcagcagagatgcttcaggcagattctgtaagcctgttctccctcatcagggagcagctcagccaaggagcaaagtcagaccccctctagctccccagggacagaatagcccttctgacaggtaaacaggtgacctgggtagagagggcaaggccccaagataggagagtcagggctcccctttccttggaatgtgggcctctctgggcaactagggagggcaaaagtcttcctcggctggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggacagaagaaaaactccctggttctttgtcctcttggatagtagaggccttgggtgaggcaaagagatgggcagaaaaagttaccttgatacagaggccagagagcctcctggagggcatgtgtttccctagcggtcacctgcgaggctgcaatcctagaaaagtcacttctgtggcagaggatgaaattgtatccccggagactcagagatattgggtgttatgtcctgaccacacaggctcaccaggaggaaaggttaggaaagtggagaaagtacgtcctggggagcgggtggccgaggagagctttccccttgtgcgcctctcaggccttggcagggattgcagctgcaggggtttggcagtgagcccatccagagagcttcctcccccgggag

SEQ ID NO: 58110 - DNA, 1961 bp, Homo sapiens
cagtctggaaaagtggagggagctttctccataggtgggcaagcaagatacaagggtggctggtctggcaagctagggtctgtggtctctgaaggccattggaggcagaggccttggcctgtgattccagagagctcggtgagccagaggctagagctcaggctcaagcaggccaagaaggagttaacctccaaggagaatgcgggcttctcccagactggaggtctgtgcccagttttgctggtgccaactccgggaagaagtcctgggatctgtagtttgtgccaccacccacccctggcctgcctgtttatcaacacggtcttgtagactacagttcccagaaacctgcagaggctaggctttgggggaaggggtggggaaggaggctccgtggcggccagagggagagggagagggaggaggtggggagagaaaacccaattcacccccttcgtttttaattctttctcctggtgtgtctgctccaccgcccgagctaatcccccaaatccggtctcctaagccgcagctgcttcccttcgcagtgatgaatggctcagggagggaaggtgaattcatattttaattactgagacgcggtgctaagggagccggggagggggcggagggctcagctttgttctagaggcgtcgagggcacaccctccttactgggtcacttctcttttgccctttacctggggtggggggtggcggggagttaaggtgggggttgccttgctgagagtgcctctgctctctgccttgggagatgaagggatgggtcgtggggggcgcaatatccctcttcttgtttatcagagaattgctggcatgccccagcacttttaaatagcttcctagccttccacccccgctgccgcccactctgatgaaggacattgccaaaattcgagacacctaggagtttgtggtctgcaagcctggggccctggatttctctttatcttactttctggcctgctctgagtctcctctttctcttggttcttccacatgttcatgctgtctctgactcactgccccatttttgccagaggtgcaagggttggaggaccccaggagagtatctggcacagagagatgtgggggtcaggccaagggaaaggatcagcagggaggccgaggaacctcctagtggtgggggaggacggatgctctatggattggcatctcttctgcttggctcccacaaagctggctgggcagggcatcgtctgtgcccccagaccgtaaaccatcttggacctgagctgggaaaaagccagagaggaggatggggaagaagccagggccaacagcttgcagtcagatgcagccaactgtgtggtagcaggaggtttgtccagtgtccaccctgcctctccatcctattctgggcttctgtttttctgggggctgtttttccattccttagtccctcctggactatgggcatggaaaaggagggggaggatgggaggggagttcccatgatgagctctgatgagtggggagtggacccaggtgctagtccagactcctccccctcaaatagacgcagcaaggggacctgacttcagggagcctccagctggtactggagccctctgccaagggtgaaggggtaaagtcagggaagagagtcgacaggactcctgctcgagcaaagcagagaggagcagagaccacagcctggcagagggactccccaggtacctgctgctggggactctgagggaggagtggggttcacagcgggcagggatacggaaatgggttggaattctctgccccatgtccccccacttcaggggctggcccggcaatctgcatgctgcagacagagcccaggcagcctccggggcatggagttgtgcaccttacagtgaggacccttttagagaccctgttagagaagaggaaggataaccagagcactttagagcaaagatctg

SEQ ID NO: 58111 - DNA, 1043 bp, Homo sapiens
tcagggatggctccagagtgagctgccctcagcttggggaggtttcagctgaagccctctttctgactccaaccaggtctggagacagagatctcactctcctctaaactatgcaagaatgggtgttgtcggtaaccacccagactggtctgggtaggttggcccagcccccacccctgggggcactcaagaaacctatttaacccctctaaacaaagggtaggtcctcatcgctgccctcctttacccagaccctcctttgccctctgtgcttccagtggctggactagaaagagttaagctttgtaaagagggagcctaacctggggccccccatcctgggtactggcagcagcagccttgaaaagatccggccttattctctagggaaggggtagttaaggaccctgggcagggggctggaagctaattaagggaatttgaggaggtcctttatggccaggaagccacccctcctcataccctggagtgaggaccattgtgtgaggcctttgtagggcaagaactggaaactcattactgggatggctttagtgcaggtggtggaagatggtgagagaatttaacctggggggcccagtcctggagggaggcagtgtgggtgggtctggggtcgggggtgctgagaaggggagtgagggcttctcgggtgccccagcttctcgcttccctatgagattcctgccgctggacccctccactctgctgtggcctatggcttttcattcctatgtgattgctgtcccaaactcatgtagggctaaaagccatgggctacagtgaggggcgagctccttctcctgcgcagctgcacctcccatgggaccaggttcggagccagccaccaaggggcaccagaaggaggctttgcttgggggtggggcatcacgggatctggtaacctgggatcggggctaagccgtgtgaccttggcccagtcacttcccttctggccctgtttcctcactctggaatgaagagactgggccggtgattccagagggagattccctctgaggaag

SEQ ID NO: 58112 - DNA, 1013 bp, Homo sapiens
tcaggtgggctgggattggtaggcaggccaggggctgagcccttcatgtgcccagggataggcagctgggattggcaggctatggctgggaatccgagcgcaggactgggtgagggtgggtggagggggccaggctcgagcaggtctgagaaaggaaatggaaggacagataagtgctgaccttgtcctcccagggcaggggagtggtgggagcagaataggggtatgggtgaggagaggaaccagggctgcggagaaggggaggggggccaggcaggagaggggggcctgcagggagccgtctcaggtctcctgccaaaaattaaactataaaaaagctggaggggagcggcaggggaaggaaggagagaaaggagatggggagggagggagggaccaaacagcccctctgcaccaatagcccggcagggggacgtgagtaatacatggctggttcagagggagtgagatcaaaagccagtagatacaagaggtttgtgcttcaccgaccagacagccagaggctcaatgagacctttgttactcaggcccaagtcagggttgaaggaatacctggctgccccgcctgcccagcccgcccccacccccacccccaccgtcctcagggctgggggaggggccggtcacaagtgagtcaagttgagttgggtacagctcagccctggccggtggtgggcgggcagggggagggaggaggcctgccctcgctggggcgtggagcttctcggggtgagtggaggagtgagtggctgcctggaaggcaggaagtggctctgcggggaattgtgaggcggactgcgagggaaagggggccttgttgagtccgccaggtgagcagcccctgggacccccagcccctggcccagcatcccttgggagggagctgagggcattctgcctagagtccatggctttatgcagggcctgggtctggggttctgggggcccatgagagaggaaggaaaggagaaccagagggggttggggctggg

SEQ ID NO: 58113 - DNA, 1095 bp, Homo sapiens
ggactgggggctccctaaaaagggagttgctgcagcctgctccccagtgaaacaggctttagttttcatgctggacctggcttctgcagcttgcactaagattaagggacttgttactacagaggaggggagggcacacccaccagccaatcaggccagggacacctgaggtctcttctccccagccctccctccgcctcttgccccaggccccctcatctctccctgctgcctccggttctgcctgtgctccacctctgcctccagtttctctttgtcagcattcttcttttctggctctctgctttctctctctcaggcttctcctaccctctcctctaagagcaaaaaatgcccatccaggcaagttgtagcctccatcaacctcagttttctcatctacccaatgggaataataataataaatatttgtgttactgaaagatgatcattaagggggacctagatgcatgacacagttttcactaaaaaaaaaaagttgcttttccccttctcgccttttttctcccattgagtttcttctgcatttccatctgctatcacctctgtcctcttcttcacaatttctctcagtgtctccattctgtgtctctcagttccatctccccctcactcctgttttgtctcccacctccttttattccctcttggttacccccccgaccactccccccaactcctgccacaggcggcagggcccaggctgtgctgacagcaagggcaggcaagcagggcgggtggctgtctccacttctcatcagaggcccaagaatgtgtggagtcatgagggacaatgggagcctgcggcaggaagaatggggcctctgttggggcagaagtttcccaaatccggctgaatgggagtacctgagggctagggaggggtggaaactcctgaagtggagaggaggccactggtggtaggtgtgggggatgggcaaggctctagaattggccaccatgggaattcttagcatctgttggcatttctggggagagctcagacctcaaaggtgactgcctctctccctggagtggccaaggaggaaagggaggaaagggatcctgggggac

SEQ ID NO: 58114 - DNA, 1045 bp, Homo sapiens
cctaacccctttacagccccttcctcataccactccataccatggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggcactttctgcctgtttgttttcgctcagtactcacagtttagatgctaagccggctcctcttgcactcacttcctttgtgtctctctctctctttctctctctctccccctcaccaatctctttcttccctccttgtccgattctctgctgtagcttccagtggagaaaaataattattcttcaatgggttagcacggggcgcacgcacacacgcgcgcgcacacacaccccgccgaggtacccaatcaatgcacaaatcttcggggtccctttaacctctgcggatgactccgggagttaattatgaagcctatttcggcgcggcataaatatgcattaaggtaggaaataatcgatacgctgaacttctgggaactggcatttagacggactccgtctcgccgccccccactccctccatggccccacgagccacctccacagcctcgcgccttcccggggtcgcaacgcctatcacaagcttctacccgggtttcagggggcccctgtagtggcgtgggcgccgcgccggtgccgggagaccccctcgtgcgccctctgcggtcggggcagaccctcagccggagcttcttcctcccccacccctgcaggccgggcccaagctgcgacacccccagcacgggct

SEQ ID NO: 58115 - DNA, 1032 bp, Homo sapiens
cttcctccgtcccctcccccgcccctgcgggctcccggccgcacacacacacatttcctgacaattagcgaacacaccttggccgcgcggcctccggcggcggcgccgcagcttttgtctcccgcccgccgggctgcgaggtgcgggcgcttaggcgcgaagttgcagctccgacgcgctgctccggaatgccggctgaccgcggccgtcggggggcgcggagggcggggtgggccgggcacgccggccccggggctggggggctgcaaaagagagaagagagacaaaagtaaggcagcgctggcccctcttcctttgttataaccctgagtgtgtgcgggcgtgagcgcgcgcgggagtgtctgtgtgcgcgagggtgtgcatatgtgtgtgtgcatgtgcgtgcatgtgtgtgcgcgcgtgtgtgcaaatgcctgcatatgtgtgcgggtcgggactggccgggggcggcaggacccgaaggcgctaggcggattcaccggattgggagttgaatcgcgtcccggtctttctagctgtgcccggaaatcgggcgtgcgggcaggtagccgtcccgctctcgccagttcctccgagtactgagctcggagtttgttcacaggctgagcccgtgctgggggtgtcgcagcttgggcccggcctgcaggggtgggggaggaagaagctccggctgagggtctgccccgaccgcagagggcgcacgagggggtctcccggcaccggcgcggcgcccacgccactacaggggccccctgaaacccgggtagaagcttgtgataggcgttgcgaccccgggaaggcgcgaggctgtggaggtggctcgtggggccatggagggagtggggggcggcgagacggagtccgtctaaatgccagttcccagaagttcagcgtatcgattatttcctaccttaatgcatatttatgccgcgccgaaataggcttcataattaactcccggagtcatccgcagaggttaaagggaccccgaagatttgtgcattgattggg

SEQ ID NO: 58116 - DNA, 1069 bp, Homo sapiens
ataaaagacatttagagaacagttgaacaactatgagatgttcagaggcctgggggaggccatgcaggccaaggaggcctcctgggcccagcctggtgggagggaggccatgcggagtgtgaggagggagaggcggggcaatccaagtgaccagaagctgggagctggtcagaggagcccagtggagttcttggcggtgacatgaagctgctttttttaagctagtctctcagattggaatgaggaaagttggagacgaccagccaggggttcttgtcagaatgtgggcactgggcggcgtgggccagctggtgggggtggagtataaataggaatatggtttagagatgctgggaaatcctccccattccctccccctcctgagactgagaggtccccagggatgccaggctcaaaggcccctgcagttctgttgccaaagttgggcatggagagaaacccagagacaggactgaaggtcccatgacaggccagcaggagagctggacacgggatatctggctgagagagggctattgggtgggtgaactcaacactcttcttttcttctccaatttattgtgtaaaagatggtaggcaccagtttctgtgccagagcaagtggagaggaaacaagctgtttcctctggtatttaaggaagacctaaggaaaggttccagactttgggatctcaaaaacacaggacagttggggaaggaccttccttgagtgtctttaaagagggctgataaaaggagcagagagggctcctctggctgggagagtaaggcgggctttctctggaggcaggaggatgggggagatggaggccaggcctatcctggcccttgccccttgctctggtctctgatctgggatgttctgtacgcccaggaccagaactgacagaagggctccttgtcccatcttatcacttggacatcctgagcctcctcagagagtgcagaccagctttagctgggcccccaaaaaaggtcaaaaggaaaataccagaagatgcaatatgcacctctattccttaagcctcaggaagccagagagcagcag

SEQ ID NO: 58117 - DNA, 1023 bp, Homo sapiens
gatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctcca

SEQ ID NO: 58118 - DNA, 1054 bp, Homo sapiens
ccctaaccagaactttgcagaggatatattgttttactcttttattatgagaatttaaaacatgttaaagtagtatatggagctccaatgaacccaacactcaactttagcagtcagcaccggtttcattggtggccttgcacttcttttctgcactaggttacactaaagcaagtcccagatgtcacatcatttcaatgaggagggtatggtgagatgcagctcttcccctccctccagcagggcaaaagaggaggaaaggagaatggagtcacaatgagggagattttggaggccggaagatctagatgtgaggtcctctctgtcagtttctggaagtgtgactgacctagggtaagttgctaaattcatctgagtttccgtgtcctctgttgtaaaaaggggaataatatctacattatagtattcaataaaaagtagatgttaggttgtttttttttttttcctggtgaataaatgaaacatgggtggatttgaatagaactggaagagttggccctctcggtcagggcaggagttgagcaggaagctgggccctctgcagggtggccagaggctgtgagaggtggggtagggagtggtgggttccgaagggatggaaaaagaactctgactgcagttccaacccatctcaggctctgagagctaaacagcattcccacgggccccctctggccctgctcccagacatggcttgtgtttgctttggacttttccatgcatccgtttacatctccagatcccacatatggaggctcagctctcagggctggcttggaaacggaaacaggtaacaacggcacagggggccctgctggctttgctggagactcaggaaagggacagtttgagttcagaaggtggctatctgcatcttctcacctgtcagaggagtgctccccaaatgctcccctctcccttacaggtccccacataccgaaccaaccagcatctgcagcaccatctcgccaactcctgcccctgtcaccagcactgtggttgcacagcctaacaaaaagagaaggtttggttt

SEQ ID NO: 58119 - DNA, 1046 bp, Homo sapiens
atgaggtgacaaatggagtgaagcgcgcggctgtctccttccttcccatctgggtatctggacagctcttaccaacagtctgaaccagggaagaagataacttgagaagccaggtaaacttctaatgattttgaccaggtaccaggactcaatttaatttcctctacccaaccaagttttagtggagaagacttgaatagccattgagagagcgcctccaccaccacccagctttctgaaacagtatggtcgtgctggtgatcaagaggctgaaagtcttctcttgccttcttcacccagttttacctctggtagcactcagagttttccattccaattgatctgtcttgggtaggaactacaaaagaaaaacaaaacaggtagcatgtttcagcagctctgatgagttgcagtgatgattcattctgagagcttacccaggctgtttgtttctctgccattctgtggctctagagggagcaaagtgaaaagtcagaccccctagttctggcgaacagttggtggaggcagtttcctgagactgctgtctagggcttggggaatgtgtctgtctcccatgaataaggagcccattaagtgttattcatttaatgttcagcaaatattaattgaatgtaggtcttaaatgaaactcctgtgtgtgtgcaaccagtactgctgtctcagaagtgaggctatagttagtgctgttttgggggccacctttccttctgggcctttgtactgagcgtttagagcgtagatatgttcacccactgagagcggatggtgaatgcctgttcctttagtctttttgtgatgattttgctttttatagggaggacagagtctccgcctgggcaccttctcttaagaactggctttgcacacagccgatgcagtccctgggcactttgaaagcagtgggcaaaagggcaggtaagggctcagggttatgaaaattgctttgggactccccctgcctggggtctctagaagggagactattcttaggaggtgtctgtgccctgaaggagactttcttt

SEQ ID NO: 58120 - DNA, 1258 bp, Homo sapiens
gaaacaggagaatcgcttgaacccgggaggcggaggttgcagtgagccaagatcacgccattgcactccagcctgggcaatgagagtgaaactccgtctcaaaaaaaaaaaaaaaagcgcaaactcaaacagctgtgccagtcagctgacaagcattggtgttaaggagtccattggatggttcccatgttttttgttttgttttggggtcaaccgtgctgtcacccagtctgaagtgcagtggcacagtcatggctcactgcagcctcaaacttcagggctcaaatgatcctcccaccttggcttcccaaagcactgagattacaggcatgagccaccaccatatgttttgaatatgtcaccataattaaccaaaactatcttctttggtcaaggtcatattgccttacatgttgccacatctggtggttgacattcggtgttcattggacctcttggcagcactgattacttaactccttcttgagatgcacttcatgtgccctccaggaaaccacattttctcctgaacttcctatttctctggcttttctcatgtgcgctgctgggacttgttctttttctaaaactctagatgttgaagaatcccagggctcaatctgtccatctctacattcattccctagcttgtgtcattttagtcctatgactttaaatacttctttatgtgaccacaaaatttgtatcttcagctttgacttctcttttaaactctagacttctatatctaacagccttcttgacatccaagattgcatcataagatgatcatgtccaaaatagaactcagaatgtctccccatggccttccagagttaaatggcttcatcatgtacccagttacttaggtcagattccttcaggtcatcgttgattcttttttgtttgtttttttgagacggagtttcactcttgtcacccaggctggtgtgcagtggcgtgatctcacttcactgcaacctctgcctcccaggttcaaccgattctcctgcctcagcctcccgagtagttgggattacaggcacctgccaccacacccagctaatttttgtatttttagtagagacagggttttgccatgttagccagtctggtctcgaactcctgacctcaggtgatccatctgccttggcctcccaaagtgctgggattacaggcgtgagccaccgttcccggcccatccttgattcttatctttctcacactacacccaatccatcagcaaattgtcagtttc

SEQ ID NO: 58121 - DNA, 1623 bp, Homo sapiens
tgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatgattttctgaattgattatttattcccttctctcacattcattgaggtggtctctttacagtctctgtattacattttcatccatgctaactgtgggtcaggaaagagttgttttcccaatggctatcattaaaatctggccttcaacaatttgatatgtatctacattaaaatatttaaagtc

SEQ ID NO: 58122 - DNA, 1054 bp, Homo sapiens
cttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatatt

SEQ ID NO: 58123 - DNA, 1827 bp, Homo sapiens
accaatctctcccaccggttaaactcgtcttctaatcctgtagaatcacatgaactaaatgaagaagtaagaacttgaaggctcagactgacactgttacaaactagcatcttcagatgcatggtatttactttaaatgtgcttatatacagtgtagagaagctcttgtataagaagacatctatgctagctaacttagtagtagtagagggaacatattcagtgagctgcctttatatctgtagtgtcggagacttgttactggttcatttgtggttatcagttgaaggttctgttcctgagatgtgcaatagtagtgttgaaaggtattgtttaatagtgatggggaacagacatattggacttttttttccatattaaattatttagtttgcatgcctgtttgaaattggacctctcagcagcactttgaaatagttttaattaggttaacattttgtacattaaataagtagatatagatggttgatttaactagatgtgttaaattttgaaagcacaaaggtattttatctttttgaattaaaggagaaaagccattgatttgttttcacagacagtatttttaataattaactgtctcagcacagaggtaccttggaaccaagggcaccattgaaactcagttgaagcaacttcctagtaaaccattttagtgagtcctttttgcataaatctatagcctctcagaggtgtgaggctgtcacagattggtgatctgctatctctttgagatcaactaatttggagaagtgtgtgtgtgcgtatccttttttaagtcaaagtttacaaccttactgcaggtgtatgaggcagacagttctgtttatagactacctccttcctggaaaagtctcagcttcatattctgttgaatatatgcagaattcttagtgtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccaccttagagttcagaaaggatgtgcacagttggctcagagccagtgctggcaaaccattgcatttactccacccaagagtggattttcacataatttctaaaataattttttcttatttatatactgacttttcaaaatacaaaattaaaatatcatgtctgacttcagtgatctttttctttttctttttttagaaatgagatctttcagtaatcctttaatttaattttttagagatggagtcttggtgtgttacccagggtggactcaaactcccgggctcaagtgatcctcctgcctcagcctcctgcatagctgggctacaggcatgcaccaccacacctggcttagtaatccttctttattaatggtttgtcacagtacgtttgtgatgttatattgctcatggcatactttatgtgttcgaacaaaggtggaaatttccattgatttttttttttttaaatgtatgcacaaacaatctggattttgaggagtacggtcaggaaaaaaaaaaaa

SEQ ID NO: 58124 - DNA, 1083 bp, Homo sapiens
gggtttatgatttgctccataattgaattacactctgtagtgcatattgtcatttacttgaactttctaaaaccttcatttgaggttaattgtaaacctgtgtaccttaggatatgaaggagggtacaggttgttctttgtttctactccattgaggtaagttggagaatgttaatatttaatatgttaggacaaaagatttttgtttctagtttttgttatgacatcatattctttcatgataaacagccactgcctttgtcctgtgagccattacagaaggctgttgtgttttgcctcaggtaatagagtaggatagaaagtaaaagttggggttgagtaataggatgataatgtgttttgttttctttctcagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggc

SEQ ID NO: 58125 - DNA, 1264 bp, Homo sapiens
gggactgtgtttggtatggctagatgaatttaggtgattttgaaagttttaagtaagtgatgtctacttctaaaatggagaacctcattaccagctttttcttttttttttttttttttttttttttaagacagactcttgctctgtcaccaggctggagtgcagtggtgtgatcttggctcactgcaacctccgcctcccgggttcaagggattcacctgcctcggcctcctgagtagctgggactacaggcgcacgccaccatgccctgcaaattttttctgttttagtggagacggggtttcaccatgttggccaggctggtctcaatctcctgacctcgtgatccgccctcctcggccttccaaagtgctgggattacaggcatgagccactgtgcctggccgatgccagctttttcatgaactatgggatataagtttataagaaaggataaaaatgcttttttttttaacctacagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccac

SEQ ID NO: 58126 - DNA, 1049 bp, Homo sapiens
tttagtatttatcaagcgtttgtagtgtcctgggatctggcacttcgatgagaaagctgtgacggccccaacttctaacagcgagtggtaaggaggacgagggacacaggagggaggagactctccccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagacgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcggtgagcggtcagccccgcgcgccccctcgggatctcgcggccacagccccaccggccgggagcgggggcgggggccgaggggcgcgcggcacaacaggaagtgggggcgggggccggggccgggcgcgcgcgctccccttgggtccgcccccggcccgccgggcaccgcggcgcacaggtggacgccgcagcgcaccgctcagctctcgtcgcctcttg

SEQ ID NO: 58127 - DNA, 1137 bp, Homo sapiens
gccgaatcgctgcaccagccggtccatgaccagagagaagaccagggagatggcgcactgcaggaacagccccaggctgcccatccgaacgcctgcagagggagaggggccatcagacagagcctgggagggaagggtcggagcagtctcagggagatgagaaggcggaaccacaggtacctgctgcacgagacctgctgtggaccagccctgctccccagcacccttcccctttctacctctagcaatgggagtctaggttcttccactgaccctcagagaatgtgggcaacgccccttgctgaaggcagaggaaggtagtctgaaggtttcctgggagtctcagctgtgaggacaggcgggtgagagggaacacaaagacagctggccataggcttcaagacgcttctaggacgcctgagctggaaggcgctggtgagattatttggaaagtcgttgggggagcagagggcacactgcggctggaaccaggcagatctgaaatccagccttaactcctccactccctctagactttgaataagctccgcctttccttctgtcaaactggggcaacgactctgatcagactcctagagcagccagaggccttcctgaaaccgcaagcagagatgttccacacccatgagaagccgtgtatgcagatggggtccatccccactttcctgacagagaagtcggggccaggatggagaggcaccagcccagacacagccccgagtgtcgtctctggtgggcggctcccacaccagcctctgctggctgccaaggccttaccttcatcatagtgtctccgggcctcggtgcccggctcagctctgggcacgccctggtacagcccctcgcccacgaaatccgtgtaaaacagcgtgaaggtcatgagtgccatccagctgcacagctcagccacgaagagccggcgcagggtgcggggcatgcggcagcacagctggtgcagccggggaagcagggcgcccaggttccggaaagccaagcgggcccggcatggacagcagtggggcgacaaggagggggccgacagcccttctgctggctcggtggggcccagcgctgcctcctcagccaccagcagtgtggctgctacgcaggtgagga

SEQ ID NO: 58128 - DNA, 1093 bp, Homo sapiens
gtcacttgcaagctttggcaagaagcttgccctgaggctgctgatgggagtggtggccagaaaagtggtactgaaagacttcttgttctctgacctccctgagcctgacaactgagaaaggctgggctcctccgtttgtgctccagggaaggcggccctggagcggggatggcgagcagctggacttagtgctcaggagtcctctgtggtctccttagcccgaggaccctggaggagggatgaaatgacagggactggggcactggaaagcatgcaaggataagaaaagggggctttggagggtagtgtgtgcttatgggcttggaacttctcaggcaattccgggctgggaagagtaaagtctgggggtatcaagaggactctggacccgctgggcagagtagaactcaaacaagggaggacggactctgccaccaaagaatacaggggtgcttgaagcctgcacccttcctagtcaaatcctttccccacctggcccaaccccaagttaccaggtaaagaatctctgggtggggatggggggcgttggagaaaggcaccccaggaactgggaggctactaatgagctatctgggctgtaggaggatggtggggggcactcttctctttacctctttctttttgtctttttcccatgtgggctaagaaggatcctgctaattcctggggggcctgggaacttgattaagggaggggcaaggcaggtggggtgattaatggttgctggacagctgtggtttatttttatttttttattttttagagaccaggtctcactctgttgcccaggctggagaacactggcacgatcatagctcacttgcagcctcgaactcctggactcaggagatcctcccacctcagcctcctgagtagctgggattataggtgcatgccaccatgcccagctaatttttatttatttattttttatcttatgtatttatttttatttgagatggagtttcgcactgtcatggggctggagtgcagtggcacaatctcggctcactgcaacctccgcctcccaggttcaagcaattctcctccttcagcctcccgagtagctggg

SEQ ID NO: 58129 - DNA, 1111 bp, Homo sapiens
gagggcgcgtcccacacgctctgccggggcgggtgccgagtgcccggcgcctgcacgggtccccgctgagctgtgctttcttccgcggagggcgggcaggcaggaggtgcccgcgctgtcccaggcggggcggcggtgtgggcggggagcggcccctccccggagccccgggccgggccggaccgggccgggccgacggctggcggaccggccgctggctcctgttgcagcctcccgtgtcagacttttctttggaaagttgcgtttattttcttctcttgtctgggcttcaccggaaaggggcaggatgagtcactgcggcgcgcacagtccgggacttgggggagccgggacgggagccgacggccgcggcgccgcggggtgctcaggcccaggccggctttcttgaggaagagtgagttattaagacagggaaaggggactgagccctcttggacttagaactggggcgagctctgggtacagagttgggactggaccgtgtgtgtgtgtgtgtgtgtgtgtgtgtgtgtgtgtgtgttactgtgtccccttttcagcctcagtttccccctctgtggggagagaaaggccgctgttttctcctcgcctcccaggtctcaggtggggaaggacagagttctgcaaacggcaaacaggtgtgatgtggtggtacctaggcatcccgtgcagcttctcagagctctgggcctaggcaggcttgctagaaaagccccagggacctgcatgctttctccctagtgcgggtcaggccttcctgtagtcttccgctccccccaggcactgcagtcctgtgagttgctcttgcccttgacctctgaatcagcctccatcttcctgacagacactcttgacctgctcagcttttccccactccagggcgtgttccctatgcttcctctttttccaaggggccagagttgggggtagggaggggtttggcatggtgggtacctggtgaggactcgcccttcagctgttacacagacccggtcccggtggagcagggactaagaatagcccagctgctgtcttgctgccctggagtctgcagccgggcattgccagttgaccagggcccgcagtgacc

SEQ ID NO: 58130 - DNA, 1006 bp, Homo sapiens
tggctctctgctaaccagctgggtctttgggaacacaatctctctgagtctcagtttctgagactgttaaccaggtcagtaacatctacttctcagggttgtagtaaggatcatacatgaaactgcctggcaaaaggccttgcagtaatatcttcaccctggaagataagaagttaataggacatcagtagcagaaacaaggagcagccttggttgctgagccaccgtacctttcattcttgctgccgagggacgttccctgtctccgtattttctctggagggtgggatgatggcgcaaactgggtaaataaggggaaaggagggcaggttggaatcctaccatccaccatgtctcagcgctcctgcgttcctctgtgcctccctgggtgccttgcttcagacgctatctgttaacttatacttgttctgtgaactatctggcaaacaacacacttcttatgacattctgatacttgtggatggagccaggcagaggtctctgttggaatgccctaacattcagaagggcaacaatcaggtcggcctcacaacattctcttgcctggtcagatctccctggttaggtggtgggtggagggcatgatggaaatgataggtaactagtaccccttgtgagacactgaatgtggaagctctaccctaggaaatgggaccataataataagagctgggcagagggatgggttgggagtacagtgagctccctcttaggcctctctctccaatgctgcagtggattcctaaaaaggagggaagggcaggtggtgggcaggtgagatgcagaataaccccacacagctttcttgttccttttcccttgctcccttggtgcagatgacttgagtttatttgagccttggagaggaagacaggccacactgggtatttcccaccagtcagcttttggctcacctccgcctccctacaggggcttagcagagtcagagtgtggtggggaggcctggaattcacatccacatcca

SEQ ID NO: 58131 - DNA, 1090 bp, Homo sapiens
attggggacagaatcctggggctcagctgggctgttttactgatgaaatgtgacatcctgtgttctcacaatactgaagtctcactagaatgctttttgtgggtggcccctatcatgagacccttacatagactgataacattttggcaattgaaccccagggacaagctataagatagacaccgccctcatcccccgcaaattctcttcaatctttggggaagaaagacccaatttcaacatagtgaagaggccgtttttaaaagtttgatttatgtaagttgagtaacagactgtataaatactgaaattttggtcaggagcctgttatcttgtaataccctcttcctctagattgctaagatcatcatttgtgcttcttggattgataagataactctcagaagtctgaagttcctcttgtcatgttatcttgctgaaggagatagaactagtcatttggctttggtaaaattttcacttgtctcaacccaatttctatcactgagttctgttaatgtgcatgacgcatgcttctccctcattaggccttttggacaagtgtcagcatttaaggtcgtgagaactggattttgttccctctgaagagtatgatattaagaaaacttagctgaaaactaggatagcattctttccccaggcttcgctttcacaacattcttgtggagtcagaatgctaacttagttggagataaacataggcaaggccaattctcagtctgaaggtgttcaatggtgaaggagtagagtgagaaataagcacctctgcttctggagccccctgtgtctacctacttgacaagccaagttagttcttgttatgtcagtcagacttgcacaggaagtttctttgttttgggttttttgctcttgatttttcctgttttaccataatttttttttttttttttttttttgagacagagtctcactctctctcccaggaatggagtgcagtggtgcgatctcgactcactgcaagctccgcttcccgggttcacgccattctcctgcctcagcctctcgactagctgggactacaggcgcccgccaccacgcccggctaatt

SEQ ID NO: 58132 - DNA, 1166 bp, Homo sapiens
tggcctgagtacaagataaatagcattcctaagctctgttgtagggaatgctggtgtgacttgaagtacacaggatatacacagtatctagttcaaaagagtggtttttgtgctaaaccttataaaatcaccagtcctgggccattggcaaagcaagtcagtccttttctcaccttgctttcctttctcttgccatgcacttaagggaagcaataagacctctaatatttagctcttgggctactcttctctagaagtcaacaccattgcacagtcactgtgcaatgagagaagcagatggctctctctctgggagagctaagtctaagtaaggacacactaataataccagacagtggaaacaggagttcttagagcacgtgttgcttccacaggtcacctctgaattagccagcaatatttattgacaatgaaaattgtggtgactatattccaccaaaaattgggatctgtgctacaatgaagagttctttcatattcctcaacaggaaaaacagtttaaggtatagtttggttctcatgatattggcatgtctggatacttctatggtttaagggactgaagcagacaatgttgaaaactggagtattccaggtaatgtatgtgaatagtataaaaagtgcaacaggtgttccacagcagagttcagaacagcacatcgtgctaactatagcatgagtagtcatttgttttatttgaacccccaatcacttttccttgtctggcgacctgctttggagaagctatgtggctggttgcagatgaagtcagatcaatcgacagggtgatcttgggcaagtcagcttatccgcctacctcccactctatgctcgtttcttctttttatataatgaggattataagggactgattctcctctgcttcaaagggacattatggggccgggcactgtggctcatgcctgtaatcccagcactttgggagacaaaggcaggcggatcgcctgagatcaggagttcgagaccagcctggccaacatggtgaaacctgtctctactaaaaatacaaaaattagctaggtgtggtggcaggcgcctgtaatcccaactactcgggaggctgaggcatgagaattgcttgaacccgggagatggaagttgcagtgagccaagattgcgccatt

SEQ ID NO: 58133 - DNA, 1047 bp, Homo sapiens
caacaccttgccacttacttgggttatcgaagccctgtgatcagtgtacccagttaacatcctaatgtatgtagcagcaatcttttctgaattttaaataggaaatagaatttcttgattcatgcacatctgtcttcttgtgttgttccctctttatatctcctaagcctatgtggataacatcccgaaatagaagtgcagactgaaatttcaaaatgcagctgtgaactctttgccctattttgaaacaggtgttgtctttgaaattgccttccagctcaaaagccttgtttcttgtacaatcagcactgatatgtgttcacacacaacaaatacttagatttgttttcaaggtaatatggtagtttgtgttcctttatcttgatgacttgcttctcttttcctccattatcttactagaatagataggtactcattttgacatgctttggctgggtcaccaccaagagaaatcagtattattcatgggtgtgccccctggttcaatagtaaaccctgcacaaatattgtgaaataaatgctgtgttaattctggggtcagggagtgagagggtacagccagagttcccatcctaataaagcaaataattactttaaactatgataacaaaatgttggaaataattgtttgccttgatttagcagtaagctggcacccagaagggatttgtttaaaaatctaactttaaggaacaggttgatcaaggaagagtacacatatatattattattggtaatgttttagctattaagttgaatacacaaacccttttattagaatgtgtaagaccacctccttggctgatgtacaaagcaatgtgtgtaatagttatactttttccatcttgggaagaaacacaaatacacagtctatatgtagtcagggctctcctgattataagagattagggtagatgggtaaagtaaggctctgaaggagatagaaagtcattgatccaagaaaaatgatagcctaaattttaggatatgataactaccaatttggtaaccctagctgattggtta

SEQ ID NO: 58134 - DNA, 6147 bp, Homo sapiens
acttcctactgttaggaatgatggaactatcaaatgttatttgatggctttagtttctgatcagattaattcttttccttccgtctttttgacctgctttttataaacaacttttatcataaacaactgttagtttaccaagcaattaaggatgttgtgcatattctatagcatggtgcttcttctttacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaacacacttgcattcaattccaaatacccataagaac

SEQ ID NO: 58135 - DNA, 1999 bp, Homo sapiens
ctgtgtccatgtgttctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaatcctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacaggtaatttctgcagaagtgaaattaaatttactgctttaaaaattttgagaatcattattttcaatacagaaattcctcattaggatttggcattggcctgatgtttagcaggaatacaagaaatctaaaagggtcttgtattctgcaactggaagtatctcttattaataaagacactagcctgtttaagagtctagtgggcttagccatgttcttcaactactgccagtacttgagcaagatttcagaatgatctatttgtttcagacacagtggtagaaacactgtgtcatcatagttgttactgctcttttttcctcactggtatcacagtctcagcagccagcaaagacttaattgtgaaaatgcacaaacctagagtaatacgtttaagttccacgttctgaactctaccccatcctctgtgctatcagaataaaaccacac

SEQ ID NO: 58136 - DNA, 1797 bp, Homo sapiens
agcaatctgcctacctcagccacccaaactgctgagattacaggcgtgagccaccacgcccggactacagttccttttaataattttagatattttagcagtttttcttgtgtatatttagtgatctttatttgccatcaacactatgtatttttagtatttttatactctgcctctgttcgagaatatttttcttattaaatattcttgtgaaccaagctttatccataggtgaaaaaattccagcctgtgttgagacagcttctttttttcctttgagtctttggaagcagtgttttgtaacgtaaataaaattgtgcttattcaccagcatccctgtaaataaggaaataaagtactccttagcatttgtttgaagattttatatagaagaggtatttttcacttcttctcaagtcagaaatcagagatctatgttcacttagattttgagctaagacttttatgcatttgcttttttgcctccctttatagtgaggactcagaagacaaagatgtgaagaccaagaaggatgattctcactcagcaggtagtaaactattttaaatgtaagaggtataattatatttgtatattattttattagatgttttaataagtgatttctatgccaggcactgttgcaaatctgggattacaaagacgtttccatcttcaaagagctcctaatgattgtcagtcctggtggcttattacagtcatctatgaatcttttttaaaatgcatattctgggtcctgtcccaaaatttctgattaaatagatctaagtgggatgttggggcttggttttctttaagtatctatacattattcttatgcacagtcaatattggaaatcatttacgtaaacaaaagacatcaaactaaatagaataatatataaatataaaacttggtaaaataggggcataaaaagggggagtggtggactctgggtggaaaagcaaatgaaagtttcattcccactctttttagtggagacatagccttttgtaacagtagccatagagaaagttttttttgtaaaaattttaacttaaattaatatgaattaatggggagtctccatggccaaataaaatgttcagtcctgatgattctacttgttgttggtatttatttttaaatttaatcttctaagaattgagatttttaatccatattacttccagccactttagttttgacctacattcccttgctgttgtctccctggatctccctttaaatgagactgctgtttagctaatacaaaggggagagacaaagttctgctaaattcactctgcttagctgttttgctttccctcctattcaagtatactatctggctacctaagttgaaaagaaactgtattaatcttttgcactatctggtgatcctgtgataatagagtatatgctttcagtcatttgccttgtaaatcctagtttgaatctcttacacttgctagtttattgagcacttctagataaataactctgtactagtattaagctaagcttctaccaagtgggtttagttttgggtcggccatgtcagctttattctgtttgtctctagatgagatttttaaaagtgaaagagatgacttgaacactgactatggcaaggctcatgggactagaagtgttttcagaaaagggctgtaggtagagactaaggcaaatatggtttagtctagaggcagtaggctggcagcctaccctttaaccaaatttattcacaaacacaactgtgtgttaaaaaaattttttttaggctgagcatggt

SEQ ID NO: 58137 - DNA, 1114 bp, Homo sapiens
gggcttttgaaattggagatattttcttcaagtgcaagattatgttgtatttaatgctttagtttaaaagtaatttgcttagtaatagtaattgtgtttacttcctaaaatgtttgtaatataaccatattacaataattttcaaataagtgtgaagatgttgaaatcaaaaggggagggtataaaatgatgagagaggtttagctatagaaagatgaaatatatatcataaggactagagggtaatatgcaaaaacgaagtgaaggtgataggactgcgttgggaaataatttagttttttaaagatgaaagaaactatttgggaaatcctgctcctctcaccatttaaacagcatgagagataattatgtcagtaaatatagtggtgattttaacatgtaaaaatcatagttaattaagtttgaaaaacactgtttagatgaagattatggaagagattcgggccctcccactaagaaaattcgatcatctccccgagaagctaaaaataagaggcgatctggaaagaattcacaggaagataggtaagaggcattgtttttctgttcctgcttacactgttaccactctgagatgagagcagtctctgatctctaaattgttggaatctcatatacttttgaaaagtacttactgtccacttaatattttgcatatttcatattatctcaggctgtgctcgagtatacaatttgttatctaaggttaatactgacactttcattgtagtgataacaaaaaataagtgatatatctcattcagtcacaaatcactggcacaattaattacaactaaagcttgtagaatcttaagttgtatagcctgctgccttttgctgtctcataatcaattctcctttgtttaaataatttaaccattttggagagtttcttttcccttagttttacaaatgagttgtgattttaactataattttgcctcataagaccaggatattaggagtacatggtggctcatgcttgtaatcccaggactttgggaggcctaggtaggaggatcgcttgagcccgggagtttgagaccagcctgggcaatataaggagaccacatctctacataaaaatttaaaa

SEQ ID NO: 58138 - DNA, 1124 bp, Homo sapiens
ggttgcagtgagccatgattgtgtcactgctctccagcctaggcgacagagtgacaccctgtctcaaaaaattaattaaataattttctttttttttcttttcttttttttttttgagatggagtttcacttttgttgcccaggctggagtgcaatggaggtatctcggctcaccacaacctctgacccctgggttcaagtgattctcctacctcagcttcccaagtagcagggattacaggcatgcaccaccacgcttggctaattttgtgtttttagtagagacaaggtttctctatgttggttaggctgatctcaaactcccaacctcagatgatccaccagccttggcctcccaaagtgctgggattacaggtgtgagccaccacgtccagcaattaaataattttcaaagtgctagttcagttctgtttatgaaagagaaatgtgtgttctgatgtcttagaaaaatcctacagttttatgattttaattagagtctcttctttctacagaaataggaaggttgttgattactcacagtttcaggaatctgatgatgcaggtaagttttgtggtttcaacaaattttaagttggactgaccagtggaggttaccagcttatatagttttattatgcttttggaataagttttacttttttatttttagatcatttaccaaaaccatgtcatgatctgtgtcaaccaaagcaaaagttgaacttacatggattttaacttttccttggtaaatcattgataataaacattaaaaagcttttttcttacctggttttggagtccaaagtttaaatgtccagtaattctgatacagtgttcattgcttaaaatatctcctgctgtcagccagtcgccatggctcatgcctgtaatcccagcactttgggaggccaaggtgggcggaccacttgaggtcaagagttccagaccatcctggccaacatggtgaaaccccatctctgctaaaaatacaaaaattagccgggagtgttggcatgcacctgtaatcccagctactctggaggctgaggcaagagaatcgcttgaactcgggaggcggaggttgcagtgagccgagatggcgccactgcactccagcc

SEQ ID NO: 58139 - DNA, 1035 bp, Homo sapiens
tacttaaagtcatttagagtcaaatagattctgcagatattctcactgttttgattttgtaatagtcaggacaggctaaccattcactttattaagaccatgcatatatccccagaactagttctttcctgaggtctagttttataaatgttgctgataaaccaggtctgtaaaattggaaaaggaaaaaaaaagtttagaaacaaaagaatagagtcaaatacatagatgtacataaatctgtgaggctttcatagttttttaaataaagcatcttttgactggaccaattaatttgtttccttccccttctgtataaagcttaacattaccataatttttgtgcattataatgtaactgtactatacctaaaaattgcttttgccttgaaaagcttagtaataaccttgtttatcaagtatacatatatatgtgtgtagcagtaagagtaaaatatcatttacaactttagcttataaatagggcatctttgtatataatgaatacataggtacatggtgatttggctcattttgctgttttatgtatatttgttttgagagacgggagattgttttgtagaaaagaatggtatttgagaccgggcacggtggctcacgcctgtaatcccagcactttgggaggccaagacgggcggatcacgagatcaggggagaccagcctggccaacatggtgaaaccccgtctctactaaagatacaaatattagccaggcgtggtggcacacgcctgtaatctcagctactcgggaggctgaagcaggagaatcgcttgaacttgggaggcagaggttgcagtgagccaagatctcgccattgcactctagcctgggcgacagggcaagacttcatctcaaaaaaaaaaaaagagagagaaaagaatggtatttgaattatcactgagatgagcagtatgagaattgtagcttgacatacttgtggtttatgctatgctttcttataacagaatgttaagtacttaggcttaagtgggggcctttaaaaaataatttt

SEQ ID NO: 58140 - DNA, 1060 bp, Homo sapiens
tgataggttttatgaatgctttaaacttaaaaaatgatttaaaaatttttgatctaaatggtaacctgaactttgccataaagtcagaaataaaaatagggagggctggatgtggtggctcatgcttgtaatcctagcactttgagaggccgagaagggaggatcacttgaggccaggagttcaaaaccagcctgggaaacagcaagacttggtctctacaaaaaaaaatttttaatttactggctgttgtgacacacacctgtaatctcaactccccaggaggctgagttgggagaattgcttgagtccaggagtttgaggctatagtgagctatggtcacaccactgcacttcatgcactccaacctggatgacagagcagaccctgtctccaaaaaaaaaaaagagatattttggtattacattttagtgagatgaacaagaaaacaaagacaatctttctgaatgatactagaaccaatacttttaagacttacatatttttcaacaaagtgacttaatcatcatatccaaataagagttagttatgtgttcaaaattacagtggtattctgggtggaacaagttaatacttataagtaataatagctgttattgatatttatataccttgcacaaatgttctgaaatgttctcaacactcttgttattcctgtaacaggtattgttattcctgttttacagatgatgagactgaagttcagtcaggggaagtaacttgcttgaggatatacaactagtaagagtcaggacgtaaattcaagaatctgtgtttttaacctctctgctatattgaaattttatgctgtcctccagttctagttattgatactcattttacattgaagagttagtttagctttggcatttaactatcatgtgtcacatagcaccagggatacattctgagaactgcatttttaggtgatttgcatgtatttccacaaaaccagatggtgtagtctcctgcacacctaggctgtatggtatagcctattgctcctagactacaaacatgtatagcatgttactgtactg

SEQ ID NO: 58141 - DNA, 1567 bp, Homo sapiens
ttattggggtggtaatactgataatatccaactgataattaccagtaaatctttagaaaacctattttgacaacacaggttggacaattctgtaatgagataatttttaaaatacgatactataagacaaatgtatacttttaaaatacttttgattagctgtgtttaattttatgattcctgggaagattttatttgaacaaaaagtgtttactgctaaaaagtttaactgtcactgatttaaatgaactaatttccttttttaaaaatttattagagcaaaagaattctgtgaaaataccgaggttttatttcaacaaggattttgacagcttcacataggtccttgtaagatggagaaatacaggcagaatgatagctcagtgtgagggactttgcctgagcagccttacccggagagggctgacaaataaatagattgttaccctggaagactgtttgcactgttgcctgaaaggattctgttcttggcatatcttctaattaatgatatagatgaggacactgatggtgtgctgattaaatttgcagatgttaagaagttggggaagataaataatatgctgaaatggcaggatcaggataccaaacggtcttagattatggaaaaggaggttttagtcattggaattacaatatatagtccactgaatgatggaacagtccaaaagggaactgaaatcttggattgcattgaagtatagagtagaataggaagaggagggtcataatcctgatttgctccccattccccatctttttataatcatattatgtttcatcctgggtgctgctttagtatttactaaatccaaggtggtatggaggaaagcagctagagcatgaagcgagtacttgaaatatgaggaagtgttaaaaaggagccctagtatttagcttcagagaaaaagtgggaatagtcatataaatttaaggaatgctctgaagaggaggggttagatttagaccatgctaatcccaggaggtggaactagatagaaccagtgagtggacactagaggcagattcatctccttgtaaagaactatttaattattggaattttttttttttttttttagaaggagttttgctctgtcacccaggctggagtgcagtggcgtgatctcggctcactgcaaactccgttccccgggttcaagctattctcctgcctcaacctcccaagtacctgggattacaggcgcctacaaccacgccgggctaattttttattttttattttttagtagagatggagttttgccatgttggccaggctggtcttgaactcctgacctcaggtgatccactgcctcggcctctcaaagtgctgggattacaggggtgagccaccacacctggcaattactggaattttcttagcataggctgccttggagatcatgagaagttctcagtcattctcttctagggatatttgttaacaggatacaagctaaaggttgaattagattgtctagggtccagtagctctactacatataatactctcagcaccaccatatctcccacccccacgacc

SEQ ID NO: 58142 - DNA, 2770 bp, Homo sapiens
caattctgtagcagccccgcagtgacgaatctgctgcctctcccacgggttttgctattagaggattttcaaggtgatcaaggcagacgagatgaaacaccattaaactaacactgagcaacgctgaaccctacataaatctttttttctagtctttctaagatacgaccccagacgaatctgcaactctggagtggaaaccagggggcgggctaagcagcgaccatttttgttttgcggccgtgcgctctcagagcatcttgactaacaggacccccacggtgaaggtggagcctatcagagagcagggcggggcctggaagacgtgatgattcaaacggactaatgatctgggcgcatctggcagaagtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcaggtcagtgcggagtctgaggcctggagcgggttggagggggatgggggcgagtggtgaaaagagtgggggacagaaggctagagtccgccatccccggtgccgcgcgcggcctcctccctttcggggcccgcgcgcacccttgagcgtggggggccctgctggcgcgcgggggtggtggctgcgcgcccgtgcgcgcgcccctccccgccccgcgccgctgcagggctccggtctgctcagctgcctcccccacccaccgcactagagcgggcggggtgtccctgagccgccagcggccggagggggaggggtgtgaagtcagcgcccccaagaggccccacctcctcggggccgtccccttggagccagcgcggggaggcgggcggactcgagctccactccccaccttcagcgaggaggggcggaggcacccgtattgccccttcccccagcgactggcgcgggggtgggggccctgagccctctctgtagcggacgggggtgttcctggcaaagggggaggggcagcactgccaaccggccccgcctctgtccttcggggtcgctgcaggccccgcctcccggatcgggccgagcgtgggcgggacccgtttttttccccccgggcaaaagtgagagttcgggactggatcctggaaaataatgggctgctgcctctctccccacctcagagttttgagagagttaaccccaaagttcgctctttctctccgactagaaatgtccttcctcggggaaatgtccgtactcagggaggtgcgggttaacagcacggcccaaatcccgtgtggttctcgttccactctcacccgcgtacgcgtctcgggatatttttgtaaccctcttgtccccgagtgactttagtaataaaagggctaggttcgggtaaccatcagacttcattctcggaatttcaacaagtttgctattcccccagctgtcggtggaatcgtcctatgccattctccaggctattgtatggaatgtgccatttatggaggggtgtggtttagtccaatctgttgaggccttaaaaaggagagctgttgcaaataaatatttttaatgtaaggaattggcttctttgcatagtgtgttttctaaataaatagataaaggcttagtttttaaatgttttaacagtcgttgcttccccttcattccaagttgtgtgggaaacggaagtacctttaattagagttctaaagagaggtttgggaccctggcaagggttttgttctacaccgttctgtctccagactagatcatcctccaactggtggtggtatgagactgcgtactcctacacacggggtgggaatgaggagaaagctgctgttagctctgtttcaatcagcatctgtggtaactcacgatctctactctgaaagttatgctggccttttggcaaggagtctggatagctctttcagagtatagtttgcgtaatttttttggcataaaacttgaccaatgtatccatcaactcacgtagaatattttctttaggatcaggtaaaataataaaataaagatttattttacctggattggatcttttgtcttctggaagtaattactgtgtggtcaaattaggtcaaattaggaaaaataattcctctaccttttaaattttagttcactaagttttgatgactttattttattgtggtgacgttcttatctcatctgcctgaatttgttttcccagatttaggtattggaacatgaacagaacatttttactggaaaacttggattttttatgttaccatgtggggatatatatattaagcacattctatcagttttttggaggcattgggacttctgcacaacttttttattactcagtatgttgtttaaactaattttgaccttgtttatttcccctaattgaagagtgaagttaatatgttgtgggctgtttttttttttctttgccattttcaaattattaatttcagagcaagttggttacggagtatattttagtcataaattctttgtaattattttttaaaagaagtctttattcatgaccaataataaagcagaaa

SEQ ID NO: 58143 - DNA, 1055 bp, Homo sapiens
acactttgggaggctgaggcgagcggatcctttgaggttgggagttcaagataagcctggccaacatgatgaaaccccatctctactagaaaatacaaaaattagccaggcatggtggtgggcgcctgtagtcccagctactcggcaggctgaggcaggagaatcacttgaacgtgggaggcggaggttgcagtgagccaaaatcatgccactgcactccagcctgggtaacagagtgagacactgtctcaaaaaaaaaaaaaatctgcagagctgttgtctagtgggctggaaaagtcaatgttccagtttaaagcctgtcaggaaggagaattctcttttacttgggggaaggtagtattttgttctactgaggccttcaactgattggatgaggcccacctacattgggaagaacaatccgctttactcagtctgccaatttaaatgttaatctcatccaaaacaccctcacagaaacacccaaaataatgtcttggccaagtatttgggcgccctgtggtccagtcaagttgacacataaaattaaccatcacatcatgatgggtactgttttgattccttttttttatagtctaatttaatttgcaatcaagttaaagttcatctgattaagaactatatgttagtgggaataaagaaagcagataggaagaggaaagaggtattttatgatttattttgtatagaattcgtccctcagatctgtgagttgtatatgcctcttacactatctttgaaataagaaagtaagcaattcttcccattctgtgtttcagggaacaaatgtcttgaaatttgactgaaaggcagctggttgaatttgtaatacagccaaggcataactgcaagtcttctcattctctgtctccattctgtcatttaggtttctgggaaacatttggcctgaaaaacctattttagaaaataagcccagacatttagagaaacagaactgagccctttgggttttgaaactcttggtttgtgttagatatcttttgagaacatgttcatgtgtgaaatagagacat

SEQ ID NO: 58144 - DNA, 1439 bp, Homo sapiens
agacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttagatggttggtgtttcctgtatgtctcatcaaaaagcagcttcaactgttgtcttgggcccctctgtaggccttaccctctcctcaattaggagtagaaaggggccaaagtgtgacaagaaatgaaacatctcggccggctgcggtgactcacgcctgtaatcccagcactttgggaggccgaggcgggcggatcacaagctcaagagatggagacaatcctggtcaacatgatgaaaccccgtctctactaaaaatacaaaaattagtcaggtgtggtggcgggtgcctgtagtcccagctactcaggaggctgaggcaggagaaccacttgagcccaggaggcagaggttgcagtgaaccaagattgcaccactgc

SEQ ID NO: 58145 - DNA, 1181 bp, Homo sapiens
agtcatttagggagcccaaatgtcaggcactgtgcagattctaggagattcaggcctgccccaccgtggtattctagatcaagggcatcgccaacttaaaagcgcatgtaaatcttgttaaatgcggactctgactcaagaggtccagagattttgcatttctaacaagcacccagctgttgttgatgctgctggtcctgggcccactagcgagattctgatctgagtcattcttaattatctgtattaatagaaggtaagcaagaacacagataaaatcaaagccacagatcatgtcaaatgtattttgaattggtatgcattgtctgctttatattaatattgaggtgacttattcacaattcaactttattaggactaatgttaaaataaacttgcattctttgagcccaaacaatggaaaagaatggaatgaaaagccacaacaacagaatgaaaagggtcaggaggaagccagcttgggatgatcatctgttacttaagacaaccgccagcagcagcttcaaacactatccttataccactctgccgagagaagacatccctttaggaaaagctgactccagcagccagccccctgccatgctcctggaaaggccaacatggcaggaattggagtgaccccagaatgaggtgacccagagttagaggcaagagggctgagtttctgcaacaagtaggatttaggtcaggaagctccttgtttggtaaacttgggagcagaatataatgctgatgtgggtgaccctgggtcgtagcagcatcttcctttctaaagagctcttattgtgcctgttgtctgctcaaagtggtaattgtggggtggagaaacacagagaggttgctggggtggaaagaggaagattaaaaagtaaggattatggccagccaagccctgtgatgcactgaatgggtctgatcatgtggcctctggctccccctggagagagaggatggctataggctgggcccttttgtctccccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggat

SEQ ID NO: 58146 - DNA, 1525 bp, Homo sapiens
aaataaaagaaaccacctaccctgttagggccagggagggagacacaatcctaaacctttttgcaagtcctcagtttcaattgcaagtaaagtagctttcaaatagccagtcctggttcctgcagtcctcttagcactaactagtggaatactgtctgaaccccagtttactcattcacaaaatgagaataaaaatagcccctaccttactgggttgttaagatgattaaaagagaaaatacatggagagcacttagcctagcacacaatcagtccttaatagatgttaaccaaagacattggtaggagagccaggattgattgtcttgggactagaactcaggtctcctgactcccggtccagggctcttcctacaggagtacacttgcttctcctagctgagagattgaggaaggtgtgtgggggtaaggcagtgcacagagaaataaaaagcctcttgcaggccagcattcagaggtttaggggccacagtcttaattcagagcctgttcagaaggagagttgctgtggctgaggcccaaagcccttggagatagaaaccaaacaaactctctaatctccccagcctcggccccagccctgtggagcccaactcttcacagctgagacaacagagaaactggactgaaggcaaaggggccagggattgcaatttgaggggggattgcaaaggatttctggggtgtcaggcagcccagggcagctcagctgtgtgggtccccattacccttccccacccacctccaggaaaacagaaaaggtagggccagactgagagtctcccaaccggcagaaaccctctccatctccctggttctgggtggcaggaaggggggttgtgttgtttgaagaatcatgggcttggtttggttccaaggttcttggaggaaaggtggctggcgtgctcactccctgctgattctatttcctcctcgagcccctgatctcagactacctgttgaacctcaatgcccgccctttggggcactgaaattcctgggttctgttttcacctcgtagcactgggaagtcttccagaaggtgacagaggtcttcatcctagtgcctgcgctgctggggctcaaagggaacctggaaatgaccctggcatcaaggctttccactgcagtgagtatcctggctgggaggagtggggcacagagaggactctgggcagcacagagccagagactgggagagggctacgagcccttctccactgcccaggcctggagtgtggggctggggtgggaagggagggcctggctgggcaggtgtagggagatcccaggctgggtgtcctgctcctgggcaggggctccctgcccaaagtggttcccaggcttggtttctggatgtcccagccacccctggactcctgccccaccccctacctctcaaccacctcgtgactgtttgtgcagctttgacaggcaggcatcatgctggttcctccacccgcacagatgggggcctcctctgatctccagcccctgctttgca

SEQ ID NO: 58147 - DNA, 1058 bp, Homo sapiens
atccctcaggagggttgctggtggggaggatggcggggatagctcctgctgagcctccagatggagcagtgcaggactgagtaatttttgcggaaaaagggaggcaaatagcaaactctatagctatatgatgaactcctaacttccttggggggaaattctcccagtacaagctgtcctttgctatagtgtaatgttctttttcttttctttctccttcccacataaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtagaggtggtgattgagtctcgggccaacgccaagggggttcgg

SEQ ID NO: 58148 - DNA, 1050 bp, Homo sapiens
caactttccatcgaagggatatctcaccaatgcccttggaaggagattccatgttcctggctgaaatggtgcttttcgtaagaatagctataggctttcaagagagcccaggcattgctctgtagtgacccagtagtcaattttccagccaggccatccccttgccacttcgttggtttgattgctcatgtaaatttgttccaattcaagatctgattcatgactgtaagacaagtctcccaaaacatttaacctaaatctatcatgctgtaggttgctttccaggaagacccagctcttacatcacctatagccagtcagctgaaattgaagtcccagtgcttaaaaaaaataagtcctgtctgtaaaccctgaggctctgccttgctggaaagaaatcaggatatttaagcccatattgtacatgtatagaaatcaataagaaatcgaaccccctttgtttctaccctggaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccaggtaatgacttcatcagctgtggctggagggaggagggggctggaactgtttcctatccaatgtctacttccccacccccaccctagatgttcagcctgtaaacagctggctgcttcccctcctgatgagactagaactgtattttcccttcagagtggaagtgagaacgcaaacaggaaaggaacagaaataataaattaggtcagtcaagcctgggtccttgcttaacctaggccagccactctggcatagaggggagaattggcttagactactccctcctctctaggagccacagaaggggccaagatcttcccagagtctggttctgatccattctaggataacagctcagcaggagagctcagaatcctcagctcagaaaagcctcccagcccataccattt

SEQ ID NO: 58149 - DNA, 1012 bp, Homo sapiens
cgcctacctcacattagtgttttgccctctgcaatatgataatgaaggcaaaagaactttttgtgcacagaggactgtagaaaaaaacaatgactaattcattttcaatctttcatctctatttgactctgacaggtgccatccagattccaacagtgacttttagctctgagaagtccaatactacagccctggctgagttcggaaaatacattcataaaggtcagctgcaaatcaggggcaaggggtgggtggtagaaatagcaatggagacacagttcttttacaaagtgataaagaagtttattttgcgactgatcagaggacaatctaattcccataggcagagtagagactgtagatttgctcttggaaaaactaagccaccatatgtagggcaaagattgagagttcatccagccattgcattagagtacaaactctctcaaattttgccctacatgtgtgtcattcaataaatgttaaatcatcaaaaagtagaactaggatttccttctacttgtgcaactgcccagaactatgttccatgctcctcccacccctacctccttacacacccaaacacaccggtacatatacactccacgtactcaggcctaccccagattcattactaacacatttctaggcctctaggcagtcaacaactttgagctataacatcagtctttttccctcatccctaccacccattgagtacagagctgaggaaggatgggtcagaggaaaaaaggattcttggaactcctccctccccttatgaaaatctcatggagagtgatgagattaccttcctaaatctaattaaaaacaacccctccaaagttgtcagaggtgggagaaggtggcctaggagcagcaagcagccccctctctaacaccctgggacaaatggctctgggattagccatgcatggtggcgagcacctgtagtcctagttacaggaggctgaggtgggagggttgctggattccaggaattcaaggctgc

SEQ ID NO: 58150 - DNA, 1128 bp, Homo sapiens
gcatcaaagggcgtcgcgaatcccttctcagttcagcaaagaggaacgcgtcgcgatgaaagaggcgctgaaaggtgaacccgggtccccttcacccacctatgctcatatgtgggtccctccctccccaggtcaacccgtgactccccgcttccgccgcaaagcatctgctactgcagctggagccccgacacgcaccccagcccggccccaacacccttcccagcacatcgtgcccctgtctggggacgccacacttcccccatacctggctcctggaactctggtgtgccctgcctaacctggaagctccaacttcacccctcttggcgtgaccaccgtccattctttcccctgcttgcctcgagtattacaccagctttcatttgtacatcaattttaacctttgaaagtttgcatgcctgataaattactgcggtgtcgtaaaataagacaaatgatattagtcttatctacaaaggagagaaattgaggcttaggtcagctaaatgatcttccccagggccccacagcaaagagtgggcagtgggtgacagcatctagtgcctgtcggactcgctgggatcagatggctctaaagaaagggagtggagtgttcccggggtgtgggatgttcctaattctcaatcataattgaagaacatgtctcctctagatctctaatccagaccaaaaattcatccctgttctgaatctgcattttccaggaaacaggaaagtttctgttgagtgctagatcctatgggatgaaatccttctttaccattcagcttagctccagtcttttccctttcattaagtaatggattaagagagactgcctgcataaacatatagaagcagatgcagggaccaaaagctaaccccaatagttggatatagattgttcatatgctagagtgacaagcctgggaggcagagcagggctttcccaaagcataaataattctctaaaaggcattagacagccactcacagtctgcacagaagagaacaaaagctacataagctagaatagggacctcatagcaacacagcttggaactctgagcaggggacagaacacctgagatcagatccttgggtctgcccttgagtaggcacttg

SEQ ID NO: 58151 - DNA, 1045 bp, Homo sapiens
cttggaggagtggtgaccatcgaaaggagcaagagcaagcttaccgtaacaccggaagtgcctttttccagaaggtatttgaaatatctcaccaaaaaatatttgaagaacaataatctatgtgattggttgtgcatagttgctaacagtaaagagagttatgaattacgttatttccaaattaaccaggacaaagaagaagagaaagatgaggattaaattttatttatctggaatattttgaatgaattcttgaataaaacttgggaaccaaaaagaatgggcaaaggatctgagcagacatttctccaaagaaatgggtcacaccagctcattgctgtagcagtgatggagtaaaaaaggtaggtaaggaacgtgagcagtatgtgggaggtgtctcatgtactttactagggagcttgaagtcttccctgaagttaataaaaatccaacaatgcaataaaatttatttttcaagttcaccctggcagcgctatggagaaaaatttagaaaagattaagatgagagctagggtctgtagattagcttttaagggttgtctgttatatgtaaaattttgtgcttgtgtgaccatgtgattcttctgtggagaggttcagagttattgttggattctcaaagggctccatggcccaaatagaggagggtgatcattaaggcatctaatgcaactgtgatgatgagaacatgaaccaagactgtgggtggtacggccaggtgtgactggcatttctccaggcatatcatcctgagggtatggttggggtacaaaatgctgcaagcaggattatagtcaagcactgcatagtgacatttcagccaaatggaccacatatatgatggggtcccagaagattatcacggagctgaaaaattcctgtagcctaataaccatgtagctgtcataaagtcctagcacaatgcattacttatgtgtttatggtgatgcccagtataaacagacccacttgctgccagtcatataagagtctagcacatacagttatatacagtacataatac

SEQ ID NO: 58152 - DNA, 1055 bp, Homo sapiens
atcagctgcacagcctccaaaatccaaggggctttaactctggccccaaacttacaacctctctccaaaacaatagcctcatagttcacttgactatcctttttagaaggaccatctgttgtcacccaggcataccccttggggtcttaccttccacccccatccccaagtggctcatcaaggtatttactccaaccctattgagtactctctgtgagatttctgatttaaaaaaattttcgtctttgaagttctatttccagtgatattttagtgcactagtcatgttttaccccttgtcatagattgacagcaaagggaattgttcagctggttggtcaccccttaatgtaggttctccttgaggaatttgagaaatgaagaggttataaagcagcacccacatgtccaacactatactcttcccacaggttcctctacttgtgatataattagctctccctggtgggtccatctctcccctgcacccagactgcaccccacgccaccccctacaggcctagacctgtctgaattagttgagtaagtatagatgaggcttacatgctggtgcctcagttgacttgtaacccaatagagaagggacagggatttatgattaagaggccagagaggaggagctaacagctcctgggttttaaaatatcaacaatactaatactataacattccattgtaatgttctttataatgttcaaagatcttcgaatcttttttttttttttttaaagacaggatcttgctatgttacccaggctggagggcagtggtgcaatcatggctcactgcaacctcgacctctatgctcaagtgattctcctgcctcagcctcctgtgtagctgggaccacaggcacctgccaccacacctggctaattttctgattttttatagagacaaggtctcactttgttgcccaggctggtctcgaactcttggccttaagggatcctcctgtcttggcaccccaaggtgctgggattacaggtacacaatttggtgagtgaaagaagtgaggtcctctcagcctttcc

SEQ ID NO: 58153 - DNA, 1002 bp, Homo sapiens
aacctaccataaatataatatgtaatggtgaaactttagatgcattctcattaaaggtagaaacatcaacgattcctgctctttgacattgtactggagtcttagcctttgcaataagacaagaaaaagaagagctaaatagaataggagaaaaaaattattgttgtttgcagacaatactgtatgtatagataatccaaaattatttacaaactgcaggaaaactgctggatataagagcaagacacaaaaatcaatattgttcccatatattgggaataaccaatagtaattagaaaatgtggtataacaaaattatatacacaatggcaacagaaactgtaaggtacatagaaataaatctatcaaaaggtgggaagacatttttgaagaaaattataaaacattattgaaggacataagaatagacctgaatgaaatcataaatatatcaattatttcccaaattaatctctaaagtcaatgcctcaaaccagaaactcaataacagaacttttttggaacccaataaactgataccaaatttcaccatttcaaaattttgagaaacattttaaaaataagaacaaagggaggcttgtttttaccaagaattaaggctcattagaaagctgttgtacctaaaatagtgaaatattgggatagggatagaaaaataaattaatagaataggccagagattccagaaatagcctcatataaaatttgaaataatgtattatacagatgatagttgagaaatgatggacaattcaataaatggagtaattggcttgccctgctggggaaaaaatgaagttagattcttactcaacacataatagaaaaataaattccagttggattaaagctctaaatatgaaaaacaaaagttaaatttgttagaagaacatacagggggaaatatttctattctcaaggtacagaacacaagacacaaaaagccaaaataataaaaggaggaattgattgcatcataat

SEQ ID NO: 58154 - DNA, 1059 bp, Homo sapiens
aatttattcctaaaagtgtatacagaagtcaaatggttgaatgtctaactacagttttatgtggggtaggtaggttctattattataaataagtgtatatgtgaaattcgaaattatccctcacctgatatatttttagcattgtataccttgtctttagttctgtttgtttttccacaattaaactcgtggcctgcctgctcaagttcagtgaatacctaaagagtccacgtagctgatgagttctgcccttatcttagtagtacagtgatgagacctctacttctcaatgcaacattagtaacagcacttttgtttttccatttccactcatttttgtgttgcaaaagataaccaagtgttaaaatgtgtgcacagcacaagcattgctgtgcagagacaaccatcctgctgaaacagaattggtacctggcagtcagcatcactaagacaagcttgaaacatttgctggcaactgaaaatttgacattggcataggaaaggcatcttaggcatgtctgatttggtaaagatataagtttggctgatgtaatagaccccaagtaataatggcatacacaagatagaggttgatttctctctgatgtcatagtctaggtgttagccatccagggctgtcaggcttcttattccatcccgagagtgttatccttttctgtatgacccaagatggctcactgccaccatgttctcattccagccagcaggaaaaggcaacaggacgaggggcaggtatggccttattttttaaaggtgcactctggaagtggcacacacagctcttcaactcatatctgactggccagaacttagtcacatggttatgctgaactgcaagggaggctgggaagtgtagttattgttctgggtgactataaagtagaatttctctaaatatagaagaaggggaaatattgggggacaatcagcagcatctgccatggtgtatgaaaggacaagtgtaggaaagaccatggccacccatccatacagagtgccacaggtgcacaaagaagagagatttcttctgattggagg

SEQ ID NO: 58155 - DNA, 1780 bp, Homo sapiens
tttttaacagaagttaggagaaagaattgtttttgaaggagtaaaatatgagaaatttggttttggattttaagtttaaggtgttggaagagtattgaagctgaaatttctagtagttgacaaaatgaatggctgtatgcagggctaaagagattttttggctgttggtagagatttgcacacgtgcacagaggggatggttgaaactgtggaaatatttgtgatttccaatagtaagggtttagaagaacaaaggggaaacttcctttgtatcatctgtgatactcagattacagagtgtataaaggaatttaaatgatatatttatttgtgtatcattgagtatacattttgggaacctaattatgtatcaggaattgggtttagtactggagatagagaagaataagacaatctcctattttcactaatattaaattagcagaatatcaaggaggtagacatagaaagtaaactttcttgtttggctggttatcagttgtgtcactattggaagtgatgtgagggagcagggcctaggtatcttaagaatttggtagacattcaacctgcaatactcctttcagtgggaggttagttacacaattaattaaagaaaaattattgtagagtctgtgttctcggcttcaggcccagtatttgaatgtgcgccatctctgtagttacatcactactgcggatgggttcctcccctggagttgagttcaaagtcattcaccagtctcacaggatagcattgggttgaaaagcatagagtcagctggccatggaaaatgttatagttgtggttgcaaatcggaaaagggtggaagaccagaaggttcctcattgacttatggagtgaccttgagaaggaaagtaccaggaaacatgaagctcccgggagggagaacccctgacttcctgggaccagtgcgtcactcactcattttggacatatttgggagctgtttgttccctcaggaaagattttgcccagatgtagcatctggtgttgcaagggttggcttcccttctccatggctcaagatgcctttgttcagaaattaacagaaggttctttggtgtgttttgcatgggcccagttcatgtagaaccttaggtcattgttgagtcctttttggaggaagagttgggaggacttctcacacatgggtaaagcagaatggaagagacgcaagaaggccatttgggaatcagcaagacagggtgatccagtctttggaagagagaaagaattcagttaaaagttctttgggaagctttgtgactttgtgtgggaaaaaccagagctttgagccagaaaaacttgggtctgaatcttgtctcttctactcctagcttgtgaccttaagcaagtcacttaacccctgttagcctcaatttcttacctgtgaaatgttgacagtaatacttaccttgaaggattcttctaaggatatatataatgtatatacagcactagctaatgtttgtgacttaatggatgctcaataaatggtagctgatataattatcaggaaaagtcaatcctgatagttaagatcagccacagaagagtcagccctgatagttaagatcacaagttctgggaaccagatttcctgggttcacaatcctggatttctcccacttacttgctgtgtgattttagatgaaaggttttaatcacctcagtatcctcgtttgcaaaatgaagataatattcataactaccttatggagttgttatgctggttaagtgaattaataatatgtg

SEQ ID NO: 58156 - DNA, 1098 bp, Homo sapiens
ttagaagcaaaatatgcttttatgagcaattgggaggatgttggagactcctgagagtttcctgtgtctcctaggatttgccactggaatgtcagcaggccatacctcaggcgttcagctccatggagcaaagacagtagtgatcacgttccttgacaacagtgctagtgtgcggggagcttttagttttccttttctctgctcctgtaagccccataataattctgtagcagacacaggaagcaatgtgtctaactactactaggcaatgtgttcttgggatttttaattctcaggaattcgcagccaattaaatgaatttactttgatccagttctcttttcaaggcaaaagctgtgtcatcttattgggagctgactgtgttaagtgggagggtttacaagataagaagaaaagacagtctctgccatacgtgtttttataattgaaatgggggaaatcgggcaggctgagagagaataataagaacacatgtgcacaggaatttaaaaatagcaccccatttaaagcaggttccagtagtcaccaggaaaagaagaaaggtggagtactcaggagggacttgtacttggttcagtcagggaaaggtaaaagatagtatagttatgttctcaattagacttgttccctggttaattgaagtaaagactttaatatctaattcctacactgcacagaagtatcacacattgaaacagtgtgacatgggaaggactcactgttaacgaaagatttagagagaatgaaaaaaaaagtaggatttgggtttttcagagttgaaataggttcatcttttctgctagctcctccttttatacatctccactgtcgttgctccttgggttttaaattcagggagaatcaatgagcacagttctgcgtcttaatatatttagggtgcagctgtttaaagagccaggattagaaaatgaatcgaacaaactaggattatcttcaacagtaggatgctgagctgtgtttgctgattcctgcttaagcagtcgggacagggcatccttgcatgaaattcagacatccctccctggcagcctctgtggtaaagtagaggttgcagaa

SEQ ID NO: 58157 - DNA, 1166 bp, Homo sapiens
acttgctaatttgatctactaacctggaaattgactagggcttctcttataccactcagccctttaaagttttgccagtaaagtatcaacatggttaataatatgctgtaatttagagcacacaagccaatggacatacaaatttggtcattcagtagccacccagagagtgagcacagatacacactggagcagctgatttggcaagattggtggaggctgaacatattaactagtcattaaatgaatcatggtctttctgtcctcaacatttacaggattgctttggctctggcatctgttgttagtcaatactgattaaggacccacctattcttggtgataggtgttcattaaacattctaaatataccctgtcctcaagagaataccttactgggcctgggggttgttcctcctgcacccccacacaaaaagagacttccttctaataaaggcaagataaatatccaaataacacatgagaactgataatgacacatgcagccaatctgatgactgtgtagacttcattccatttagatctatagtttcacagaatcaagaattttatttttttcccctccttttcattgttgttatgagccatgtaaggggactcattgtcccagggacgggtatttgggagggggagatctttatggataccctttcttctcagtggcttattgctatttggcatactaaagtacaatttgctagccaggaggagtttctggctgtagatcaaacttctccgctcatgcctggtgccagagagatgcttgctcttaagggggtggttactgctttgataataagtgtgtggatttctgagtgacgtcattccactttggcacagacaggtatttatttctctagaatgaactaccaggggtgagccagactgtctgcctcagtcatttcccaaggtttcatttattttaaaaatctgctaacacatctgtgtgtatttttttttctctgtatgtttgtcaagtgctataattacttatagggcttctggtgacatcttaattaactagagaagaaaaaatcaaagatataattgtagagttgttcacaggtttttctatggactttgtggatccaactgtcaacatgatattgatggttacgaattctttttaagctgagaaacgtata

SEQ ID NO: 58158 - DNA, 1046 bp, Homo sapiens
ccttggtgatttttaccccctccttcttttaacaccttccccagcaaatccaatccatcctctggcttatctgggtcagcaagggtctgattttatgcatgacactgtcagaccataaatccgctgcagctttgcctctctatccagcctgcctgcttctgtcagcatcagcaaaatgcataatagagaaaataagccagaaaggctaataacactcatctgaataaaataatctctttggctgcctcagttcatttcattttaatcaaggtgccaggagggaatttaggttaaaaaatccagcctccttcttgtcacaagttccctgtccaaccatcacttaaatgattccttttatcatgcatgtacctttttttattcaccacatacttgtatgttcaataacatatattgaatgatgtatttaactctttaagttttgtctatcatcacagataggtctgtttttaaaagcgagaaattatattctgcttagatgtattgatagttgccatctctctatgcagattggcaggtttgataggaattctgagacaggggatgggagcttagtataagttgctgaagcatctagggttttggcaatctgtgctccctttggattcctttctgtcaacctcagcacacagttcccagtgtggaatgcaggactgattgttctaccttgtcccttagggaaaggacagtgggagattaaaatctgctctcctgttggtatctctctcacgtcttcccagagccttacggctgctttgttaattgcctgttgctgctgtcttactcaaaccattatttgctgaaggctgtgcattttcagcaggcagcaatcttggccctggcccagagccgggtgagaagcatgttggaaattgatgaaagctgagtcctagtttgtttggaaataaaaataataatatttcttcacatttgtatagtgctgaactattggcatagttcttttgcatccatcatttcatttgatccacacaacagccctgagaggtgagcaacttagagactattgg

SEQ ID NO: 58159 - DNA, 1050 bp, Homo sapiens
tcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgttttcatgaactaaaaatattgagatcaggattatgaatcagttatagttttatattcatttcagcatctggttttggtttaggtagtcagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctaacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggagactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatacta

SEQ ID NO: 58160 - DNA, 1351 bp, Homo sapiens
aaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagct

SEQ ID NO: 58161 - DNA, 1023 bp, Homo sapiens
caagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagcca

SEQ ID NO: 58162 - DNA, 1204 bp, Homo sapiens
aagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgt

SEQ ID NO: 58163 - DNA, 1529 bp, Homo sapiens
ttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatcttttttta

SEQ ID NO: 58164 - DNA, 1081 bp, Homo sapiens
agctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtggga

SEQ ID NO: 58165 - DNA, 1453 bp, Homo sapiens
cagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaaggg

SEQ ID NO: 58166 - DNA, 1051 bp, Homo sapiens
actgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaa

SEQ ID NO: 58167 - DNA, 2686 bp, Homo sapiens
tgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaa

SEQ ID NO: 58168 - DNA, 2693 bp, Homo sapiens
tttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatc

SEQ ID NO: 58169 - DNA, 1035 bp, Homo sapiens
gagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcac

SEQ ID NO: 58170 - DNA, 1011 bp, Homo sapiens
gattgaagacagattacagtttgttctggctattgaaccttgctcaaattatttaacttcactgaacctcagctttcaagcctggaaaattaagattataccaacctcattggggttattatgaggattaaaatgtagaatgtatataaagcacttagcacatggactgacgtatagtaagcatacttagtgaaatagaagcattttttaaatttcaaaactgaggaaggtggattttaccttggggaaaaaaaatgagaggtattttaggttcttcaacaggaaagtgccataattaaagtcacagtttaggacagtgaagcagacggtgagggtatgaataggggtagaggtagtaagaatggagaggaaagggaaattaccaaaaacaggtaaaagttttttgaagggtaacttttctctcccagattctaccccctgcccacaccccctccacccacactcatacactctgtgggccgtgttacttctgttcattagacttataggcatagagctcatcaacagggtctacatagagctagtcaggaaggtttacaggttcaagggcagcctggtgagaccagcagcatctcccagagagcccatgcccgtgcagagtcctaatgagccgcttttgtctagcttccatttgctcttccctcccaactgaatttaatgtctttccatcctctgcctctagttaagttgtaactgctgttattccactgcagccaggcagctgccagggcctgttggcactgaacccagagcccaacccaactgatgttctcactgagcttcttgtcagatgccaggaaagaggaggcacatcatatgccttttcttccccaatagtagctgcttccaatgtgatcatgatgagaggaaaaggctgtggggagagttaatttgatgcttgcttgtgcaatgaaatggcaatcaggcagatggccttactctatgcatagattcttctttgaggtttcttctcaggacccggacctcaga

SEQ ID NO: 58171 - DNA, 1030 bp, Homo sapiens
tctcccatctagagttgagcttgcatacattagctgctgttgcaatactcctgctttcagaaccctgaaatggcctggcttggttgctatatagtgatttaaccacagtaaccctcagtgagtggcaggttgtatttttattgttgaattttgttataatgacaaccccagataaacctgaaaatgaaagaggattctctttaactctcaattcttctcatgtttatgaagtagcgcttaattaaataatgtcattttatccttatgaatcttcttcctcctaaccgcctcacagccctctagggtgtgtttaactgttgaattgggagtcaagaactgagaactctcacccagaccttggaagtcggaatgtcagccctctttctactgcacagccaagcctattgatgtggtcagatctgccctctggaccaccttccttttctgccaagccttggggctgtccatggtgtgctcatgtgccttctccttcccacagcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggacttgtctagattaattacacagaaggcacattattctggggtgggagaggcctgggcccggctttttgtcaggtgggtgaggcacattccacttattgagcaaacagttagtgagtgcctgctgtcagacactcgggcttgggtgcagacatgggggattaaagccctcagggagcttacagtctggggaataaggtcgctaaggcttgaggagggttcaaactatgcatagagaggggtatccaaaggggcccagcagg

SEQ ID NO: 58172 - DNA, 2040 bp, Homo sapiens
gcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcctggggaaaatcaaaccatttacagttcatttccattgctgtggcttaggaaatgtcagtgtctgaacagatggagaagtgagatggcagcatgtgcaattagaattgggggaaggggtgtcaccaagcctcaggaagccccattcctcacctgccctggcttctggtcaaacttgccttccaagcaccttctccagctgtcactgaggttccttcccagggatcagtggaacttggggaccagctgagtggagtgatacattttctggtgttagtgactgagttgccttctgagccaaacagcttgtctccataaaggaggaatccagatgctgggtgctcaagccccctcctccccctgtcagagccttatttccatactccagagtgcagctgaagtgtattaccttgcaccctggtagcggaccactgccaaagcatgcatcatcatcagctctgctacttcttaaaggaacaggcttggaggtggtttttccctccatgattcctctctgctaggtctgggttactttaaaaatcaatagctcactcttctgccagggccctccctttatgtaatatagctgatcagtggctgagccaggcaggggccaggaccagtcctggagcttgtgaaggttccgcattctagcctagccttcatatgagtgaaaataaaaagagatgagagggtgggtcattcttggcctctgcagccagtctatccccatcagtgtgggttgtctgcagattgtggaggcaacaggagggagctgcctggaagtcgttgaactagggccaaagattgggtagcattttgaccggaagccttaaaattggccagggtcccacactaactggtgttctggggtgcacagcacatgaattgatgccaagtgctctcagatgtactaggaggaggtgcttggctccatttttggtgccctcagaggctgtgggactctggatgcctgactggtgacatcaggcagccagagaatttcactcttggcgctaaccggttctggccactgagctttctccattgtgtctgcttatccaagagttagagtgaagtcagctctctgtggatctgagagttggctcaggccagcctctcagctgggggaagaggtcaagtcagttgggagcttaaaagccaatggaggaaaaggtcaagtcccagccccctccatttgaagaaaggttttttcttttcaagcaagggaatggtccgtgggcatgtgaatgtgcccactctttgctgaggaggaaggagaccatttctatccagatgtctctctgcagacaagaggctaaaggacgaacggtaacaaggtgacaggagctgtctccacatgggtcctgcctcccaactctctcagccttctgctcctcatctgtcatccaggggactgtggatgacctcatcccataaccacatctccaatgggagacagtggaacagccattccttcacacaggggaaagctaattggcaataatccttgcgggaaggtcagactcctctcttacagatctagggaaggcctggggtaaaatgatggctctttggaaaatgccaagctccttcagattccataccccctcgggccctctagcataggcaacgaacttgttcctggcttcacgctttctcattgaatcaaagctctcatgcatggcctggatttgtaaacacatgctggctgccagcagtggcaagttagcctcctgacccacttctctcctgctttca

SEQ ID NO: 58173 - DNA, 1665 bp, Homo sapiens
gcaaatgagcaaacaagttcatcagtttgttgaaggtcatgaaacagaacctggggctttgcagtactaggcccatcacacattttaattagctgtttgtatgagggggttggtttagatttattttattctctttcccttaaaacttctattataatgttgttatataatattataataatgctaatattaaattttaaaagtaaacattaaaagatctgggtcaagtacatagcatgaagggttgtagtggcttttaggttttcactgtagagagtagcatgctgtagcagagtccatgtgatgtttacctcccacttagcactgtccagtgggaagcagagctgcacactctgatggcatcctgtggccttccccagcccactctcttcaagcttctccatcacctgctgtttaacaacccacccttcatgcatcctgttggcccttgtcgtggcaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttat

SEQ ID NO: 58174 - DNA, 1063 bp, Homo sapiens
tgaaacccgaagaggtaatccatcatacatctttaccagattgttatttattttaatggttcatcaagtgatagccagagttaactaatgaattgtgaacatgaatttaaaaaatgatttctggaatcacaagtagtgagaggaaggaatttgtatccatctcctttgagaactgtggctgttttctgagcagtctggtcttgttttgaaggttacagcttcttggtgaattttcctcattaggaaacctttagagtctcctgggataaccttccaaagagagaggcttttgaggcttgcattgttggcaatggatatttcctgaaggctttccacctctgggccctaaagtactgttccaaacccacaattaggcattggttggggatttggatattaccccgggaagaatgacagcaggtgagctggcatctggagcagatggaaaagggaaggtgataacagagcctctttccttgcagaagttcttgtgcaaaagcataaaaggacagagggaacagatcatgaataaggcagtagaaatgatttggtgtaagatttggttttggcttgttttatttttaatttagagagtacgggcacactaggggcttggtttgtaactgctgaggaagggtctacccagaggagagtgagactgctcattcatttattcatcatgcatttattgagtatctgctatctgctaggcgtggtagtatcagggatgcaaaggataatgaatgacatggtctctgaccatagagaggaggcagtctgaagaaaaagacacatgagtaataaaccctctgtgacagggctgtatgagaagtgctgtcatggagatttgcatggtacacacaggaccatctgggtgaacatgggagggctagggactgcatcccagagaaagcagatttttcttttgtttttaaacaagagagagaatcagatgcaagctcttagttaaaagttcacactgtacagaaaagtatagagtaaaagtaactcacatttgttcacttttcttttctttttctttcttttttttttttttttgaga

SEQ ID NO: 58175 - DNA, 1873 bp, Homo sapiens
tgactgttgctggataatgaaatattacattgcattggctcgccaaagagtattggtagaaatatttgcctgatgtacaagtatgcacccctcccaatctttccccaccttccccttcctcctccaccccagccaaatattttccctctcagtcatggtgctgctatgagaaaatttgtgagctgtcggagagcaaggtattcattcatccagcagttctcagatgcctagaaatgtgctgatttaactagagaaggggctttaatgggttggactccttagagaccctgggttagcccattatatcaaccacttatatctgccaaaacacataataattatgaggccatttacaattataggttcattatttagagatagcttcatttggctttcattgttttgtcattgtgaattacaataaagatcccattaatataccagtcttgatgactggagggaaccaggataatgggattctctggaacacatctttttggtgttagagtcttactgtaagttcacctgagctcctgagtctgtggaaggctctgtaggactgaaaagagctgagttgaatttcccggtgctgagttattttgctgtgagaccttaggccgctcttttcccctctctgaactctggtttcctcttatagaagaccagagcactccactagattcaaggtgtcctaggattccaaaggggttcctcaggagtggcctggtggcaggggcagagcgatgaccagcaaccaggctctggtcccatccttcactcagagcaggacagccctggcctccttggtttgggtgttatgcctctgagtcagattccctttgagaagaggcttctgaggctaaacacagattggaaaacattgacctagaggattctcaaggttgtttccaaactagatgttctacactctaaacccagaaaaattgttccctgtaaagatagcgatctttaaggatttcctagagaaacaaaacaaaaagcatcctttggtgtttcccagtgtctcctagcaggcaaaaaaatcttcttattgtctagcccaaaaatattttactaaaaattgaaccagtcctctcctattctaattttgagtagtggtagacattaaaagcagggacgtctgtgcttttgtgaaaaaaaagagctttcgtaggctttattgtggaagtaatttatcaagtttcttagccatttctgggactgaactgagtaatgtcacatgtttcattggctaccacacagattttttttaattattaaaaactttacttctgggtttaagagtgattgtttatctcattcgtcccaattttctctttttctcccttgttgctggattggtccaatctgattcggcgggattggtcacaggcgcagctcaactgtgaggaaacaggtaagggcccaagcggggccaggctggtctggcctgaaaatatagtccatcccacaggcatttattgagcgccactgtgtgcaggacagacacctctgacttcatgcctgcatttggaatgtatcatttagtcatagtatgtttaatatggtggcaatgtcattgatttaactagttggagtggccatagtctttttgacttgtccctctcctttctagtcatttatcctcttgcatactaggggtttggtttcattggtgcagattgttccagaactgcccatggcatccttttccaagaccacaaaagaggcttgacacttcctacatttgtgctaacatatcagtaactcacagcacctaattagctagaccagacaatctcgctttaagttggcagattttgtttgattgtttccggtggcgtagtcattctagatggattcctaagacatg

SEQ ID NO: 58176 - DNA, 2168 bp, Homo sapiens
atagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgccaggctatttttagtagagacagagtctgttgcccaggctggtctcacactcttgatctcaagtgatctgctggcctcggcctctcaaagtgctgggattacaggtgtgagcgaccgcacctggcctcactttttcattttaatgagtataataataataatatgtactccataggattgttaccagcactagtccatctaaaggacttagtacatggcctcacacctctttaaattcctctataaatggtaggcactaatgttcatgtgttaataggaaatattactctccttgcctccagtcccctccccagtctgtagaaggcaaattgaggcccaaaaaagttcagtgacatgagccagactgtgaagcaaaacaacagagcaaagattgacatctgggaggcctgcttctttgcttagtacctgttagtccccactatttagagttagtttttcttttctatcttacctttataccaaacaaaccctctttctgaagctcccattggttcattctgctaccttcaactgagaataattgagcacctcttatgtgagagcatcatggccaaccctggacacccaggaattgacataggatctgctcttgtgaagtttgagctgtagtggtgacaagtgccaacaaatattcacatccacacattggagtcacagtcagggttgaggagaacatacccccagcaggagcagctcatgcaaagccacgaggcaaaggaggactttgcagaacagaaacgtggccagcatagctgtagcagaagctaggggaaagaacaggcagtggaactggaggcacaggcagtattcctggcatgcaaggccgtgtaagagagtaatgagaggtctttgaaagagtttaaataatgaaatgtgcccttttaagattacctaattactatgtgaaggaagagaaatgcgggtcagaagatggcaaggatgggaattgaggtattggtggattgaactaggttgggggcagttgagatagagagaagcgaatggatttgagagatatttagaaggcagacatgacagaatattaattaattaggtggtggagaaggtggtgagaaactggtttggggcagaagatgatcagttttgtttaggacatgctaactttaaggcatctgtgtagcattccatgtgggtggttgtatttttgtgctctggaacttggaggacaggccaggtgcttctttgtagaccggctggtgatccgctaagacagttctgcacggtttggcccgttttctctgaccctgggctatccctgtttgaatattctaatgttgtgtttccctttggcttttcaggactccagccaggcaattcctctggtggtggaaagctgtatccggtttatcagcagacacggtaagcaggatgacagccttgtccatatttgtgcaaagattgggaagaacttccaggaattctttgtagagtaagaatagagattgacttcccatcctggcattctcagaaaaggaataaattcttacttgtccacataacttttgctacctcaaaatagccacacctagacattgaaagaaatgcatcatatattttgacacaaaatgcctcagccacttatcacgcagcatttttttagcttgagagtaagtttgaaattgcagctgttatgtaaatacagctgctattatgtggtaacagtagtttcaccattactcacagtctttgcaagtgtgggtatctcccactgtacagcctgaccattttgtcactttctgtaccagactagtttgaaaacaactcctttcccaatgttgcagtgattcctaataatcagtttttgttctggtttggtctcactggatacagcatggccaagggctgagttagtagctggtcttaaagttgtatccaacttttgagaatctgcagaggcaggctgcttctcagcctaggtgaaat

SEQ ID NO: 58177 - DNA, 1009 bp, Homo sapiens
gttaaataaaaagggataagctgtggtaattcagaatagagtataagaaatttcacaagatagtaatgattaacagtcaaacagtttgcaaagaaaagtccaaacggagttcaggggaggatgaattatttgtgcctaagagacaataggaagaagaaagtctgagccactgttcattagcatacatttcattcattgaacgaatacatattagttgcttattatatcccaacaaaaagtttctgccttcataaaccttacattccactgaaaggtggataagcaaatgaccaattgatcagccagtaaatacagtatgtcaggtattggtgaatgtcatgaagaaaagtaaagcagggtgaggggatggagaaggaagagggaacactgtttgaagctggttcagggaaaaggcctctcctaaagtgacattagggcagagttgtgagggagtaagccttgtggatatctggggaagagtatcttggggagcgggaacaagtgcagagatccttgccatatgcaggaagccagcgtagctggagcagagcaaatgaaaaaggaagcggcaggagatgaagctggaagccagactcttagggcctcatgtgctaggattggattttattctgaggaagatgggaagccactggagaattttgaacagggagtcatctttttaaaggatccctgatgctctatggagctaagactgtaagaaggagacaggaagcaactgcagtagcctgaggaagacatgatggcggcctagaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatccag

SEQ ID NO: 58178 - DNA, 1769 bp, Homo sapiens
agagaatgagattgttgccaacctttaccttgttgtgacattattatttctgaggaccaagtaatttatttctgtgaaagcattgattagcagcagtcactatgccagcatttttttcatgatttttttctctaacaaaaccaagaaattcttgtgcacattatcgtagtataacattcatgcatgtttgtctttagagtaaagctgtagtcaggaaccagtgcctagcacaatgtctggcaatactatctgttgactgatcacttcatagcaagcttgttcaacctgtggcccatgggctgcagcacaaattcgtaaactttcttacaatattacgagattttggggggattttttttttatcatcagctatcattagaatattttatgtgtggcccaagacaatttttcttccaatgtggtccagggaagccaaaagattggatgctcctgacttatagtttcatgttctctctttttcatgagtattgaaagcattgcccccttgaacaatcaaaccgtgttaaaacagctaaagcaatattataatctcagaccttatgaaactcctctgatgagaactaatgccttgacctatttcccattcttttttttttttttctttgagatagagtccactctgtcacccaggctggagggcagtggtgtgatcatagctcattgtagcttctaacttccaggttcaagtgaacctcctacctgagcctcctgagtagctgggactacaggcatgctataagcactgtgcctggctactttaaaacattttttagagacagggtctcatgttgcccaggctggtcacaaactcctggcctcaagcagtcctgctgcctcagcttcctgagtacatttttctattcttgaccctagatgatttaaaaaagtaccaatgggtcacttctttgctttacagatgggaaaagagaggcaaaacaagggaaggaatctgcctcatagtcgcccttggagtcaaaggagtctctaacttggtgctttctagtgaaaatgaatgcctcgaaattattccagtgacttttccaacatccttgcacatgtttttctcctttggcctaaagaagagagacagcgtgcttaaatacatgctggctgggggagacagatattcaactaagcttggcactatgcttgtgaatttgctttttcttcttcttgatcacttttctgtgtatttccaggactacagcatgaaggaattttccgggtgtcaggatcccaggtggaagtgaatgacatcaaaaatgcctttgagagaggtaaggaaacagtcttgaagataaaaccaaatatttgccagccccctggggtattggctccaccctttcttctctaagaggtccccagaggtcaggaagccaacttccctgtctcttcagggggtacctgctgtcttgtacacattcccctgtagatatgcagagaaataccagggcacatcccagtttccttcttctttcgtagccctacccatcctgcctctttcacgccgatgatctgccaaaacccaagaagttaactatgatatctgggcggtttatggcttcatccggaacccttggtagcagttaatatcaaggctaatgcgcttgttcattgtagcccatttattattttgtgggctattaaggtaatgggcaagctttggcaatttccgtcactgtaatggatatatatagtgtcaatttgaggttggccctatcattaaatctaattacatctgatatgaa

SEQ ID NO: 58179 - DNA, 1151 bp, Homo sapiens
caagcagcagcccagaggaggagaaaagagtgccacggggccatttaaaaccccagagtcatggtaatagcgagtttggatttggatttgggaagcaattagaagattttctttttttttttttgagacggagtcttgctctgtctccaggctggagtacagtggagcgatcttggcttactgcaacctctgcctcctaggttcaagcgattctcctgcctcagcctcctgagtagctgggacccaggcgcatgccaccacgcccagctaatttttgtatttttagtagacatggggtttcaccacgttggccaagatggtcaccatctcttgacctcgtgatgtgcccacctcagcctcccaaagtgctgggattacaggcgtgagccaccgcacccggcatgttactatctgatttgtgtattttatttttttaaaaactgccaactgctttgtggagaagttactggaaagggtcatgaagagaaacagggagaccctatcccaaggttaccatctggtctggccagaggtgttagtggctgagtctggagagcggtgaggaggggtcaggtttgtgatacattttgaacatagcattaacaggatttgcccatggattatacatagaatatggagagagaaatcttaaattgttggcatgagcgacagggacatagggtggtcatttatggagttggagaagacaaggtgtggagaaaggaatcaagacaatgtgttgatgtggtcatggtcatttgaggcacttgtgagatgtccaagtggagattttgaacaattggacctaggaatccaacccttaagggagaaaccaggagtggagctgccagtgcaggagttgcccatgtactggtggtatttagctaatcacccagggaacggatgtgtctacaacaaaggtctgaggagcagagggggccgcgggtgtggatggggcatttcttctcgtccaagcagcatgtccttgtgtggagcaagctttggagtccccacatgacaggaaaggcaccaagcaaggacatgtgattcttcccctctgaggcacctctgtcttttcactttggttttgctgcagtttcgccctcaacagcctagaccaaaggttataaatgggcaccctgagagccaga

SEQ ID NO: 58180 - DNA, 1036 bp, Homo sapiens
agaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgtt

SEQ ID NO: 58181 - DNA, 1516 bp, Homo sapiens
cttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggagggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaaaaaaaagagtatctgtagacagttaaggtggttcccttgaactccttgtttgctggtgtcaggagtcttgggatggggttcttggaggacaagcctcatcacctggtgggtgggtgagcggtggccccggggcatgtctggcccttagaagtgagtcggcctttgagtcttacctcctgccccccacgccactcctcctcccaaattccttgagtttcccgagtgcccaggttctctttcgcccctgggcgctcacgcctgctgtctcctcacctggtcacctcctcatctcccttcaagactcagtccgaagacttagctctttggggaagccattctgacatccctgacttccccaggctgagtgaggtgcccttatgctgcattccaaagacactttgaataccttttggtactcacgcttcactcagatcccccaccagattgagctccttgaacccaggaactatatcttccttttctttacatccccagggcctagcctgggacatggcacaccacagccacc

SEQ ID NO: 58182 - DNA, 1027 bp, Homo sapiens
cttcgcttaatcagacattttttctgacagcaacttacatcttgacaacacaaagcccgtgaccaccaagtaagtatccatttctccttcacccagcttgggggtggcaagggaatgaagacatggagaatgcaagagaagatgaagccgaggagagaacgagttctgtgtccctctccttccgaagtccctgggtgccaacatctgccccctcccacttatcctagcttccttggagccagggctccctgatcacactgccctttctgtttgtgattgaaggcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggtaactgtgggctcctggacagacagcatgagtctacattcatcactaccacttagtgccacccacctaattatgacaggacttgaaacagaatgattattttgtatgtgatatactgagtatatgtccactctggacatgtggacccaataagacagcttaataagtggtctgcctgtccctctctccccaggaagaacctaaagacagaataaaagaagcctagcttcttgctcatacactggctattaggaaggctgttgtaatttttaaagccggtattaagagtattttgaaagcccaagttttgagtctaaagaccttggtagactttagtgaaactgcccgactgttgaggatcaggtgtaatcctggccacatgtttatattgctgtgcccatcaccatcatcccgattcct

SEQ ID NO: 58183 - DNA, 3183 bp, Homo sapiens
aaactcctggccattcttactttgtccgtgtttctcttccccactagattatatgtcacttcgtcgataagtatttcaatatctatctctaaaacctagggtctctaaaaaaatatcaattactttttctaaaggaaaaaaaaaatctcatgacagtgaaaatccctccgtccccctttccctacttcctgagcattcatatgttcaaagatttaggccaagtacaataatctggacatcttacggtcattttcttcatgccttggcctgtgttgttgaaaccggctccttggggaattctcccctcatttgcctcacctcctcctttttcctgttttgcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatcca

SEQ ID NO: 58184 - DNA, 1056 bp, Homo sapiens
cagacagcaggagaggacaatgcttcaacaaagcagggaatctgctgttgaatgccaatggggtaaggtgagggtggcatagaaagggaatcattggacaagagcattttcagcagagggggaatgagtccaactggagtgggttaggtggcaaatgggaagggaagaggcagtaacttgacaactcgttgaatggggagcatcgagagacaagggtaagatgggcagtgcagaggtgcatttgttggtggggtgggcaggatgcagtagaacgggaagaatgaatgtgcaggagaggagagggtgagctgcagggtacaagcgggagggttggccatggccactagaagaggctcaagaagaggcacttcctgctgtcgcgtgggagggaaggcaggtgagtacagacacagggcaggcagtggatgtgggggaggaaatgagggggctcccttctgattgcttcttttatctaagcgaagtttaaggcaaggtccttagctgacagtgtaggagggaacagtgcagaggaggtttgaagagtgaagacaatgagagaaacacttgcttttcctcgaagagagacgacgctggcaccggcgccgatttccttcagtggcctggatgctgcctcacagcttgtcccactgcttggggccatagcagcaagattggctgcagtgtttgtccctccttctgcacccaaagctcctagccagagctgacccctgaaggtgacaaagagctgggctctgagacctcgtccctcagccctttgcccttgtgactgagcacagcaaatacgtatggcctggcaatgccccccagcctcttccatatgcaccccaaccagcacccgagtcctttcccctcccctttaaggcactgggccggcgagtcagttgtgaaaaactggctcaggccccttagaggtggaaaaagaaattaatatcttttcagagcagaccaggtgccaggagcttcatctcattttactttcaaaccagccctatgagaaacgtcgagtgacgtgctagggtcatccacagtaggtgg

SEQ ID NO: 58185 - DNA, 1033 bp, Homo sapiens
agactgtccccgaccagagccagctagtggcctccccgtctgtccccagtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctggtgggtgagctgctcgagacccgctgccctatgctgagggctccccttgccttgtgagccccccagagcccccatgagggggtgtggcccacctcctgcttccacaggagttatgtctctcccctgtaccccaaccagaagaatgcattctgttctctaagatggaaaaggtgaggctgacacccatttttaagatgacaaagaaggatttgaacagttctgttttcacctgcaggcggtgaaagggggtctgacaggtctcaggcccttgccagccctccggctccatggcctcattctggttctctccggcagcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtacggtgggccacagggcagggaatggggcggactggcagtcccctggcccttcccccaccggtccttgctgtgtcttctggtcccctcacactccatggccctcctctggtccaccccccaacccaggctctttgtagatctttttttgttaatgggatcaaacaagcagctgagctctgcccagggctgatgggagtctgtgaatatgctctatgttagttcggtgcttcactctagccctctgctcccttactgctctcctcgtctcaaccgaagctcaaagagtgccttgcctaaggtggaagagctcaccaggggcaaag

SEQ ID NO: 58186 - DNA, 1048 bp, Homo sapiens
tggataaggaggactcctggatctctgaacctgggcctgggccctggccctctctagccccagtattgttaactgtacattgggctggaggtggggagacaggtggttgttaacgtggcactctccagctccgtcattatgactcagtgatcacagctttcctcttaaaacacaggttcggtttggtccgtctagcggtggtcattttttagaagaatagtctaaattcttctggacctggtctctcccttctcttcccaggccagagatgggtctccccctagtgcttcgtaggggaatcttcacttttgctttttgtttttcccttggaggtaatttttaggtaattcctaagatttccagagtccagtggccagggaattcccagccagctttgctccatggcttctccctcacggtaatcatagtcctctgcctcccaaatctgtagcagaagagaggttcctggggctctgggggctcaccagaggcgggagctcaccctatgaggtggtttctgaggaatgacccatgggacagtcaaccccacagtgctaccaaacagaggagctccgatgaggggtgtaagccacaggccaccgcctctgccccacccctcctctacctttcctcttccctctcctaaccttgcttttgctacatcagtggttttcaaaccttggtatgcatcacagtcatctggagggcttgttaagattattgggcttcatccccaaagtttcagaatctataggtctggggctggggtttgagatggctcattttgagcaagttcccaggtgttgatgctattgatccagggacccaacttggaaaaccattgctctaggtctgaggtggtgattctgagaatgggcttctctgttccttctccccaggacaagtgtacttcagtggacctgacagataaaagcccaatgagggctattcctgaatactttctgctgaaggtgtaaaagggaaaatacaatttgcccttgtggtctcttattttaatctcccactttttctgcaagcagttctcttg

SEQ ID NO: 58187 - DNA, 1030 bp, Homo sapiens
gagctaccttgagggccccagagagaattttaatatctactttggtgtctgagcaacaactgagcagatcttatgcctttccctttagtacaaaatggtcgctaaaagtgtatgtcaatcccatccagccctgccacacagaaaactgatacagtcattttggaagagagtaaagaccaggatcttggggtggtctttggctctctttcctgtgcctcagttcagcagaggctcccagcttcaccccacctgtccagcactttcccttctcaccggccttggaggaacctgcttccataaagccctccaccccaacccactcttttacatgggaactcagcatctgaaccaaactggagcttgctcaggtgcatcccctcttggctgttctcacagagacgacagcccctgtgtgtcagctgcccatcttgcctgtccacatgaggggctggccatctctgaccttagagttgcaggacactcgtcttaccattacattgacctttcctgtttgcttcctggcttgctttctggcagtgtgtgtgtgtgtgtgtgtgtgttggagttggggctggggttgtgtggagggagggagcagttgtgtgcctccaggccctccgggctgggctgcaggatgctgaatgcccccagggtggtctgtcctctaaatcaaggaactacagtaagtggtctcaagagggctgagctttgcctccttcctggaaacataaggatgcagatgtcctgacctggctgcctgacccttggagtggggagtttccattcccttgctgccagcctcactaggagtttagccaggagtttgaaaaacttatagatcatgttgattttggcaatggctgcagacctccaggcttgactatcacagtctctccgccttcccattcaccaacatgacctatccttccagcccccctgccttactcctctgcacccattaaaggcagaagttggagggaagtgggagcaggtgggaggaactcagatgagcaggaaagttgcacagttc

SEQ ID NO: 58188 - DNA, 2001 bp, Homo sapiens
caggtaattctgatatacagttgaggttttgaactatttctctagagtgttttgttgctgcctgggaaggaaatggttcctgtttttaaaccaaagtttaggtgctgtgcctgcctctcactgccagctaggctgcaagccctcagtttcagagggtgagatttttgcataattaggtgaggaagaggcactgcaaagatggggtttcttttacttggcagtggaaaagataaccgtttctgatatttcttgggaggaatagaaatatcctataagaaaatacactgggatggggttggtgtgggggatggcttgctccatggcctgaacagccatctctctcccttcttccccccagttctccttcctcacctgcctccagaaaatacacctttggtttggtccctgcagaaacacttcctgtactttgtgtcttgaatccaccttgtatcttgaggcctctgtatatcttcctgtgtcattttgctggagtctgtaagccctcagaagacaggaatcccttctaagaaactccttttactgaaccccagagagggtgatcagggataaatgcttcagggtggtgggcacggcccctcttatccttacgggaagcatcttgactggatattcaggtcagggacagtgttcctcagcacgaggctggccttcagcacagaactctccagggaggggcagggctgggtgagcaagtgcaggggtggactgaggagggtgaggcaggctgagctggggacgcgtcctccaaaggtttcagtctttcattcttctaggtgcctttttaccttcaatgacacttttccactctcttttctcccttggatcacttctggaaagggttttaaagagctctgccatattctgaccccattctgacctcttacagtgcttttattcttacccaaagagagatcacgcttgagctcctaagagaatttctttttcctgtctccaaggaaaggagttgatgtgtttcccggtcgtcgagagattgaggccctcatctgggaagggctgagcttgcttctataaatagccttgtcagaacaacctgtgtggctgctcagtttgtgcctggctagaacagagcttcagggaagcctcactgctgtgcgatgccaccacctgggagttgccactggtcagtcccaggagttcccaagactcctctccaatgccctttgggaagaggtcggaggggtgggaaaggtctccccatttcataggaagggggtgcctaaaggtcaggagacagcaagggagatgggggcaccaggccctgggccctagcttggtctctcttttcagaaaatggcagtttcctggggccacgtgcctcctttgagaggggccggggacttggttttgaatcataccacagttttaggaggctgaggcagtactctcctggtactttcccacttggctaggcacaattagatcgtgtttctctgggtcaggcatgtcacaaatggggcctgggggagagccagcctgtgggcttgggcagtgcagacgtagatggtctcagtaagaccatcatagttacctcaatctaaggtgttgcctagatgggtagggggacttatcaggtcacaagacaaggttttgatggacccaaggttagaacttccctcttttgcctcccaggccagagaattttcttccttagtcccacaaaagatagggtttggtgatttgtaggactggtgactgtgaagccaggccaggccctctgtccatccctcatatttgttcatttttttcctatcagggatctgaccctggaagtggggccagcttccattcttatcaatttcccaaatgcctacaggtggtggccatttaaggctttgacatctgagcgggaacacaggcgttctgaactcttggcatgttaaacaggctctgggaccccaggactctggcaccggcccagagcattggggtgagtgctctgaggacaatacagctttctgc

SEQ ID NO: 58189 - DNA, 1043 bp, Homo sapiens
aactggaagtagacacgggccttttaatgaaatgaacatgacagtaatgaacagggcaataaccttttatcttgggtgtctgctcagagtttaaagcatgattccattcacatcatctcctgaaagattaggaatggtggggcagattcctcccattgcacagatcaggaaatgggagcctagggtgtggttttcctgaagtcacatgcagagtcagggactctgctcttgcctccctgcccggattccacagatctgaacaccacatgggcagctggacccctggtgctcaggagaagcccacagctcccacccaaggccggcaggagttttagagggtgggcttggacacaggtaggaagggaacggtctggttgggttcactctttctcctaccttgtccgtccttgtgtatccgcttaaaaagtgcaaacttctggggattgtccacaaccatgaacttcttgagcagcccctggatgacctcactgacggtggtggtgctgctgatgtgcagctgcttgatggcatctaggggcaggtagaaggatgtccgcttgtccgtggtagccgccaggttcacctccttgatggcatcatagatggactggggccggatcccagcaggcaccgtcacaggccgccggagtttcagatgcactttgatgaaacccgtgtaggtgccgtcttcactctgccagcgggggcatgtcacagggggtcagggccgtccgccttgcatgatcatatctgccactcggggccattgccccagcagcacccacctgtctccttgagttctttcctgcctctgctgacgtgggagagctggaggaaggagcagagatccctttccccatagtgggctgggagaagaccctcaggatccagctaccaaagaggacctgtggggctgcagtggatttccctcccaggaggctcaggccagctccctaaacctcctgtaaccagttgcctttggtgagtgcccattgtaagaggcagggtgtggggtagccactctagtttgtacctctgaacca

SEQ ID NO: 58190 - DNA, 1056 bp, Homo sapiens
ggtgacgagagaggcaactatttggttggtgaaaggcttgcagatcgagagaggacgtcagctgtttgtttcacatgagttctgatccttggcagaatctgtggtggggcacagcctgggggcgggcacagctgaacccccatgcaaacacttgtccatggaagagacttttgccacagctggaactgctgggcaggcacaaatgcacctgccagagatgtcctgagaaaaagtgtctgttgcaaaataataattaataatacaaataaatctgaatgcaccaggaggagaggaagcaggaccggttacccaggtttgccctgggattctcttaaggcctcctccagtttctgcctaaacttgtcatacttcttttgcacttgttggattttgtcctgctcctctttttccaggattgttaggaagttctgaagttcagggatggagaaggcatcccactgtgaggcgagagggagatttgtgggaagaaacagaataggagacaggttagaagttgacacgacctgagagaccctgctgccttccccttcccagttcacatccgtgattcacacacagtttgctactgaacagactgaatcagcgaagcctgggctttgcatgcctgtcatagcagcaacaaaattccaaatgctggcatctcatgaccaagagttgccagtctatgaaccatgtttttattttgaaactcaataatcttaagtttctgtgtagcagccgagatcttgacggtgatgctggaaccacccagcctcccaacatgcagaccctcagaaagcaggtggaggagtggaacgtggactcaggagactggggttgggcctgactccacctctcccagcagtgtgacctcgagcacagctttccacccttctcagcctgttatctgctgggaaattggggtatctacctcccatgactggcagagcagataatgagagcctgactggcccaggcgtacccctaaaggacctggcctctgatggcagaaggcaagttggacttccatcaggctgacccaagagcacaagccct

SEQ ID NO: 58191 - DNA, 1053 bp, Homo sapiens
tagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcatgttagaaacgtctcccttgaacttcaccatcttacggacactgggagcgggggagagagggtgagaatggacatgatcacatgcttcctggtggagtcagattttcttttgccagtgagcagagaaatgaaggctactgttcaaataatttgggaaaaattgtccaaatgcgtaggcgggagggcgctgcctgggtgaccagctgttccatgtctccgcagtgcaagagagtcaaggagactgattgcaggcagagatgctgatgtgtgggaaagagaagggccttctggagctaagggtgatttgacaccaggacaggctactgagctgagccatgattcttctacttctggaattatttaaaaataaggtagaaaggaatagatctttaaaagtttaagatcacttcacctggaggaagggggctagatcaaatgaccaaaacaaac

SEQ ID NO: 58192 - DNA, 1031 bp, Homo sapiens
accccagccttccctgccaggctctctctggcagctcctacacccatgttgcaggcaccagctgtcctggtctccttgcagttctccagattctccttgcatgttcacccacatgtgcttccgcctgggctatccccttgcctaagatgccctcccacgcccaagcccacctgacctcagaggctcactggcccagcccaggggtcctgggaggcctgagcctaaattagcattttaaacattgctaatgtagcactttccaattgtgtttatatttccggttaatgtctgcagcttggctaattttttctaatgtctgaacctcctgccagactgagctgcatgagccagaaaccttgcctttttcatcctcagggcctggcggatagtaagtgctcatttaggcaaatgtattccatggcctatggcagtacctgacagttaacttctagagttgagcctctttatgtgaagaaccccatacaaggtactgagaagaaatgttatgagcaagagcgaggagcacagactgaacagacacattctctctcgtgaaaaaattataaatgcctgaaatacacccagaaagtagctctcagtgtgaaaatttcagaaatatacacatcagctgtgaggtgtaggcgtaagtggtcagtcccgaagttgagtttgagctgggtggaatgacattgtgaggcaacggggactggtggagggccagccggggagcaaggtcatgctccgctgaggagtgtgtgctttttggattgtagaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaatctgacttccctcttgtttcctccacttagctaaaatgtactaatttttgaagt

SEQ ID NO: 58193 - DNA, 1018 bp, Homo sapiens
tttgtttttatgtttaaatgagccttgtcttttggagatacatactgaaatatttatagatgaaatgatctgatgtctggggaggtttgctttaaagtaatagaggagtggggagtagacaggggtatagatgaatcaaggttggccatgagttggtaattgttgaaactggtgataggtacatgtgggtttatatattattctgctttcatttatgttttgaattctccaaataaaacttaaaaaagaagtagacattctgtgtgatacagagagtatctgtccctctaaatatgtaatacatatattggatggggtagacagaatcaatttagaagcacaaaaataagtgatttggatttaaaaagtactagggttataggaatggtgaaccatcagagaacacaggggctcagaaggctgctgaggctctggaaggccctctggagggaagggaatgcagtcaccaccgtcagtctctgtccccactgtccccccaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttggtgagcatcccctctgaagagtggaggcattggtctagctcagcaaagaccttcctgccaactcaacttgcataatacacacacacacacacacacacacacacacacacgcacacacacactctctctctctctctctctcgcgctctctctctctctctctctctccatttagtttttagtagctatttagagaagagggaaccagtgtttgaatcagatcctttggctccttccaaattcagtgttttctcttccactattagagtagttttcttcctggttggtccctttctataaaacatatggcgagcacccaaacttttgtgctaggcccattgtt

SEQ ID NO: 58194 - DNA, 1020 bp, Homo sapiens
atgtcagaaatgtgaagcagcactcgcaggcaatgggccacttaaggcacattcttgagacaggtagtagcctccacagggcagactgggcagattctcaaaaggccaggtcagtggaccgtttccaggggcctaagtcactgatgttcccatctttgaatcagtgggtgtctaccttggccgcattttagggagctttaaaaaatacatagccctagtcagagatacagatttcattgatctgggctgtagctccctagggatttgaatgattctaatgtgcagccaaggttgtggacctgcaatttcagcctacacctaactgcctgctggtagtggggtatgaggaaatggtttctgttggctttatcagtttgcaactcataacttctgtttcaggtgtttggaaaaattacagcctgcctatcaagtgacccttcccggacaagagcccattgtgaagaaagggagaatctgtccaattgacatcaccctagcacaaagagcgtctaataaaaaggtaattttagaaagacacaatgttcaaggatagtgatttaatgttcttgccaagttctggtctccctaatgtgattggaggtttttagattggcctcaaactcatcaaagatttttttatgaaacacccgtgtttatgtgcctgggctgggctctgtatgaaacaggtaaagctgaccccgctcactcactgccctctaggattttgttctaggaaacttgctagagcctggttccaaaagtaaacaagattgtattttcatttttttcttagaactatgttatggacattcagctcccacatattctttcacctcttaggccttgctcaatgaaaataacttgtaaaaaacttgctgaaggaactgagtgtgtttagcttggcaacacaaaattgtggggaaccaatgacatctctcctcaaatatgtgcaaagctgtcccctggcaaagtagggcacttattctatatgccttgaaaggacagaaataggattattgg

SEQ ID NO: 58195 - DNA, 2970 bp, Homo sapiens
tgggattacaggcacatgccaccatgtgcagctaatttttgtatttttagtaaagatggggtatcaccatgttgcccaggctggttttgaactcctaacctcaagtgatccgcctgcctcggcctcccgtagtgctgggattacaggcgtgagccactgtgtccggcctgaatttatttctttttgagaatctggctgtggttttttaaaaaagtgattcttaatgtaatgtcttcccatttatacttgggtgtctttaagctatcctgtacaaatgtggtgtctggagtgtgtggagggatacttggtaatctgttctgactttcttgggttgcaaatatatggtaaaggggccccagaatattctgtaggataggattctggggtggattctagaaggactcctcgagaatccactgctattgcgtgtcatgttttgagagaagatgtaagcttttatcaggaatgttctctccaaaactaattgctgtagtgcaggggtcagcatgtttttctgtaaagggccagatagtaaatatgaatattttcagttttgcaggccacaccatctctgttgcaactgctcgatgctgccattgtagcactaatgtgaccatagacagtagataattagttggccagacctgaccccaggatgcggcttgctgggccccactccaggcctggctgcccacagtgtgagtttgctgttgcaactttggaggccacagaaggttgtctggtctgggaggaatctaaggctgtatccaatgtggtagccactggccacatgtcgctattttcagtttaaattaatttaaagtaaataaaatttaaaattcagttcccttggtcacattagtcacacttcaagtacttactacccacatgtggctaatggctgccctgttagacaacacagagaacattccacgtctatggaaagttctcttgaacagcactgatttagaatgtcccatagtctgcgtccctctctgctgtcatccctgggcagagagttctggcacagtggcctctctctgaaggtgggggaggaaggctgaggaaaaaggccctcctctcagtgtcaggcaggtcccagtatgactgctcattagtttaatttgccttttccatctgccatcagccctgaaggacgacaactggacataaagaagtcaagctacaaaaaggtaagcaaggatcttctttgcagacccatgcagagagttgtgtaggggcacatatgacataagccagatggatgctggggaagccttgtctaccaggctcagtctagaattaagctttttgactccaagtataagggggaagaaagaaactctccctgggctgaagcagttggtggcacccactttcctttctcctttgacccctttatatctgattagagttctgaacggcctcactggttagtctctagcagcttcttgctccctggccctcaggttgggggcctcccagttcctggttgatgaaggcaggggctgtctcatatccctgcacagtccctgcctagctcactctggcacatcctgggtgctcagtatgtgtgtggaatcaatgaagtcccctaccactggccctctctcccttagctctctaagttcctgcagcaaatgcagcaggagcagattatacaggtgaaggagctgagcaaaggggtggagagcattgtggctgtggactggaaacacccgaggtgagtgcagggggcctgtcactgtagcccagctggccccagggcacctgggccacggactggggattgctgagatgctagtataaaatgtgttttttctttccttctgctgggttttaggattacatctttcgtcatacccgagccctccccgacctcccagactatccaggagggtagcagggaacagccctatcaccctccagatataaaacccctctactgtgtcccagccagcatgaccctgctcttccaggagtctggccacaagtgagtttttggagagcagcccttctctgcctgcttggtgttctggcctacagttcctctcaatctgagtagtgctcttttgcgactggcaaaacctgctctgcccctgttctccccttctccaaaatccagcttccagccttcttccctgggcaagttcctctggactaaatgaacgagtaggtctcacccttttctgcgtgtaattattcttcacatggtcatgctcacttcagtcaggaaaagggaagaaactagaggccgaaagctaaggaaagttccctgctcagcagggagtgagtctgggcatctgcatttttgtctcatggcacagcatgaactaacccctgggtcacttctcctcacctaggaaggggagctttctggagggcagtgaggtccgaacgatcgtcattaactacgccaagaaaaatgacctggttgatgcagacaacaaaaagtgagtgcatgagaagcaccagatctgtcttattgggtctttgtctttatcagacatagacacatttggggaggatgtctgggagggagaatagaaaaccatagcatcttagaggtaattaagatcagtggtttccaaaccatgggctgtggacactcagagttattgtctggggtgttcagatccatgtatacgatcaacattgactaccgactaagtaaatattctctcacaaatacccatgaatcatctttaattggctattgtgaggaataaaatgcaagcttacaaagaatttactgaagtcatcatagctttaggtatttatttttattgatagatatttgtacatatttatggggtgcacgtggtattttgttacatgcacagagtgtataacgatcaaggcagggtatttggggtatcatcaccttgagtatttaccatttctatgtgtcgggaacactgtaagtcctcttttctagctattttgacatacacaatacattgttgttaa

SEQ ID NO: 58196 - DNA, 1047 bp, Homo sapiens
tcaaggtataactctaggaggagaagagcccatctccccacctctcaatttaggagcctgacgaactccactccactgctgactagaatggcccttaagcttccggagggggaggggaaggtccttattttctgtgagggtggcgcagcagccctttcacatcttgtttttgaatcctttccacataagtcacgtcttcctgggagctaatccgccctggcatttgcctgtcttcagctacaaagccctccaaggtttcttctggctcaacttctctgggtgaacactcctagcttggtgggactttgtggcttgactccttctctggggtcaaccctctttaaaggctcagtgctcaagagaggctgggagctttggtacctgggaatgggttcctttcagagccaagtgggtgaggtagggatgaagctgggggtcgttttcttgtaccaggtgttctgtatccctcaggaaggatgtggctcttgtcttttccctgcagaacaaatggatgagctgttacagcaatgcttcttacatgccttgaagtgccgagtcaaaaaggctgacctccctttactcaccagcactttccttggcagccacatgttctcctgctggtatggaaagcactgatgtgggctggaggccggggccggggtctcacgtgtgctccttggtagtaggacaggatggggccaatgcagggactggttgagggacatgctgtggaaagagtggagggaaggcttatctgacaaatacattagttcctgggttctaaaaagttaattcttagcttgctgggctgttaaaacaaaatcttaaattttagccaatgaaaggatattgaggaccggaaagttaaaattcctgagattctgtgaacactgcctctgccgtgggggttctgggcaacctcacaaatcgggcagcgtgtcctctgcaggaagtgtcccagggcagcctctttgtcaggaatcttcttctggaacattcaacctcctcacacttctgaaaagtatgtggggggccacattaggtttt

SEQ ID NO: 58197 - DNA, 1055 bp, Homo sapiens
tgtctataggtctcatggcatagttatttaatcataaactggcatatttgcgaagcatgtatgagaaaggagtgggcccaagggctaggcatgaagtcaggaaggcagggctgtttcctgtgtcaggctaacttggattgttcactgggcctgttttcccacccataaaatgggaaggcataccccaggaatgagtgaaaatagatgacaatggatgaaaaagagtttaggatgtttcagaagagtgtgtgtgagactaggacatcataaaccaggcaatctttctttggcccttgtgattttatagtgagcacttttgagttcgttcttgatatttattaaaagtctgtccaggcagcattcacagtgctggtgtgctttccacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacaggtatgacaacaggacgaagatggccattaccattaggtagttcttgcctaacatctgcttctctctgtttcttccattgtctcccataaaataagcaagcacgaaatctcccaataccatccccaaggatctttatggacctggtgttcctagaattgggtctttcaattctaggatgcaaaaggttttctcttatgcaaaaccactataggagggattaaaaaaagggctgacatagtaagtaagggtggttgcaaagggaagttctgagatgaaggaacagtggctgagaagtttacagtgggttgactaggaatagagcagaggtcttgaaaaggatggaatttcagggcatgtcttcatgagacagagtcttgctctgttgcccaggctggagtgcagtggcgcaatctcagctcactgcaagctccgcctcctgggttcacaccattctcttgcctcagcctcccgagtagc

SEQ ID NO: 58198 - DNA, 1012 bp, Homo sapiens
cctccccccatccctgtctcaccgggcgcgggggacggggctagagcggagttagagcaagaagaatttccacccctggattccctctgaaaccctagatcggggtatatgttaagggattacgaaaatctaggactttttgtggggctttttattaaagggggggagcccgggagcaataccttggaaagaagccctgttgcttagagcggataaccaacggctgaactcttggggtttgctgtgaggggtgcggtctagcttcgaatgtacaggttatgggctatgctgggtacggctttctccggatcctattttgagagattccccaccttgcgttgtattttacacctaaatggagagaagagacccttgctccccgctttatttgcatgcagactcttgttaatttcctctggctgttagtcactaggcaattttgcacgttttctttttctttatatatgtggacgcctatcctggtttgttttatcaggcttatggcaaagggtcagtcacatccagaatatttggtttctgttggtgaagccattccctgttaaaaatataaataattctatcagaatgtgagcatgtttttaaaaagagcattccaaaaatatttgtagcggtttttttccctttatatttttataacacatctataaagaaaactctagaatgaatttcacaaaacagtttttaaggtgaccagaatattccaggatattttaaaagacgttaaaaaattattcctctgcaacatcatcattgttatattcatagtgtatcatgtaaaatgatacaatgaaatgctgatgtgtgtaactgggaaatccgtgttcttggtagcagatgaaatacattattcagggccatcttgtggattaaataaatcctctccgtcttttgtgttcccttacagtggtggagccacagtgttaaagaacagagaagtgatccttaatcatttagaattttgcctccaccatccaccagaaaatgaagtgga

SEQ ID NO: 58199 - DNA, 1107 bp, Homo sapiens
aataattgaattgactcatttgtaatatttctctttcacgtttctgtgtttaagacctgaaattgtttctatatggaaaaatcacttctatttttcatagtccttcctgtggtcatcagtttttgcttaaaatcaacctttttccttttttttttttttttttttcctgagacgcagtcttactctgtcttccaggctggagtgcagtggtgtcatgtcagctcattgcaacctccacctcccgggtccaagcaattctcctgcctcagccttcctgagtagctgggattacaggcgactgccaccacacccagctaagttttgtatttttagtagagacagggtttcaccatgttagtcaggctggtctaactcctgaccttaagtggtccacttccctcggcctctggaagtgctgggattacaggcgtgagccaccgcacccggccctttccccactttcaacactagtagtatacaaaacgtgagctaaaaatattttgaaggctggtcaccctatttttcgtcccctttttggagtgtagtggggtttctttccattctttgcaagttgtttctttaatatgtcaaaatgtctaagaacttcagaaccatatacatcttgtgttgcccatcagattgcttggttacttgctgccaattggttcacctctataggaaactatttgcaattgggttgaagtgttaacatctgactttaagtcattttaactgattttttttttttttttttttgagatggactctcactctgtcacctaggctggagtgcagtggcgcaatcttggcttactgcaacctcccgggttcaagtgattctcctgcttcaccctcccaagtagctgggattataggcaccaaccaacatgcctggctaatttttgtatttttagtagagatggggtttcactgtattggtcaggctggttttgaactcctgaccttgtgatgcacccacctcagctccccaaagtgctgggattacaggcgcaagccaccgcgcccagccaagtcatttttactttgattcagagttagccgatgctatttaccttccagtaggttacttacattgtatgtttcagg

SEQ ID NO: 58200 - DNA, 2355 bp, Homo sapiens
agtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcatctttgttattatcgtcagatgtatttcaactgatgtattatactattggtttaaatctctttctctcaagatagaaggtgtagcaaaagtatcccaactactcctcgcttctagtgtccctcggcatctgttctggaggggtaatttgggatgtggtgttagttgtggctgagagccagtgctaggtcccttgccccactaggccattctctaggctcattctaggtgaaagagctcacagcagactgtggggtgggggagcaccaggaagctgttggtgacctggacaactggtgtccctggttttcagtgactcgctcctcttcccttcagttctctgatgtttggtgttattattttatgttgttattttgcctctgatttgtttcctagtcactcaaagcattttacagaagccttaccactttactaaataaccctgtaaggtactgatttaaaaactgagtcatatgcatccctcctcctttcctctcccatgcccaaggaagataaaacagcttctctgccacaattgacccagagtggtaaagatagagaatcagcatgaaaactgcagttccccagctttgtggtactccacggaccagcctccttgctgcattttcatagaatctcttccttataaaagtaatcactctcggataaaccttactacagtttaaaaatgcttccctcttctctttacagctacctgccacttcaatgtgccacatttttccccccactttcacgttaagcttaatgctattccctagatctgagtgaacttcagttagaagaagaaaactaaaaatccagaaactggtgataatcaagttttccctttttatgtttcttaattttattctcttcaacagcttttctttttctctgctaagatttaaacagtgagggctgataataaaactaattgttaagccagtgtcctacttacaagggtggagacgggacagaagctaactcactgctactgggttttgtttgttgtttcctgtcccttgctctatttctgtcctcttccagaacaaaagtatgctcaagttctatcctaaatgtgtgctcttggctgggtattagtggctcatgcctgtaatcccagcactttgggaggctgaggtgggtggattccttgagcccaggagttcaagaccagcctgggcaacatggtgaaaccctgcctctacaaaaaatacaaaaattagccaggcctagtggcacatgcctgtaatcccagctacttgggaggctgaggtgggaggatcacttgagctgag

SEQ ID NO: 58201 - DNA, 1043 bp, Homo sapiens
cctttaaggaccggccccggacgcagacgaggctgtgacgcggccgccggcccggggctgggtacattgtcgcgcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaagtaggtctggggcccggggaggggaggcggggccggtcccgggccctggagctccacggcgtcgggtgcccgtcccggcctgggtcgcggcgcggggcggaggggtggccgcggcggggcggggcggggcggccgggccggcggtgccgagtgcggcgcgggcggcgggtcccagcgccctcgcctccctgaccgcttccggccgctcccgggcgggagccctgggacccgctcctggggactcaggggaccctgccattttggggtttgagcgggatccagccgagtcagaacggttggcttcgggacttctgctaatttcactccatctcaaggaagtgattttggggttggtggttccccgtcctctcctccctcctttttctctctctgcgggcacaaaag

SEQ ID NO: 58202 - DNA, 1023 bp, Homo sapiens
cttacatggtgtcagcatccgagccacatcttgagacctggttccctgggacctgctcttggtctgggcccctttggtttttggttgctagaagactgtagacctggtggagcaaaactgagctccactaacgcatcagctaggatctttccacatgggttaccttgtaaatgggggcattggtgaagagaaggggccatgtcactggacagtgtaataacgtatggcagttatagaacccaaatcagattgctgtgtaccttttctagtttttaggaaaatactggtattttgtattttaagatatatatatatatatatatatacacacatacacagatatagatatgtagagatgagcttgttaccatgggttatgtgctagataagaaagcaaaaataagtgcatacataaatagaaagcttccagtgtttgtatgctgctaacaagttacatgaccttgaataggtcagctaaactttccaggcctcattgcacagagggtcggctcgagcagctcctgagcaccggcagggtgaggcagtagaaggcggtgctgcaggccagaggtggagggcaggcaggatagcttgctgacttgctccgggtctgaccatcagcagtatctgggtcagcacagatgccctttcgtaagcttagtgcctggctccagggcagcctgtgtccagttaatgaataatcatcactgaccagctgctccttctcttgtgtgaagacttagaaagtgttctatgctggtgactcggcagagaggatagactacgtaatttagcagggtgtgcatcttctctttccttaaaatcagaagaatcatagtgtagtggtggtgcaaagtagagatgaggaactctattccctgtttgagattcctttctcaagttatggggcatttgagggccactgtgatttctggtgcaggctgttccctgtgcacagggatctggttgaggagctaagcgaaggctgaagtccagccactgtctccttgcttggctttgtct

SEQ ID NO: 58203 - DNA, 1087 bp, Homo sapiens
tggtcctttgtgactccattataattgggtacttagatgacctagcaattttaagtttatccaatatttatgggatacttattttgtgcaaattgctacgatgagatgaataagttgtaggccctgcctttggaaacatacagtttagaggaacgaacacccgtgtgtataaaaatgaatgaaagaggacttcctctcaaaatccagatcttaccatttcttgcatttttgtcatttgacccttgtaggccagatggtgtggttcctcgttttgtatctgaaggaagagtttcagggagtgggtgggggtaagtgtctgggcaccagggtggccaataaaggatgcagagacacatgatgggctcttcaaggtgggaggaagtagagggtgggatcactgcctggcatgggcagaggatacttcatggacatatacctgtgacacagccaggggagggtgcagatgaaaatacgtccagtgggatggtttctaaggagaagtgtgagggactccactggggctccgtattttgtctggctgaggagggagagatgctgcctctccaggaatctggtaataggcaatgcttgagattggtgtgaaccaacgcatcacatagagccaggagaagtcacgaaggaggcaagaaaaagaaatggctgggctaaagctgtggcagagccctttttatcctcctttgggccctcatatggcttctcttttggtctgaagaatctcatccttcttgagtttagccttctaggtgaaggagtgggcagactgcatgcagggagacagggaggccgtgtttgtgtccttcagctcaggagctgagagaacagaggtcagggcttgggatggagctgaccgttagtgcagatgggaaagtgaagcaatgggtcgggtctgtttgttcctgagcatgtcctgtgacaaaggaagttgcaacatgtctgtctgtctttctctctctttttcttttctcctttcttttcgtttctttctctctctctctcttctttttttctctttctttcttcttcttactttttttttttttttttttaaataaagaaagaagcaggt

SEQ ID NO: 58204 - DNA, 1106 bp, Homo sapiens
cagaaggcatgacctcgacttctctctcacagtgaccttgtgtttgtgttggtggcttgaactcactcttgtgtctgggccatttctctcactgtgtaggaaagagtggttcctgtcttctccctggccatgtagtctgctgtgtgtcaccataacaatcatctatcttccggttctttttccttctctcctcacccagttgtctccagtcttaggcgtgtggaattgtgtactgggtgggggatgtgtgtgtgtgggccgccctcttgatttgtaggatccttctcttcctccacattctctgtcaactctcctccaccccctgtgagatctgtggactcaggtatacgttgctgtgagtctcattctgctcagctggggtgatgaaggtgagattgcttttgtcgcttcaaagtaaaattttagatttgctttggcagccgcacagggtcgtatgcatgggggctgcttaggccagaggcgcagtgttcctgacctccttccgtcttactttctcttgctagtttgtccatctctgtggattttttaaagtagatactagatacctagatactactaagaacatgatctttctcttcttgccacttggattttagcttaaagccaacttggaacatttagggtgtttccttcctaccactgtctgcctggtctcctagggaaagatgccttgtatcttgttctggtgtacagtctgcccatttaattggtaagtgtttattgtgactcttctctactgggctctggccccaggcctgatgcgaatagggcaggcctgtgaacagagcaaagacgagtcacttaggaggggacgagagaggccagcggtaaactaatattaccagctcagggtttatttgtcaaagcctcctttgctgtgaataaaaggttagatctgaattgggtctgagtcctggctttattacctactagccatgtggccttgggcaaattattaatacttccttgggccttggttgccgcacctgtacgatggagtcagcaatggatcctgttctgtagggctgctaggaagcttaaatatagcaatatttgctatatataaagtgcacctggtacataat

SEQ ID NO: 58205 - DNA, 1840 bp, Homo sapiens
tgatctcctgacctcgtgatctgcctgcctcggcctcccaaagtgctgggattacaggcacgagccaccgtgcccggcagcagatttcttacaaggctcttggccagttgagttgtaggcttgttcccaagccagtcactagcaaagggactggaattaatgagactggcttagacaggtcaagattgaacccctgaggctggtgagaagccagcctcctttaatacccctagccaattggtccagggagaagaaggggcatcagtgaggttcgacgagttaagtaacttgctcaagcttggaaatctagtaataactggattcatactggcatccggctgacttccaaggccatctgttgccaggttgaagtcaactacagaggtagagagaatattgctctggatttgttgtgctgggtctgagtaattgctgaggggccttttcctatggactctggagtctctcttctctctagccccctttccaatactgtattggtttttctcagtctgcctttctccccgaagccccttcaccccctgcttcccagtacctgagtgctgcctgccttccacagtagactttatggcctaagctggagacaggtctaagctggaccgaatggcctgagggctgatctcagtgtagctgtcaaggccccaagagagtcatcatgagatttcatatagagcagataaggaactgcagaggcctcaggaaatgtgccaagggggctggtggggggggccagcaggagtggggggtttgtggtatgtcggtggcgatgtcagggcatgtgggccaggggcttagagcaggcccatgtgacagcgcagttactcagaaagctgtttggcctgcagatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatggtaagcagccactgttctagtcccggcccagcctgttcccactcctcactcaggcaccttaccctctgaggacagcccagggatgggcctgaagcctggaatgtaaacacttgattttttggggggcagtggagagtggcggcgggctgttgtgttctctggatctcactgtggcttcatttcagtttggacggtggagaactctttagccgaatccaggatcgaggagaccaggcattcacagaaagaggtagaaagggtctgttgtgggagcacgtgcaggcaggcagggcagtgggggtctgaagggggcctttgcagtgcctgctcttggggaagggtgctgaggctgctgccccctccagcatgctgcaaggggtgcctcagctgaccagggaagctcctggtggctttgtttctggggtgggtggtggctgtggggagcctcaggctgcacagaggtgggacccggtgcactgggttttcaagcctaatgatgtgtctttgtgactttctttcccactcactcttccctcccctctacagaagcatccgaaatcatgaagagcatcggtgaggccatccagtatctgcattcaatcaacattgcccatcgggatgtcaaggtgccagctgttcataaccctgagcccgagtgctgtggggggcaacaaaggggctgtggccaccccagagatggttgccaggccaccctgcgtccttgctgcctggttcctgagcatgccattctctgccttgtagggccttgccctctctgcccatgggcaaacccctaaacccagtagtgaagcattctctggccccactcagccc

SEQ ID NO: 58206 - DNA, 1003 bp, Homo sapiens
tgggctggaaagtgtgcgccttagatacttgctatgctggattcccgggccccgggcttgactttgtatattgtgcctgtgtcaataagccctgatttctctgtgacctttacaaggagaagagcctgtttctcatcctgttcctggtacagggccactaagtgacagctgttctgtctcccacttccttcctcctgttgatgcaggctgtgtgggtatccccccttctactccaaccacggccttgccatctctccgggcatgaagactcgcatccgaatgggccagtatgaatttcccaacccagaatggtcagaagtatcagaggaaggtaagaacccaggctttcaggacaaggggaagagcccgtgtgtgtgtgtgtgtgtgtatgtgtgtacacgcagacacatgtatgggcctccatctcatgtgcgtggtgtaactgtgggttagcacctatgcccacgcctgcggggtgcgtcctgcttcattttgcctgtgtggagggctggaggcagggccaaggctgtggggctgtgcagggcctctcaagtggtacagccgtaatggtccttggggccagttgctccggcagcctgcctccatgcaccccctctttgaacctggtttccccatgaaaactggggaaaggagcaggccagggagagtgacccctgagctgtcactgccccctgtcccaccccacagtgaagatgctcattcggaatctgctgaaaacagagcccacccagagaatgaccatcaccgagtttatgaaccacccttggatcatggtaagctcggcaggctggggagccttgggtctcacgggactattccacaggacagagtcttagccaggaccctaccccaggctttcactcggaccccttttctctcttctcagcaatcaacaaaggtccctcaaaccccactgcacaccagccgggtcctgaaggaggacaaggagcggtgggaggatgtcaaggtgaggggcaccact

SEQ ID NO: 58207 - DNA, 1032 bp, Homo sapiens
ttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttgagagtttttctttctctttcttcctggggctcaggccttaccccccaccgcctctatgtgcagaggggttttgttgggtggtgagggtgtgggttgggggtcctgggagaggagcggagggcctcctgggcgagcaggagccagcacctcattggtgaggacctgggcaggatgtgtgtagggcatccttaaagcaggacagggaggctgcaagggctcaagcccatcttcttttgccaaatgcagaatcaggagccaagctctttttggcatatgattctttgacctacatagccaccaccaggtgctggcacctttagcctgcgaaagccagctggtatagggtccagggaagagggggtgctggtgaatttggttgaaatcctggtaaagataccaggggagcaggttagtgtagtaccggcactctccaggaggcggtgataggggtcaggcagaaaccaaagg

SEQ ID NO: 58208 - DNA, 1066 bp, Homo sapiens
gcctcatgcccaacgttggcccttgtgttttgcttccttccctgactcagcccatttcaggaggatgcttttgtggtcagcaaggattcaggctggggttggctttcagggaaaatggctggggcgaagggccaggaggggtctggcatggttagtggggtcttgccacagcttttcacccccatgcccatgtccctgaccttccatgctggcatggccctgcgagtccctgtctctagggagagcttaacacctctgctaaatgcctgggtgggatggcaatggaaacttttgtccctaaaggcagatgctggcttgcatgggttcaggagcaggtgtgcttcttgaacacccttaagtagtgtgagatgtaaagaggagcatagagacactcctgggcccctaccaagtaccgatgctgggctcttcccctccatctcttcattatcagaaccctctgaggtagtcagtctcgtttccagcttacctgtaagaaactccaactcagaggagtaaagggactcgcccagcatcacacagctagtcagggattctgacctggatctcctgtttccaagtttagagcttctttaagaaagcccatggacatcgtcttggtaagggagtgcagagggggcggggaggagaggagatatgaggctggattccactccactgaggaaggtctagttttctttgctatagaatgagggtgatagtcctaggcctgtggctgttttaaggattcagtgagatggtggatttatttatttatctgagacagagtcttactccatcacccatgctggagtgcagttgtgtgatcttggctcactgcaacctccgcctcccaggttcaaggaattcccctgcctcggcctcctgagtagctggaattacaggcacataccaccatgcccagctaatttttgtatttttagaagagatgaggttttaccatgttggccaggctggtctcgaactcctgatctccagtgatccggccacctcagcctcccaaaaagtgctgggcttacaggcatgagccactgtgcccagcctagat

SEQ ID NO: 58209 - DNA, 1057 bp, Homo sapiens
atcctagggtagtagtgtttccaggaccctgatatgcaaagtatctgtacaagttatgcaaatgagcatcctgtctgggtggctctggtcctagccccgggcagttactagctctgactactgctgtccgagtgtgtgaaacgtgatcttgctccttcctctgtccaggcagctgtgggtctcttgttcctcaaacagctactgcctcttggggtaataaggcctcaagtttcagaatgagctgagttctcctagcccttaccttctgatctggagacatgtggttctgaattcaccagtcaaaggtttacttttgaaagaaaccacgatctcatctaagtctaagacagagaccttggttagctggagtctgtggtgcagagagacctggtatttgtagtaagacctagaggggcctttggttttctggcactcagctgtctccttttctggtcacaaacctattctaaggaaatggtcctcatagtgagactctagccctacccacccacaggagggtcgagggcaggaggggaaggatgacagccaggcattctttgagccagtgtgcaaggaagagaaagggtagacgagaaattcagtctgatcggcttatttcaggctctgaaaatgacagctgactcagggtaggtgcttagtatctgttggatggatgaaagcatctaaaggaaaattaacacaagtaattttagtaactcaaacaagacattatatgtacatatatagacatacagagtgaggcgtgaacctttctctttataacgtctccacctcagtgatgccaattccctctccagaaaaaacttcattgaacagctttattttttttgaaatttttatccaaaaagtttctgaaaatttatctagatacaaatatacttataagcacaactgagaagtttctttggcagttataacaagtacaaatggaatcattaggcatattgttctgcaacctgcttttaaaaaattgtgataaaatacacttaactgaaaatttaccatcttaaacatttttaactgtaaacttcactag

SEQ ID NO: 58210 - DNA, 1026 bp, Homo sapiens
ttccctgccctaatcagaggcattgacctggaggccctgtgtaggagtccccatctttcggaattagtgatgtggttagagtagcaacgtgactctctgtggacggaagaaggtaggtcggatgtgagagtctccctccatgaacatgtgtgcgtcatctgagtcaaagcttgtatctttactctcaaaaacaagtcatttttgttcctgtcagcatcttggccagcccacaacaaagagtacaagctggatgcttgtactgtgctgcgataaagaggcccagacacaggcctcaggtgatcctacagagcatggctggagagaacaggaaaggattattcccctgggggctgatggggctgccttcagcaacacaaaaacatgcttacagaaaactgctggaggacataggagtgatctgcttgcaatgaggtttttcaaccaccaggaatggggtgacctagtccagagccctctaataaagtgactttcaaactgactgcacttcaaaataatcctaagctttaacaaatagagatgcccaggcttcatcccagatgtacaaaattcaactctcagggacagggtctgggactctgtgcaaagccccctgggaattctggaacaactaatctggcattgctctaggaaatagcacttggaaagcactccagcaaggtgggagggaaaattattccagcttgaacactacaatatcaagtaatcctttctctcttcgccctgtctcttcccttccctttcttgctctctgtaacaggcaggaggctcagaagagcttcttctctcacgcttcttgcagggcagtacagggaaagatgtagctgtgtaaattccaggagggcttcaggtatatttaaatatgggttgcttgccacattcacctgcctatcaagtttgcagatgacaactgcagaatgtggcacccaggtcttgaaagtcatgaagcagaattggataacatctgtccgagtcatgacaaagagggttcctgtgctgggagtgggg

SEQ ID NO: 58211 - DNA, 1058 bp, Homo sapiens
tgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgttgtttgagtatattttgggatcagggcagatatggccactgaacggctattttactcaatatacatattatcaaaagcttaccgaatctttaactaaggtaccaaaatctgccaaatatcaccctttaggcggactcaatgaatgagacaggagaaactaaggtatttctccttaacgaaaggttgaaattcccattcattgactaaatttttttctaaatccaatcctacaagttgtaattcaatatttgttgctgacaagttgtcagtgtggaaaggctta

SEQ ID NO: 58212 - DNA, 1847 bp, Homo sapiens
atcttccagataaaagttttctacctcttttcttaattattctgatcagggatgctaaattataatttgttatgtattatctcacataatgtgaagaggcttaatgtgaagttttgttattttggtctcttttttattaagtatctcacttagaaattcagtggtatactttaaagcacttggatctttttcagcatatctgcctagcaaatgttttaaaattgacatttatttttagcactttcacttggtgaaggtggccatataaaattaaggaacatttgaacaatataagagaaaagaacttttaaggaacaattcacaaagtttgtttgaaattgtcagatgacatttcttgagtaccttttgtgtgcatagttattttagacaatataagctgttatggtcagcataacttaaaagtgtttagttttctattttactgagccttaaaaatagcactgatgagcttatgatacttaatgtttggcaatcataatgtgttcaaattaatgggattgaaaatctctccacacctgactctcatctgatctggatggttttggttttgtatcttttttacttctcccagaaaatactaaatttaaaactgtaaattaagaatataccactagataacaattatcaaattgagctttatgcatcattactcagaaagcttgccttcctttctttgctacttcaggacacagagttgacatttgcttactacagctttagatctagaagtttattcgtgcaacaaatatttattgagtaatttatactgtgccaggcatgttttgatatgtttctgtcatatgttttgatatgttccaacataagtttctgtcactttatattcagtatatattttctacagtgggtaaatttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatggacttacaactttcaggaggattaaatgtcttaagttttgtactagagcagaatgaaatctttcctattcattgagtttttgcctgccatagaggaatttttttaaaaattaaaatgacagtttatattagtggcaaagtgaataaagacctcactttcccaccccacccttcttcctttctcttacttttctttggattaaaggtcaggtgtagtactatgaagattcactcctgaataaagtgatttcagaagctaaaatttaacatacctggaaattttgtgatgtgttagccaagtgaagacattagtgtgttccatcttttgctaatggttcatggttgatttcttcattgtttcccatgaaattagcatagtcaagtggtacccttgacgcttgactgctggtcagtttgaccctgtttttaacaactaatgtagtcatgccgcttgattattccatgaagtcccagcaaaataataatgagga

SEQ ID NO: 58213 - DNA, 2279 bp, Homo sapiens
tttcaccatgttggccaggatggtctctatctcttgacctcttgatccgcccgcctcagcctccccaagtgttggaattccaggagtgagccaccgtgcccggcctcactgtttgcaaaactgagtcctaccgttagattggagttaatttcctggtaatgtacttcgtctatacataacccaccccaccccaactgctgccactactctgcccagattcttaaaactagaatctgaggtcatgaaaccttgagcaggacacttaattcgatgaatctcaaattttcaatctgtaaaatgagaagaaataatggtggcaaaatctgcctaattacaagattattgttaggactgaagaagataacgtctgtaaatgtagactcgtaagtcagaagataaatgtaaggttctagtgcaactctttttataggtgaggaaacagagggctagagaagtagctgctaactgggagaaacaggactgaacctgcctcttggcccagggtgtttttacttataccacacggatccaatgcactgactttttttaagttatgtcttctttcttccccttcccttttttacattctacttctctgtttcagacatctgaagagctgccatgtctggggcatcttcctcagaacagaacaacaacagctatgaaaccaaaaccccaaatcttcgaatgtcagagaagaaatgttgtgagttctggcagagaggagggactgctctctctcagcattttatcttgggaatatagttataatcctggactctgctgcttggtgggagtgataaataattatttgacatggaaatttaatgcaaagtctccagggtagaatgtcctgtctaaaacaagtagacttagtgaaatgtctgttcttggggcttgactactggtgtagtccagcagtttcttactgctttcttaaactgaatctctgtctcctgggatgtttgcacactggcttgctgatggaagttagaactaacattattgtacacacaatgagtaaggcacagttgcaggtgcaggaattacttggagctggtaatgttaccagctttatctgttgggctaagttttgggagagtgctgctcattgtagaaattgcagatgggagccagtgctgcttggtttccttcctacaggcctgaggggaatgagccctgacacttggcttctcacagtgtcttgggcatcttactttctcacaggtttagcctttgtactttgtaaactattttccctataggttcatttttttgaggacagctttcacatgagcattttcatttctatgcctgtcttttagatagaaacagcaggagggtttgcgaggagatgaagcatcatttcctgtccccaagcatctgtatttctaagcatcataggctgcatagcttcccaaaagatctgggactctgttccccacatattttggggaacttcaaggaatgctaactcttgcctctgcttctggatggcaccattcctgcagaatcctgtcagtcagttcttctcacttcagtggttatatatatatatatatatatagccagttagtcaaggaatatatatatctcagcaggtggaaacagccgaccagcatgagaccaggaattatctcatgttcaaagcttttcccagagcctcgaccttgatgtcatgcccttgtcagtttcatgattgacaatgataatctctcttcacctagcacccatggagcctgctggacagaagcagctggctggatgtgatactggggttggcagagttagggtctacaattagggtctcttttctctgccagggcaagaagccaggtgctaagggcagaataccccatgagagataactagtatagcatgatgtttgagtatagcctctggagtcagactgcctgagtttgaatcccgggtttatgacttcttagctcttgaacaagttgcttgttctctccatgcctcagtttactccttttaaaagtgggaatactaacagtgtctcccccaagagtgatgtgaggattaaatgactaaatgtaggaaggcgcttagaagagtgttgggcatatatctaatgtgtgttatttttcacaggtgactcaatctgcctgttgtatttattcctgaaatgtttatattgaatcatactcaaatgctgtattggaagctcactatttaaaagagggctgtgaataattattttttcagtaaaaaatgttttcttctcttatttgacaatattgtaacccagatttggggat

SEQ ID NO: 58214 - DNA, 2861 bp, Homo sapiens
ttttatatatatctttatatatatctttatatatctttatatatatctttatatatatctatatatctttatatatatctttatatatatctttatatatatttatatatatctttatatatatatatatatatatatatatatatatatattttaagagacaagggtctctctatgttgcccaggcttatcttgaactcctggcctcaagtgatcctcccacctcattctcccaaattgatgggattacaggcatgagctgtcatgtctggctgcagcatggttattttctttcttagccttgctacttttttcctctttccaccttgggtactgcagtgaagacctcagacatgtgggaaagacgtatcttggtttgggcattttctggaagcctgcataaccttttaactctatttcaggaggcctgcctgatatctccttatttgtcttcccagacttgctgaacctttgctccacaggtttatgaagataaaatgagattatgactatgaagttcgtagctcagtgtataaaccttactagaccccagcggggctgggcgcctcacgcctgtaatcccagcactttgggaggctgaggtgggtggatcatgaggtcaagaaattgagaccatcctggccaacatggtgaaaccccatctctactgaaaatacaaaaattagctgggcatggtggagggcgcctgtagtcccaggtattcggaaggctgaggcgggagaatcacttgaacctgggaggcggaggttgcaatgagctgagatcacgccactgtactccagcctggtgacagagtgagactccgtctcaaaaaaacaaacaccaaaaaaccttactaggactctagtcatttcgttttattttgtttcatttccttctagcatgggcctcctacatgaccaactccccgactctgatcgttatgattggtttgccagcccggggtaaaacctacgtgtccaagaaactaacacgctacctcaactggattggagtccccaccaaaggtaagtgtggctcattccctaggaaagacaattattagttcctgggcctcacaggtctctgggagacttattcttcctggcatcaatgctatagggtgcttttggcagaaatagcagttgctttctggtttactggagttattctctattcccagacttgtctcctcctggcgtgggtggattggcctagttttgagggaatgcctttgataggactgttaagatttagatgagcatagggctgtaccttttcagaagccttacatggacatcatcttatataaccctagcagtgtctctgtgaaatagacagagtggctgaggaaattgaaacctcagacagcttaagacttgtccaaggtctagaaagtcagggcttgaacccaactcttttgactcttaatctgatattgttcccaacctaccatgctgccgcttttttcatccccttggtcactccgacattaggccaagaaacaagtcccatttggtggggccatcatattattttgctgctgaaggatttgggtgtcttctacagtgtttaatcttggggtgtatcggcgtgaagcagtcaagtcctataagtcctacgacttctttcggcatgacaatgaggaggccatgaagatccgcaagtgagtcttgtttaaggcctgatctccaggtcagctctttcttggccgtcatgagacttggtgtgacagggcttggtttcatctcagtaaatatcttaaggggaagttaaatggaagttatctgatgggcaagtgaccttgggcttgggtggtcagaagaacagggctcagggtgattgatacctgtgtgcttgtaggagaagtctaaagagggctaagatctgtgcattggggcaggggcaggaaggggttataggatggtgtgaaaaccctcagtgagaaagttgaaagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaggagggacatgattttgaactttgctgaacagaattccttcaaggtaggatctgactccatgttggaggaaaagggatgagtagaggtggggagtcaggctacaggcatggatctctcactctagtgggtgaggacaggatgggatatctgaatctcttctctcagagcattcccccagtccttgagtgttttcattcaggtcctttctcagactgttagcctgtatgtttgaggcccaggggctgtggtaagagctatgaggaggacttgagggccactttcatgaagaaaatcctgggagatgtggtggctgggtggggtagatgagcatgtgctcttaattaacagcctggcatttttgacttgcttatcactgccttctctccatggccaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtg

SEQ ID NO: 58215 - DNA, 1112 bp, Homo sapiens
tctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcaggtgagtaattattcagcacactggattttctaggcttagagttagaagggcatgactgaggtcatatattttatctccttacttaaatcccatttggacgtaggctgtggtttcatagtcaggcaagtgctcaaggtgtgttcttgctcactgcgtctagctctgtgttaaagagtagataactttgacccatttctgctgtgatcattcaaccatcagatattcattgggcacaacttgtgtacttagcaatgtacagggtgctccagttaaagttcatttccttttgggtttatattaactatgtagcaccttatggattttgaccatggttatgcacgttgtcccttacagaccaagttagcaggctttgtgtatgtgtgtgttgagtgtgtgtgtgtgtgtgtgtgtctgtgtgttttctttttacccttaattttcatttttaaaccccagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctgtgagtaggaagctctgaaggcccagaaaagccaacaagagttcaggcaggaactctcagaagtcactatttagacagttttatctaggaaactacaaccaacaagtaaaaactctgaggaagctgactctatggccagcccgggggatcagggaggacaattgtacccctaatcaggggtttcctgcctgattcagtacctgtgccaatcatgggacccaaaccaatttttgagccagcctttctggcacctggggaaagtagggctaacaaggactcattttgttcctttgtatatttgcct

SEQ ID NO: 58216 - DNA, 1044 bp, Homo sapiens
cgatatcctggtggggaggtaagacgcccctgtcatgtaaagtgactgcctagacccttgctgagtgtttaactttaatttgggggaaggattgaatgtgatttggagggtctaggcatcatttatcttccttcccttgggtcattttggtttcattcagcttagacaatcgaatgcctcattaattgttaagattcccagggataagggtgacaaggcatcctctgttcagtatgttttagaatcaacacaatcatttttacttctttttttccttgtactctctcaatcccacccccacataagtaagtggagtcaccaagtaaatatatgggataggaattatttccctgtcatcttgagtgttttaggctatttccttgtctaagtggcttccatactctagggatgtgtgaggcaaaagtaaataaaactgaatggcagaggtacaggaaacccctaggagtctcttgtctcactgcctgtattaatctgtgggaagaaaaaacacacacacacaggttgaactcacacttcctcttcttaacctgtagttttcttggtctaaatattgcttttgaaagatctgagttttctcaagagataccagggctgggggcagttagcaggtgatgtaaactcactgagcctccaggaggaaagccagctgaggaagaagaagtggcccttagtctccaaggtccagccactgacttggctgccagcttgcacctgggctcctgccagcctgccccatttccctccacagtcataccaggacctggtgcagcggctggagcctgtcatcatggagctggaacgtcagggcaatgtcctcgtcatctcccaccaggctgtcatgcgctgcctcctggcctacttcttggataagggcgcaggtgcctttgagggaggggctgggagacacatccagtgggagagggctggacttgcagtggcaccaggattcctgggaaacagacctccctgtctccactcaaattagagtactttctccagacagcagtgtggggctcccagcag

SEQ ID NO: 58217 - DNA, 1047 bp, Homo sapiens
attgagtcttttaggacagattctcagatgggatgatctggaggaggaggaaaaagatacactcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatgaccatttttttcccaaatgtggaaaagcttgatgatgaatttaatctctctcattggagtattcttttgttcataaagagaaactatctcatcttgatgtcca

SEQ ID NO: 58218 - DNA, 1283 bp, Homo sapiens
catctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcacttttacaaggttgcattgtccacatttgcttggatggtggcatctgtagcccaaatgggcattcagtcttttcttctgctgtgaggtaagagtaattcagacctaatgaatgagaagagggagcactttgatccacagactttggattaacactgtacccactcttagcaaaaggggacttctctaacaagctagcattgtgttaacctgtcattaacccagcattagagacaggtcactgggatgttcattctggctctcagcctgctgttatttccccactctcacctgtgctagttcgctttctccagaagaggagctgaggtggtcttatcctcagataggacatgagaaattggaatttggcaagcaagggcttcagcatcctttagtttctaaagcaagatcccttcagagaagtctagcaggaagaagccaggagaatgtagaatggaaaagagctcttactccaaattttagagaagtttcagctctacttctcatcttttctctcctggtcttacttgaatgcatgttggtaatctgtatacattactatgactgtgtctatcacaagtcctacaaaataaaaatggacttaaaagtactctctgctgaggctgtaagttttgttttgtgagaaataggtaaagacattagcatttaatctactggaataagctggttgc

SEQ ID NO: 58219 - DNA, 2125 bp, Homo sapiens
ctaaaaacttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttcttttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacgtgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagccatgcatttggattttacacttaatctagtaagtaaaaatgagaagaaaatttggcatttaaaaattgattttaagggttggcaaaagtattttttccagtaagcctttcactggatatctgtgaccaatgtttacctacgcaatgtttttgtatctgaattgcttatgtacgttttttattatattgacctaacaagaagatcaacttatgctggtatggtgatggttttgctatggcaaaatcaaagggctgatcatacatggtgccctttgggaagggggatggtgtggggctgagcacctctgggttgaatgggaatgggtcagattgggaagcctaggaagagagttctactgtagatttcctaggcactgctctgttgaaataggaacataagtctttagcaacattctgatttaatcgggtgacactgataacaaagtatgccactcagatccatttaaagtgtgcataactgtatttgaaatgtgtttttgtgtgcgtgtgtgtagaatgggtaaataaaattgttgagtaacttgaacctatcagaaggcttctgggttttttgtttagtattttcagttgtgtttcccatcccttccccacccctaaaactttgcctcatgctgcacaaggattcagactcagacaagccaacagaagttcgcactgtaattgaagaccatggtgtagccgtggctctcttctgccaccttctggggaagataggaagaacattatggaaagcacatgaacttcaatagttgtgtgttcctgttggcacttatgcaagaattaagaaacaattacatttcactgcactgtgcagtaattccca

SEQ ID NO: 58220 - DNA, 1018 bp, Homo sapiens
tagagtctaatatacttatgctagcagttaccatttgccacattggaagcaagagacaaatcaccaggtgaatggagggtcttctgagaaattcagtccctaaaacatcttctctgccttgatagaagaacagtgtcagtggcaaccttttcatttagagaagtttttcttgttccaggcccttcaggacaggatctgactgcaagactccccaaaatgggtacccatcttctaagttcccttttgtagctactgtacttttgacttgatgcatgtgcctctcatgcatcaagatggggctgatgtggttctcctgggtggttgggaatgtggactagacagaaaagtagagtgccatttatatcacgtgagtaagtcaagaaagctccttgagaatcagcccgatcagggagtgttttggcttcagaacaggtggaaggagacacgcccctctgtgggctctgtcaccatgatacagtccttgagagagctgtggctgtgacttggagggcagtagtctcctgatacctgcctcttggccactggtcactattgtggtcactgatctctcatataaaagtgagggtggcggggtcatggaccagcgcctcagtgcattagtcattcgcttttccttacagacaaatcagataactcttccccagtgattgtcaaatgtatgaatgtatctctgtaaatgtggttttgacatgtcactgttactgaaggagagtatggaatccccacaggatattatatcttgcaaggaaagtctattttttaaagaatagtatgtttttagctttacttttctttcttttccttttcactcaaatgctcacttgctgggcaaaagggtgagtagcaagaaaagtaatgatatgtagcttttctcaaatggttcttttatactgtggatgatacaggactctgttacctaagatgtgataagctgggctgcaggcggttcagcatccagcaactaggagctgcttttctacgtacaaagctgccttca

SEQ ID NO: 58221 - DNA, 1066 bp, Homo sapiens
ggaaggctgaggcaggagaatcccttgaacctgggaggcagaggttgcagtgagctgagattatgtcaccgcgctccagcctgggcaacagagcaaaactccatctcaaaaaaaaaaaaaaaaaagtctaaggataagaaatatcaatggttcagatgatgaatttacatatatgtgcttgataattttttcaaaatttttacctgagctttattgaggtataatcgacaaatattatcttaggtgtacaacatgatgttttgatatatgtgcacattgtgaaatgattaacacagtcaagctaattaacatatctaccacctcacatagttaccttctttgtgtgtatgcctgataatttaattttaaaaaatcaatttgtattctattctagagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtg

SEQ ID NO: 58222 - DNA, 1051 bp, Homo sapiens
ttccgttggctttgtataagtgtttcccaatttttttttgtggggggtggggggtgcgttaattcttgctctcttctcaccaaagacctttttagacatttttttttgatcatcctccaccacacatatactgtaaatcagtttatgtatcacatatatatctgcactctgtacttaaaaaaggaaaatttttttttaactttcatcaggtatcacccccattgagaatgcttgctttctgttggttttgtttttattgtttttaaagacaaaatcatatagaagaaagagcttaacctctggagtcaaaccagtcggatgttggtttgaatcctgtttttttcacttagtaattattcaacccaagtgattaagtgattaacttaatctctctgagactcagttttctcatttaagagatagagattgtgattcctatgtgaagtatttgaagcttaatgtgattagtgggtatgaaaactccaagcacagtcctaaaagttgaataaatattagcttaaggaagtcactgcatgcaatcactattattttcctaagctggatttctgataatttcatcactccctctggccacaccaaagaataagaacagtcttttattcaggtaatatttacatgttttctctgtggcaagtactgtactgattttttttaatgtattatttcatattcttctcacaacaatcttataatgtagcatttttatcccattttcagctaagataactgtggttttgcaaaatttgtaacttgcctttcacagagctagtaggcaataaatagaggccgatgactagtttctctattaccaggtttttttttttttttttttttttttggatgggggacagggtctcactctgtcacccaggctggtgtgcagtggtgcaatctcggctcacggcaacctctgtttcccaggctcaagtgatcttcccaggtactttaaaagatagaaagatgctcatcctagtgacagaccaagagacaatacaacccaaattggacaattaaggtgccgtgattccct

SEQ ID NO: 58223 - DNA, 1046 bp, Homo sapiens
acacagccttactaccttctagtcacatgtcagaaaggacaactaaactattaccatctgctctttaacggcttcaacacagatgtttagctcctgactgaaatgagcaaaggtatgacaagatcgggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatgg

SEQ ID NO: 58224 - DNA, 1028 bp, Homo sapiens
gagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaa

SEQ ID NO: 58225 - DNA, 1075 bp, Homo sapiens
catatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttt

SEQ ID NO: 58226 - DNA, 1035 bp, Homo sapiens
gcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagag

SEQ ID NO: 58227 - DNA, 1068 bp, Homo sapiens
atctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggagg

SEQ ID NO: 58228 - DNA, 1033 bp, Homo sapiens
ccctacccagtggtttatcagggacttaaaatgggagcatagcagggggctagagaagaaatgggggagacaggagctcctgtgccctaagtggtatcacagcaggggcgcagaggaggtaacctaggcgttacgcccttcaagcctgcaaggtgtactgtcccccacctgccataaatacccctttacttctgcatcaggaacatgccatggcatctgagtggtgggggctggtgacggcagagggagggtcagtgagctttcctgggagccttttgatgccaggttagtttcccttctttctgaatctcagcagtggctgcctgcttccctgacgctgctgagtcccacgggaggggagctgggcaccctgaagcccctcgttaccaattcgggggccgcggagcagagtgtgacgacagccagtgagtcgtcagtcgacggcaatggggaccctggtgacggctgctttgttgttttttttcctctttggaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccaggtaactcagcagggctctgggaacccttgcattttagagtctgaaaagaaaataacagctgtatgtgttattagatgagcttggcaaatagggtcactttttgagttcttcccactagtcccagatgacagacatcttcccagggcccagaaagccctttgggatttttcaccgtggttctctttgtgatagtcttgctggtcattgccttgaatgaagggcgattcgcttcttggggtaggggtgggccaggccgacctcagtgaatgcgggcgcacctgtaccttgggagaagtggccgtggtggggctgtggcgtcttgagagtcctctgccgggcggcgcttcaagat

SEQ ID NO: 58229 - DNA, 1167 bp, Homo sapiens
aagtgtggccaaggaagcagagtgtaggcccaactttttttgccttgtttgaccagccttggcactgccctccggctctccaggggaaaagctgcagttctgctcttgcaacacaaggagcagactggagaatttagatctgcgtcacagagctgagagagagagagagagagagagagagagagagagtgagagagcgagcgagcaagcaagctccgtcgataggtctgctagcaacagccgtgctgcagcagagagagagagagaaatcaagaaacaagtcatagcaacaccgggcaccaggttctgccagctcacttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacgtatgtatttgctgggatcaggggcgctgtctctgtgtatgtgggtgctctgtctttctcaccttctttctcgatttttgctatttatttctctgagggagggttttttcccactttaatttcttttccctagtgtcagctgctcaagcctgaccagggtagaggtgagaggagtgaaccatcccctgcttcccacctgacctcccagcttttaccctatttccttctagtggacagacagactggttctccaagttgtttgggtgtcagcgtccatctgtctgtccgtgcaggtcttatgtggaaggtaagggagtgagaagtgccgaaaggaagacagagggacagttttttcccaggggttgccttattgaaaggtctggccctgggattctgaggctggtggggagccgagtggccagggtggggtgtgggctgggagaagtggggtaaagctggtaggtttgtcactgcgtagttgggaaaagtggggaatggtgacgcagtcactgttgcatctggttaggagctctatggggacaggtagtgaggctc

SEQ ID NO: 58230 - DNA, 1053 bp, Homo sapiens
ggggtagccatacatttcttaaagaagacacagaaagcactaactctaagggagaagactgataagttggatgtcattaaaatgaggagcttctgattatcaaatgacatcaataaaagagagtgaagccaagcagagaggagaagatatactcagtacctatacctggcaagtggattcatatccagaatatataaataactccaacaaatccatcagtaaaagaaacccttccccctggacagaaaaaagttccatactgaacaattgtgagttgtatgcagttttcttctcccagtgcaaggttctaaccagtatgtcctggatcactggcacagcctggtggctggccttgggaactgtctgatctggtggctcttggcattttcttttgtgtatggactgtgggcccttcctttcccatgtgcttcttcacttgctattggtttggccacaagaggctcctgtctcatgaatgcctgtgtctcttcctcttttcctttggcttgttaacttttgatcagttatttcgagaatatttctctctggcttcttccccccgcccttcctttttaatttccctttttgtaccttcttgtttagcctaaaaacttctggttgtaaaaaccatcctaaagtgtctccaagtctttgggggagtaggcttgttctctggggctccagaggcagagtggagacctgaaggctaatatttccctgcagagagatttcatctcagttgtgttccacttgtctgaaccctccaaaggtgtggtgggagttattgaatcaagttggggctagaccatgacttggtcacggtggtgtttgtggagggtactgtgtcttgaatgggcagctggattatgataagcccttccaatcttatcaccaaagccctggatggacgttttgtggatgtccagagaagcgctctcaactgggagacagagccagtatatcagcatgacttttctgcctagctggcaggtcaggatgcacacatattattactacttcagttaaatcacgtatacttggaagtcatttcga

SEQ ID NO: 58231 - DNA, 1044 bp, Homo sapiens
ttcgcttcagctcagtgacatgggtggaagtgtcatggtctcttgggttgggggaaagctcctcagtggctctggggtagttcctccaggagactggcacagtgtggtcttcatggctgaggtctgaccacaccatgatcactgctgttggtctgcaactattaatggcactgctccttaggagccttttccccatgaatgccatcagacttctactctatgagtaccatttctgtccccaccccaacatcgagcacattctcatactttttgtgattatatatacttagatttctgtatttttgtttcttcttgaagttgcttgatgttagaaattcatctcttccttaccaggtgttgaactatcccagtaatttagcttttacttggcttctgcaacctttttttctctaagctccttatctgtcttgggcctaccacttgaacacacttgatcttgtctacttatctcgtcaatatgaagctaggtatggttgtgtctggttagtacttggatggaagatctgagaatgctaggtattctaagtcttttgaggtgttggtaggctttttcttataccaaatgcaaaatctttatgtcaccattgttgtcattctcatcatcatagtgatagctgggattaattgagcacttattctgtgttgggccttgtgctgcattacttctgtatctcacatcctctccaagaaaatcccaatgaagtatagatgaagctgaaactagaaacttagaaaggttaagtaagttgttcaagtttatataattagtcaagaggctgcactagaattcagattcaaatctatctcattttagagttagagtttttaaccactaaatgtaatatttttgtttggtagttaagtactctataaatgttggttgaatggcaagattgctctgacagtccagctgttctccatggtgtcactaatgatgatgatagcacacagcattttttgaatgaatgcttgcagtggtaagctctgtactaaaagatatgcattagttaacccatttaatct

SEQ ID NO: 58232 - DNA, 1071 bp, Homo sapiens
attatttttttggaatagatcaatggccgttctttctgttggacccgcctgctttctaaatattcaccctggcctctgaaggttttgaagttttcagagggagagtgatggggtactcctctcacctccaaagtatgtggcgttggagaaatcttctaagtgtaatcttctgtcttttaaggcagagctgttgttgctgtgctgcttttggagaaagaacattggcctcggaggcctatgtcaaatcctagcctgagaataatggctgtccagtggtcccagggggtttcagagagctgaaccctctaaaagagtgtaattccaacacctaccttcagtaaataaatcaaccacaggactgcctcccacccccaaagattctggtcaacatcccctcccagtgcagaggaagtattcacatcatcaaaggttttgtggaactttacttttggtatggtttcacattatgaaaacgtatcccaaatattaactgttatgttttagacagtccccagctcctctcccacccctgaatgagagtctcggccctggaagttttgtccctgctcctggcaaagctggcactttgctgaaagctcggacctgcacccaggccatgcataatggccctggtctcttttctcctctgtcctaggctgcaggtacggacgtgcccctgcttgggggataaggcagtatggaaatgaaagttcaagtcagaagtgtttggggaatcccctgccccacttgtgtttatgattcctgctgtctagatctgactcagttaagtagagcagaagtttgttgtgaggcaggaaagcgactccatttttaagtcacatggtgctaaacccatgtggtcacacagaggtcagcacagacccataaatcatcagaggcctaggttcttcctaccctagagacatctcctcctgcccacaagagcagcagcagcgtctgagggcaccaacctgtgcctggagggagtctggccaagacccctcaatcccggccatgtctggcctggcacaggctacaggttccgctgttgaggaatggagtaatgttctc

SEQ ID NO: 58233 - DNA, 1319 bp, Homo sapiens
ggaagtggccagtcagttgtatctcagcattgtatgattccaaaaatgaggggtaaacttggtatttcgaatgtttagaagtaggcctcacggaagttgtgctgtgtttccttcctgtgttcatcggcctgtttgcccagtggatggttactggacatggatgtgcaccatgtggtggcttaaagggctgtaagacgcagtccaggcccacgagaagcttcctagcagtgaggctgttttataactgttcccaaatcatgttagctctggaagctatttcaggaacgcctttggttatgaaccgtatcttatatttaattttgattctcttttccctcctgtcctggattcagtagcagcatccacactgtgtgcctggctgtgtcgtaggtgttggaagtacttagaagaattaggaggtacttggtaaaagcttgttaattaactaaagtggggacctagaaccatctccaaagaacttttggtcttctcttgtgcagtcaagactcttcatgtctcaaaaggaccctgagcttctgtctggagcgcatcagaatctgtgaaatgcctggatctaggccataaagtagagggtttgtccccctcttttccttggttgctgtatgttcttaataacagtaagagttttagcccaccgcaggaggcacttgaaggcatgcaaagctccacctctccacctacctcctagggccctgggtggcactcctctgctcctttcctttcttcttctgttaccgtatcaggtaaggccactttctactcttagttgaaatttacagttggtagccatggggaaccattagagtctctggtctttgattccctgggagagggtgggtctgacagtggccttcccacctgtgtgatgaggacagctgatttctgtctcctttgttctcagcctcacatggggtcacagggaaaaggaaaacacataaaagatccccagggctcagatttggggttgcactgtttttagtccagagccagctgtccttggcatccgtcaggcagaggggtgaggtgattgctggtgtttgtgacactacaggttgagtgtccctttgatatttgcttggggaccctttccagaagctgcagttagaagagcacattcttgtttgatacatttagatcaaaggaaggagagagtaggagaaacctcagaggacctgtgtgggtgggcagggaagggattcacatcaagtgagcccatttccagtgtgtttgttggggatttaggggttgtcatgttgacaggcctaatctagtccaatcaggcaatcagcaagtattga

SEQ ID NO: 58234 - DNA, 1050 bp, Homo sapiens
agggcacaaaaggagaccagaatgatgaggcagtggacttgcgggggacgtgggaggcagggtcggcacttcttttatttctttccctttaaagttgatcaagagttggcagttgggaagcttaagtaatctacatctaaacactacatctaatgtaactcctacttaaaattactggacaccaaaaaatccccaggcaagcttattgccctgtatgtatggtagaatattgtaacatggacagtggtagttgtaaagacctggttgcatgtgacagatgcacttgctcaaatatgagtgtggcgatttctcagtcacatgctgaaaaatcaagagcctctagtcaatttaaccagtattcactgggctgcagctgagagccctgcttaacactagatgctgggatagaaagacaaaaaggtgagattaagaagtaagagttaagcctgggctgtacctagacttacctgagttttagagaccttcctttccacagatattgggctgaaaactgagaaagtggatgcctcgtctgctcccatcttactctctgcagcttcctacacaactgctgggctcccaatgctctgctctggggccaggcaaaagtctgtactctcatgcatacgcacttctgaaaaagcggcttggtaacttcttaggtacacccacaaggttggccccagatctcaaggaaatcctcagaaatggttttgaaagataatatccagctaactcccccaaattcaggatccctagaagctatttatcttctagggattgcctagagtattcctacaggatgtaaatgaaggatgcaagcacgtggagcatgagtattctatacagggaaccagtcggatgccacccaccagtgccagaacgaaggcagagagcatggggttggagaggccagagaccctacgtgcttctgaataatggggtgtccctgccagagctaggaagcgtgaggtgtcaccctaccagcctacagctctgagtgctaaaagggaatccgggaccctgaaggaagctttgagtctctgggct

SEQ ID NO: 58235 - DNA, 1760 bp, Homo sapiens
taggcttgtctgcagctgttcacccatgcctggtgtttcctgctgcggaggagctagggagaaagatcaggaaaacctcagccaggtttaggagcaaaggtcaccttccctgtcttctcaccagggtatgattccctagaatgcagcagcatatccagccccttccctcttctcttggttcctggctttattaactgtctcttcgctttaaaaaaattttatcttttagcagcaaatttccttcttccccacataccaaagccatagcaggaagaggaaggccatcccgactgtggttttgtccttatattctctgtttctcaggttcgttgcctagggagggtggagtcccggcgatctgggggcagggtgggggtaggattcgtggtgcatcagaatgaacttcctgtcacctcagtgattccacttagatctgtgattctctggctccatctttccccccgaagaagaagagcctttcttgggtcatagttgcctctccttccaccagctgcactgaccgacctgcagagtgttgacccacttgtcgtacctcaaatagaggtttaaattaggacctttaatctgtaagaggcttacagcttgttgggtggccagctgctctggactcccttgtgggcagagctgggtttttcctggctcttttggggtttagggaatcatgggggtcagtggctttctggcaggagccacaggctctgggactaggtgggtgggatctcttatgatggagttgggtggtggtgtgtccttgtaatgatggaatggggagctgggccagcaacttgggtgctgggcctgcttctcttggacactgagcctggattcttgctgatgtgcagttagctttgctggctcaacatgtgttttcatttcacagatattcattaatccagagttgtgtgcccagcatggtgctaggtgtcatagggaacacacagaagcatgagaatcaggccctcctcccaagttgcttatttgtagcctccttttgaggctacaaggctagtccatatcaaagcattcattcatcctgtagaccgataggtatggaggggaagtattattggagagacctcagggttttctcacctgagaagggagagagccctggggtggtcagagctgggccctgagtggtgggatttagaaagaagggaagaggggagggcttggaagataggagaaacagcatgaacagcagcagggggaatgggtgagtgtcctcctgaaaggactgtggagatggccgtggagcctcttcttgcccacttcctgagatggtcatggcttagtgctagagacttttattccttgggcaatgtagacccagctctatgggttccctgttttttccttctcttcctcctcattataacagataataataatgattcctagctttcagggaacacatcttgtataccatgttctgtgtgctttacatggattgtctcattacagcttcacaacaaccttagagatagatgttctgtatcattatgtgcaccttacagttggtgcagctgaggcgtagagaggttaaataacttgcccttggtgggtgacatagcaaggcagtagttgggtgaggagtctaccagggcagcctgaaaggcggaactcagtgacagcagcagggcatgctgttaacccactgcttcccactcgtctgaatattagaatcaccttggaatctttcagaatttccaaatcccaggtcgattacatcagagtct

SEQ ID NO: 58236 - DNA, 1001 bp, Homo sapiens
agccaccatcctctctcatctgcttctttattgccccttagaggctgtagtcctccccgcagcgaaaacaatccgtgaaatgttaagtcacatcatgctctgctgtgcccaaaccctgcagtggcttttcttctctctcagtaaaagcaatcacccttactgtggtccataagacctcatagcttatctcatcactgcccaatagaaatataatgtaagctacacatgagggtcacgtaggtaatttaaaagtttttgataaaggaaaaatgaatggaaaatgaaccactcgaagttaattttgataatgtattttatttagcccagtatgttaacagtattttcacttctgagatatgttacgttgcttttgttttgtttgtttgttgtactaagtaatagtcaaagcacatctccatgtgaactagttgcatttcatgtactccatagccttacatggctagtggctgccatcttgcacaatacaggtccatacgaccttacccggctttattacgttacttctgtatctatctcctgttactgttttcaacttgcacttcgctccagcatcactggcctcctgctgttatttaggtatactaggcatttcctgttttagggcctttgtacctccagttccctctgtttggaatgcttttccccagatagccctgtggttaaatctcttacttcctttgggtctgtgctcagatgttactttctcagagggtcccccaagcccccagcattctctagccttccttgcatccctttcatgtagtgtttttttcaccagttggcatactatttatttatattagtatattttctctctctccccactggaatatgtgctccatgagagaagggatttttgtgagttttgtcccctgctatatctcagagcatggaatagtgcctgacatgtgtatataagagatggatatttgttgaagaattaagtgaaattatctattaagaatgattctttttcacta

SEQ ID NO: 58237 - DNA, 1053 bp, Homo sapiens
cagataggaagtgagacacgttggtagcaggaggaaaccacttgctggaagtagcagggggaacggaggtgactgaggttgattctcgttacacttgatagggaggaggccagcagcaggaggagggagcagacaatccataatagcaaagaagacagaagtcgagcacacctagagctgcttttagctggtaatggtaactctggctctaggagcattccttcatacctccccgacacagtttccccagaggctgttataaagaaaacattctctcttaaatatcttttcatttgtagggtttagggtgaccccatactatatggtcttaaacttatgttgagacaactgcactgacttggataaataaatatcatttatcagatatttattaaagatctattatatggcaggcgctgtgtgaagttctcaggatacagaggtaaataaaagattcacagtttgatctggaaggtttatgggcagctgaaccaattttaattccatctgcactggatcacatgcttcaagagagcatgtctgtatctgtcttgtcctttgctgtcaccccagtgctgagtggagagcttggcacacaataggcctcagatatttattggctgacccatccttgtttgatctgtcctggaaatgtgcaggaggaatctgagtgggtaagtggaggaagagaggtgcttaacgcagcaagtgtgacaaatttgggggaagatggacatacttggatgtatgacgatgagtgcctttaagtgactgcctttaaggaaaagagaagggttaaagctgtatgggcatgacagaatccattggcattagggccatgagaaggaaggaatataacctggctacaaaggtgggttagaggtagtcaggatcattgggtatagcagagggccaccagaattgtgaagaactaaccagcggcagagaagggaagagtggaaggagagtaggagccattgtgagaggaaacatggagacctcttcaggcctaggatgaaagcagaaatgacacaagtgagtctcagatgaaca

SEQ ID NO: 58238 - DNA, 1046 bp, Homo sapiens
cacacacacacacgcatgcacttatttcccccaaggtcttgtgccatttgcttatagctcggggacgtgctgtagaaatgtgccacaagtctttggcctcttctagcaagctgtttatcaccctggaggagtaagagcactggacagagtcaggagacttttgctagctacgtgatcttggacacaccacttccttttccaggcctaagtgtctagtcttagggatctagcttcttccagttctgaagccctctgatttgatgtctggaaagctttttccacctttgcccaggtttctgatgcagaccaggctttttgaacaagtagcctagatttcttagtaccttgtgggagggactagtagggatggaggcctagtccccagagtgggtccctgtcttcagtgtggataggagccctccgggtggatgggagcctctgttcctctttggagcatggaaatactggaagagcaggttttcccaatgaccagggattgcaaactgtggcccgtgggccggattcctgtttttgtaaataaagtttcactggaacagagacacgcccgttgtttgtgtattgtctgaggctggtttcatgctacaagggcatagttgagtaactgcaagggagcctgtatgccccataagcctaaaatatttactatcttgccctttaggataaaagataaaaacttgtcaacccctgctgtagactaccagaaaagtgcttggccttttactgaggatgcttatgatggctatttcagatttctagggttcttaaagattctgcattgggcctgtctttgtgatcccatgagaggatgatctggtagttgaaatagtagattattagagtcagctcaaaaatagtcactctgtatctaggaaagctctttcattttcagccttttccctggagcctggaggcctgagttcctcagcaggactgggtttgacaagctactgtccctctcattctgatttccctgggcagtacagaggatatactggactgacccaagtgttgggtcaaggatatac

SEQ ID NO: 58239 - DNA, 1719 bp, Homo sapiens
tactatgaacatcacctcatagttccacgttgctacagtttttataatttttttctttctaatgtttgtttatatgattatataatgattatggtatattaagtgcatatatcacttatcctatcataattcatttagttgttcacgtttccctcctataaataatactgtatgagacatttgtatgcatataaatctttccttccctatgtcctcagggcaaatttggtagtgggaaattaatccactgtccaggagtatgttcttgttgctgccaacaaggggcagcagggaatgttctagacgaattctacctgaagtcaggaaattgcatcaggtgatatcaccaggctgatatctttaggttctgattcttcctcctcgtttccctatagcttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacaggtaaaaacagcatttgtgtcagatcccggagagatgctggtgatgcttgggtaaagcatttaggatgttttcagaccgctcccctctccacagaggaaattatacaagtccctagtattaatgacttgagtatcatgcttagggtgccctgaagtaagttctagataattcttccttcagtgacagttttctcaggcccatgtcttgggagctgatcctgatcagtaatgcctccataccccttctctcatgctgagtctagcttagtgataaaataaggatcagaagactcaatagagatctccgatctcttctaaaggaaagaaggtgggtacaggtccaaactgggggtctttggcttctctaaggtagaccagcatctatttcagtttcaggacacctctaatacattctagattctagctcttgttccaacagcttgaaatgagtttggtcagggatgggacacgaagtaactgttaactccccaaactcccttttctgtgttgaagtgcatgcccatatcatgacctgagattttgtgtatctatgagcacatgcacacatgcacacccatgttttggtctcttccagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggtgggtgaattgggccaaaaatggcagattgcccctcacttcatatgtatgcaggcaagctgtttctttccctccacccctctcctcatccctgccagtgggatttgggtcatgtgggaatcagcacggaaatacacagtttaaatattgctgggagaagtagaaagaggaggaaaggggtagagttaggtggtaaggcccatccaggctttgggtattgcattttagggaatagagagtaaacgggattctcagagatccatccaatcctctggttctttctagtacctatc

SEQ ID NO: 58240 - DNA, 1029 bp, Homo sapiens
aagctgcccttcctcacttttcaaagggtcaggaatcctaggctatgatgctgggaagctagaccagctcctccaagagagactagaccagggtcattttctctgttattaactctgggctccagcttctccgtgccctgctttacctccaagtggttccaatttccaaaggccctgctgaccacatgtgattcccaggagagggctgggggaggggagcgcagaggtctggcttccatccttggcgtgtagctttggatcgctgtctaaccacacagcagacgttgcccggtctccccagctctagtttcttgcctgaatgcggctgacaaatgggaagagaaaagcattcagcaaaatactcaggaaacttgctgttttcattataattcacaaccagccatgccaaggccactttcttttgaaaatccacttctttaaagtttctcaggccctattagtagcctgaaggaaatactaatgactggccttccgcactaagccaaagtgtttgctcttcatagcactcaaagcttatcagcgcagagcccataatttatggagataaaaggaaaggagatataggtaagaagagtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagacttggggaacttgggctgacaaaggaagtagcctggggcatccttaaggaaggaattaagaaaagg

SEQ ID NO: 58241 - DNA, 1046 bp, Homo sapiens
ctttccccacagcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagaggtcagtagcaccctcaggacaggcccatgcccttgtctccctgcccattccccgctctatagtcatcactgactaaggactcagacgacggtgtctgtcatctcttcaggacctcccactcccctccctgccacaccccctgctgcgggaggaagggtggctttgtgcccgtggaagtcagatgattatcatcctaattactattcattgagcatgtgctaagcattcagcattctgataaagattttgtgtgtatcatctcattaaaatgtccagcagagttgtgaagccagtattattattatccccattttactgataaggaaactgaggtacagagagggtaaataacttgccctgcgtcacacagctagcaggtagcagagctgggatttgaacacaaagagcctggtgagagtctgggcttttaaccactctgttgggcaccgcagccacgagctctcggctagatggaatctactgaagaaactctggccttcagcctcaacctcagcatgaagcaagaggccagaggaagccacatcagaagagaaatagggaggcaggagcaactgggtacatcagtgccctcgaaggacctgggcccggggtagctataggtaaatgtttgctgaggcctccaccaaggcgcctatcctgtctctggcagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggag

SEQ ID NO: 58242 - DNA, 1038 bp, Homo sapiens
aggtcctgaccctctccctcaaactactccttcaactcctgtcctgctcaccctctgtcccctacttgtagatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttgggtaggaaacctggactcagagtgtgagggcaggggttgagaggtgaaggaagggaagctgccatgcacacaacccttgcaggggcatgactgtgtcctggccagctgaggcccgtgtgaaatgcttcccgctttgagcgctgcctgttcagatgtggctgtctctggggaggtctacgtgtttcctctgctgcctgggcccatggagccctagatgtctctagcctctgttattggtaccagcttgagggggccgggttgccaggtccctagagaaggtgcaatcgggagacactggctcacagccctcatccctctcacgccgctccctgcaccaccccctccacccagagtggcgccaaggccggatcgcccgggtcgtgctgcaagatgaggacatcaccaccaagattgagggtgactggaagcggctcaacacactgatgcattatcaggtgagagggggtgtcttttcccctcttcagcttcccagaatgttcccttcccgctaagccttgctctaaggcctcaaaagtctaaaaaggattttcctctccctgctttcctcctcctgctggagcatagaacagggattcttagccatggctgcccattggaattactgagggaactgataaaaaacgtgagtgaccaaactccaccctcagaaacagatttaacaggtctggggtaaggcctaggcatttctattctgtgtacctctacatttgcaaaaaaacaaaacaaaacaacaacaacaacaaaaatcaaatgcatattgcaaagccctccacatggacaactacct

SEQ ID NO: 58243 - DNA, 1059 bp, Homo sapiens
ctgccattgtcactctctcccaggcccagattgctgagcagccctggcaaatgcctgggatttactgcaaccagaggatataatttgcaccacgtgcagggagttaaaatacccctccggcatccccttcactgagggtctgtcacagccgctttgttccttcccaaatccccagatctgtagccctgggatgggaaggggaggggggccagcccttgcatgagcaaatcccctgttggcaaaacacttaagcactgctctctacctgagggctgggatccaagaccccacatgacagcaataatgacagctaatggatagtgcttagcaggtgccaggcacttttcttagcactttacaaatattaactcattcaaccctgacaacaaccactggggttggatgttattatgactgtctccatttagtgataggaatactgaaaccagagaggttaaatgacttgcccaaggtcacacagccaacgtatggcagaatcaggatttgaacccaaggaagtctaaccttgagtgtttttggaggggaagggaccaggcaccttccagataggcaaaacagggtactcacacatgcaagaaagcccagagggactgggaaactctctagttatcaccctgaggccagaagtgagttgggagaaccggttctttatagccctgtgggatagtgaggtgcctttatccacagaccctgtctcagatgcagccaaagttcagagcaccacggaccatcagggctgaaaaggccaacctctccattttcataggaaattgaggcccagaaagaagccacccctacccccaggtcacagtctagttactgggtgagctgggctgggacccaggtgtcctgactcccgccctgcgttctcccatgctccattgttctcttgggagacctcatggcaagcccaggccccaccacggagacccctctgtgaaggactgccccttaccctttgtcccttccccaggacagagtctgtggctgaaaagatgctgaccaattggttcgccttcctcctgcacaagttcctaa

SEQ ID NO: 58244 - DNA, 1050 bp, Homo sapiens
ggcagaaatgattatacccccttcacaactaagaaagctgaagttcagagagattacgtgactgatcgcaatcaggcaactagtgaattagagacatgtctcaaaccatggttttctgccttgagtctagtattctttctgataattttttaaataagtagatgaatgaatgactgacttaaagaaccgaggaagcagtgtaaaacagaacatgatgtcaagatccgagataagctaaaaagtggacaaaacgcactcactcaccagaattcctggtggaggaatttaagaacctatggaggttcttaaacctccctgggggagggggaagggtgctgctgtttctgttcctgtgaccaaaccaaattgctaatcccatttccctcctgcagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagtgagtccgccctggccagcccttttcccatgggagcttcagagtggagactggagactctcccctctcccttcctgggccttttccatgattgatctcccattacattctcctcccatggacctgccccagaagcctccccagggccccctcctccctcacctccaccctcagggggtctcatcctgtttgattccctgttccctgactcttctggcatcagggctccggccctgaccgtccctcattcagtctttgcctgcccgccagtgtgactgagcatttcctcctaggtctcccccagcccttcccctgtcagcccccattggaatgcatcctgtatggtgggctgcaggcaacaatttgtttggtgcgtggggctctgacagcagcttaatccgagcagggcctccgctggagcaaattcatttatttcactaagggaaatgtcagctggaaattagaaaataggcatgtagttgcggacaggcaaacggggctccagg

SEQ ID NO: 58245 - DNA, 1060 bp, Homo sapiens
taaagaacatcttgtacagggccagtgttcttccaaacttattttgggtgaaaggatgatgtctcgctctgaatctgcttctgtgcagggcccagaactcaccaaagccagggccctgctctggcggcatcactactccctgcccaagctcaggcttcgggcattctccaaacggcccatgagcagctctttgtaccccgggtcaccccagtgtctgtgatgcgctccctcatccatgtgctgcccttccagacggataggaagacttccatcatctctaaccctgccaattctaacatcccatgttttagtcatctaggaagacagaggtgcagggaaacacagggaaggagattaccaattatcaagacctactctctaaaccagcatactaagaactctccagatgttatctcacttaatcttcacatcatccctgtgaggcaagcattattatctgtttttgaatgaggatattgagattcaaggtcacataacttgtaggtgtcagagctggtatttaaattcaggtctgtctgattccagaggttactctcttccttctgcagacactgtcccagcatcagatggtctttcttccctatccgactgtagccagcagcatagagctatctgaaactgaccaagacatggatctgcctaacatgctggccatactttggtttcccttctgtcattggggcactctgtatgactccaccgcagcctctcatcctcacctctgtgggagacaagctctcccctcccctgcagcctctcagctccttccagatctagaaggacttgcttaaagtcctgcaagcagtagctggggattcagccaaattgcccctctatagatccatgtagaaaggccagacttggcttccaggagagccaactttgtggaatgcaaccctgggtgccctgcaatcaaaagctgcttttaagagagagccctggggacacagtctctgtgtgtgttgggcggggctggtgggggtcgggggattgggaccctgcagcttcctggtctaaggtggtgtcctgcaagatcctg

SEQ ID NO: 58246 - DNA, 1053 bp, Homo sapiens
ctcagcacccatatatcatctcatttcgacctcaaagcaactgttatgaaatagaagttagtattgtcattagacccattttacagatgagaacactgaagcactatgaggtctgataactttcttgaagtgacattgagaataagttttagcactgaaatttgacctgcagctagctacttgactcaagagcccctgtgtttgaccagtgtcaaaccagtccttcatctctttcctgagctcacttggacaaattagaactgtcaatctgcagagccagaggagagaaaggagctggcacctagctcttcctcaagcctgctgcagaaatgggaagaaagccagtagtccccaatcccagcattgtttggggagactagacatgcacaggaagagacaaaggggcaaggccaagaggggagtgtggatattgcctgggtgaggtcagagaggagtggggatggatgctgagaagttcagggagccagagagagcaggagtaaaggcagtgaccagcaaggccaactccagagctccttggaaagcagcaaggcatggccttagccatgtcttaagtcctggctatgcacttcttgatctgtacatcttaagcctgctgcagagatgggaagaaagggaaaggggctggagtgcctaagcagacagaagcgaagagcaggccagggcatgcattctcatggtggttgaccaaggatgggggtgtcccctggggcagtgctgtgtaaggcaaaaagcagcggttagataaacctggctgagctctgccccactcactgtggaaccttcaagaagttacttaacctctctgggacactatttctcatccgaaaaatgggaatgataataacacctcacagcttgttttgagcgcttagtgggataaaatatgtaaagcccctggcacaattccttactcattataagcacttaacaaacgtgaaagcagcagccatcattctcagaatcttcaataccttggagctgaagccctgcttctggcttctttcccgctatctctatcagcctggagat

SEQ ID NO: 58247 - DNA, 1051 bp, Homo sapiens
gtattctcacccccactgtacagatgaagaaaatgaggctcagagaaattgagtgacatgcccaagtttataccgctgataagtggcagagccaacatttgaactcatatttaattataaaaccatttttaaattctttacaatattcccaagtaacataaaagaagaagtggtgcttccccttccttcatatccggacctttcatagaccagatagatgcaatccatccacaagacaccatatcccggacaatgcagggctgtcggtgggagagctcttactgcatccaggccctcattcatctgtgcagagaggagttaggagagcacagacactgcctttcaaagacagagctacttcaatcccattttattcttgatcgtgaccagggatggtgcctcctgactttctcctgtgtctttatgtctctggaagagaatgtttgcaggggctgttggtggtgccccagcctctgccctcagacagctagcttcctgagctgctcagggctccgtgccttccccctgattcgagtgatttccggccactgctggcctgagaacttgcactgttctgtaattcttgctgctgcagttgtcagtctctacatctgtgggcacccatggtgtgggggagcttaaattaggcagagacttgcttctatcagcaccacccgcctctgccagccccagcagctgcaccatccactccccaactggctggggcccctttccagccgaaggcaagcttctcactgggaaacctctgcctcagccgcccctgctcgctgaccgggggctgacgggctgctctgttcacagaggacacccaggctacgcgaggctaattaaccccccgaggtaattatgctgtaattgattttcccagtgaacatatcagcaggcatcagaggccccaatctcctgctggtacttttcaagtcaaggctgttgtgaaatgaaggagcatctttggagagagacaaatccatgctgtgtcccaagccactcgggggaggtcactctgaacaggacatgggggagggagcat

SEQ ID NO: 58248 - DNA, 1065 bp, Homo sapiens
agaggtggaggggcaggtgtccgggagccaggtcatctgcatctcacctgggcccaaggatgtccctgtcatcccgctggatcaaggtaagaaatatctgccatgagagccacaaatgaggggcttctctatactgagggagctgggggtcacaagaactaggcacacagtcttcttataccagatactaatattggcttagacaacttgtttacgtttgaaagcaaactgtcatgccccaaagtgaatttcaggaaagaaaacacttgctccactttgagttaaggctgcacagaacacagcgtctttccagatagcccgtccctcctaggaatggagtggcttccatcagtagttttttagcaggtctctccacagaactgggggctcagacctaatatttctgaaatcctttcagtaatggaacatgactgacaaaggcaaggggctccgtggaatctgcttcttcctccctgcaggcagaggaagtctgggtctgaggggtgggctggtatttacccaaagaggcttccttgggaggagaagagacgattcaggcaggttccacatagtatctacatcctaagagagccctgtggtggcttcatgacttacattttatttttgtggctgtccactgggtcccccacgttgttacccaaccccatccttttttgtttgtttttccagactggtttgggctggagctacagctgaggtccaaggagacagggaagatatttgtcagcaccgagttcaagttttacaactgcagtgcccaccaactgtaagtgcttattagaaagggtcttgctctgggtctggatgtgggtatgggctttcttcccctcgatgctaagctcctttagggcaggaaccacgttgtagtcacctcacagtttccccatggggcctgacactttgtttggacagagtacactgtacataaatactaccatattaaaccaaatggtatttactctctatagtctctgaatccttggatgccaccccaacacacctaacccccaactctcaggccaagatagtaaaaagagagtcaga

SEQ ID NO: 58249 - DNA, 1066 bp, Homo sapiens
aaaaatacaaaaattaaattagccaggcatggtggcacacacttgtattcccagctacttgggaggctgaggcaggagaatcgcttgaacccaggaggcggaggctgcagtgagctgagactgtgccactgcactctagcctgggtgacagagcaagacactgtctcaataaaataaaataagaaagaaaaaaaggaagttccagagaaactcagccaatctcttggtctctttctgtgatgacataaagtgctggacaggaagaggaagaagtggccctagcccttcaccagactcacctttccgtatcacttagtgaaggattgatttgatttcttgtgttcaagggctttgcagggactagagcttcacccctccctgaaggtgtgtttgctttggatcagggacaggcctgtttgcggacagagcatccggacacctttcgctgggtctgtgatatggtggctttgttgctctcctagacaacaatatatatggcatgcctggccagtggcatcagggaacatatctcctgccacttcttcctggagacctccaaccccaagcccctggctgacctcctccactttcacctttcagcctcgtactcctgtgccacctcagcacactctcctgctctaaaaaaaaagaagcattcaggcagtcactaaatagcagtattgatgccccatccccacatgccctggaatgataatgcatcacccgtggtgtgtatccagacgaagccagattacgctcaggtggttaaaagtccaggtctaattagagttccagggaatcaagccattgtattattaatgattctccggcaatgttctgattaaaacagtaattttaataagcacagctcgatgctaagtgttcagtgagcacctaattacatcagttatgactccaaaattatttaaaattccgctttttttccaccggacccggcatgcaccaaataaaatagagactcagacaacttggtgattatttgctctaattaatatcctaagcacctcttttaaaaaaaaaagaaaaaaaatgtatctttgtctct

SEQ ID NO: 58250 - DNA, 1012 bp, Homo sapiens
cttggtcttgtcttctgtaaagtggggataacaataatacctacctgataggactgctgagaaggtgaaatccctatacaatgcctgggacagtgtgagagccaaaccctcagccatggctctagctaagccctgtgttttctccctgcctccaaggtaatctccctctttcactaccatggagtcccccacaactaacacgttgcccatttttcatccttaagtcatctgccagttgcatctatttctagcctctgtcttatgagacaagaataaggaaggaaaacagataactgtggaggctcatttgccagttgtcagctcctgccgtcagctgggctctcttgtctgcttctccctgggtgcctggaaaaatcattgtgaccttttatttactggttgatctagtcagttcttggctccggatctctctgcccgcccctcaggctccccgcagctctcccagccctccatcagccagtgtgggttccctgactcccaggcagaatcatgctgcaagatgggcaggctgtgctgggccctcggagcctgcctgtcttcatgatcagattcctaaaaacctgtgggcacagagaggaggggcagtcagagctattgatcttccctactcgctgctcccgccaggggggatttctactgcagattctctcctgcaggcctcttcttctcaccccgttttactgagcagctaaactgagcttgaggctagcgagtggctgccccggagttactccgtaagtcagcagcatactctctctcttggcccctcatccaactttttgagctttaccaggttgttttcatccttttcccttcatcctcttctactccctacatcagctcccagcccggctggctggccatggccagcagctatttctgcttttccttctctttctccctgggaccagccatgcatttctctgcagctcctctgagccaattggactgaggtgtgcacctcgggaagtggagggtggctgttgggaat

SEQ ID NO: 58251 - DNA, 1009 bp, Homo sapiens
atacacatacacacaacagactcatacacacaccacatatgtacacacaccacacatgccacacacatacacattcacatgccacatatatgttaatagaccacaaaagcatagggtccttaggtgaacagaggtagaagcgagtgataaaggcctcttctgaagtgaatttgaggacgccagatgctgagacctgctgagagtgatgttgagcgctcaataactctgtgtcaaaagtctcatcctctccaaatgcttaggtctgagagaccaagtttctaagaaatctgagctcaggcataacaagaacagctttatatttatattacactgtacgttttccaaagaacccacatttccactcctgcattttggcttaggcctcacctcctccaggaagtaccccctcagggcctccttcaggccaggtgagatgctgctccgccccccgtgctggtctccctgggacccccatgcaaacctcttctcacaaggggtgacccctgtgttcatgaagaccagacaaattgtccatttccccatcaccgggcttcctgaggggatccttatcctttatcacgtatctgcagctcctaacgcaggcctagctcatggtaggcacataataaatcaatattggacagtactgacattcatagctaataactcattttacattcacaatatcttttttgagctaaggaccattatgtcccaccattatgggacagctacagaaactattacataaacaagtgaaatgacttgcctgaagtcacacagccaatgaaagaaaaccttgggattaaatcccagccctgcagacatgatccagtgcttccttctgtgtggtgatgcctttcaaaccaatctctttgctactaagaaacccaagaagaagattcccaattctgctcttccacagctcttgcagaaaacctatatatactattactgctactgctactactactaataataatgtgatattagagtaccaaagggctcc

SEQ ID NO: 58252 - DNA, 1148 bp, Homo sapiens
agcctgaatatcttaggaaagatgactgcatatgtttacaagtaactgtgccaagagacattctaggtgctatgggagttccaaggaaagattggtgcaggcttcgtggagtaggtagcatttggataaggccttgaaggatggttaggatctaggaggtagaataaattgtcaagcaaaggcgtgaagacgaaaaagctggggatgcaattggaaaatggtgagaaggccatgttagctagactcctgaatgacaaactgaggagtatgaactcttctaaattattaaaggggacaattgaaggtggtgtgtgtgtgtgtgtgtgtgtgtgtgtgtgtgtgcgtgtgtgtgtgtgtatgtgtatgcatgaatacatgccatgatttacttttttcattattccaaaagtagtgtatgttcatcataaaaaaattaggagactgagttaagcaagagaaagaaaattaccaacacctgaaatttaaggattttgcatacagaaaaggcaggatcgaacaagtgttttaagaagattaatctggcagtgtttggtagaatagattagaacaagaatatgctggaggcagggagatttctcaggttattgcagtagcccagataagaggcaataaagactcagccccagcgcactagcaatgggaagagagattcgatggcatggttgtaggctccatttctctcggttaccatggcttttctgcaccatggtgggcacatgccacgtgtgtgtgtgtttttaatgacttcttttaaaatctctgggagtctcctgcatttaggcacaagtccagtgtcagataatggtgcttagcgctctcgacctcccttcccatccctacagctggaaatgccatcctcagtgttaatgaaagcaaagattactgttccagattataaaatgcagggcaatctcaggccatagaaaagaaaagaatgaattaattaaagagagtaataaccctcttaaacaccccatcctttgctcctttctccagactgcaggtggccttctttgtcacagtggaggagacagctatatgatctattttgttccccaggacttatctccagaggcacccagtgctttttaaatgtagtttttagtcctaatgtaggcattgtcctc

SEQ ID NO: 58253 - DNA, 1053 bp, Homo sapiens
tggctggtgtccccagtctcctctgactccaacatcctaaatgcccagactctcaagacagaaagagcacgagctggaggacgtgggattgtgcaaagagcaggggcagccgtcttcctggagcctggtactttagcataggctccccagctgtttgcttggtgattttgagggagttgtgtgctttcaccaggactcagttcctcttctatgggaaggtacttccccccacaggatgatcatgaagatcaaaaaagaaaaattaggtgatagaaacaaacaaaatgtcattaccttcagcataccctcagcctagcagatgataatgcagtgcctgttagatggacaaaggacaacattggctgggagaatcaatgcccagctctgaggagccctccccagagcctctagggaaggggtttccccattttcctggcatttctcccactccctaggttgattggagtcatggtggttttgttgtcacctgccatatttcagtaacctttgaccatcgcccagctagcctgtgggggtagatgcctatgcggctctccctccctctcccatgcagagaagcacagtcctccctgggagcaggaaggaatgtgcttcctgggaatactccttgccccatgtgctggagatagagcccactgcagggctccaccacagggaggatcttgaaagccaagaaaagcgacccatttgttggagaacccgacagggtcagaggcagctcagaccacctgtagggaatcaggcccttttgcccaccacaaatctcttttaacaacaaactttgagaacagcctgttttcccagcgcagcttcctgcatagtgtttgcctaatctttctgtccaaaatccctctccaaacaggaggtttcctgcccagcactggcaatcagagagctaattatgtgggattagagatggagttggggggtgttccttttaattacaggaaaaaattagtccaactgatgtcggcaaggccactgggattagaatgaaagtccaggtttgggcacaggtcagtttgggaggtg

SEQ ID NO: 58254 - DNA, 2540 bp, Homo sapiens
ttcaaaataagaaagttggaggagaacatttgcctcccaaaagctatttttctggacataatttaaaattacagcttctcctcctatcgctctgtattccgccacttcccatccctggacctcatccctaccttcacagtgaactcgggcccacaacggcctggtctacagatggcggaaagaggtgggaggttttgccagagagcaggggtgagattcccctcccagcccctctctgacttctgacctctgcacctttcttgctagtgatccctaaattactgggctgtctaaccctctctagggaggagggaagcaaacagggctgacgggaggtggagcagagaaagtatgaggtggaggtcaggggtcttttcacagtgtgttttggcaaaggaagcctgtggagctgccagtgggatcagactttcatctcctgagctagccccctcactgggaaagcaaaagctgtcactggagctgtgatttggagcatgtgctctggggaactaggctgcacccctcagggtctggccccctgaaggaaagaccagagaacagacagggccttccctgcaccctcctgccaccaccctcctcagccttaggaggtgacagcagtgcctggaaaggggcttgctcagaaggaaaaggctcggtctgcctacctgggtcgggaagtggtagatgggattgtcctcagggccccagccagcatgaagcctctctgatgcttcttatagccctcagtgtgttcctatcactccagagaacctcccacatgcatttgtctcccagtccagcaaattaaaatctgaaaggaaggaagaggtcacaggctcagagcctggacactagaggtttctcactgagtgaactttggaaggcttggaaggctggagtttggggtcgcagagaagtcagcctccgccatcccctctcaaacttgggcagggggagaccccagaagcttgacatggccagggccaatagcggttactccctttccctcctacccccatttccctcatcacagtcctttttacccctcctgggatatcttccatcccagttcccctcgattgctttagggtgtggggcaatgacagcgaatactcatgaggggcaacaacttcagacaaaatctctgaagactcacccgtgtctccacacttcttccaccccttgctagctgtgtaaagttaaccactgtgactctcagtttcctcgtctgccaaacggagtaaataatagtgcctttctaggatggatgccaatgttgtttggattcaacataaagcagatgcagagggtgtaacgcggtgcctgatacatgaaagttaagcatgagctcttgggtttttgtttcccaggtttcttctctcttggtggctctttaatgaatagtgacagtccatacccaggcagccatagccactgccactgccacagccaaagctcaggctatgtgatgaacctgttttctctgccttctgcccctgctcccagccatcccggcagaggtgcccactcaggcctcctaccggagcccctctcccaccgcttgaatgcagaggcgtttcttctgctgacagcctgaagacaggccatttttcttctcctcccatataatggcctttactctcctaccactccaccccctttcccagccttaatgactttaacatacacacagttatttaaaaaaaaaaaaaaaaatacaagcccccagtgagctgctctaaaccgcctgttgtggaggaggaacaacccaagcacatgttcacaagtcactgcatgtgatgacagggggccttgtgctaatttcctcgtgtttgaagccccagggtgggggcggggcaggaggcagccagaggggagagacccagggcttgggtatttgcttgttccctttgatcctcctagaaaatgctgtagcatttggggaagtatttcatcctgggaaatctcaaagaagagtaagaaagatgccttaggcaggggttggggggtggcaggggatactgtagaaggaagatgctaccagatgaccttttctctccttgagattctgaatccctgctctggcttccctgggcagcaggagagagtacagaatctccaaggggaggcttcagctcaaggtatttatggatttgctgaagcctcctaccctaacactcacacagtttttgccttccagtttctctttgtggcttatctgagagaggctaatagagcctccagggccctcatctgccccaccctgtggatagcatctaggttgagcctctccctctgatcttgacctctagggctgacgtgtagtctgtgaaccaagggttggtctggtgggggagaaggggagtgagtgctgcctgcctcttggcagaccattatgccaggagggaggaggttcctgaccacaggacaggtccggcagaagggagggaggacaaagagccaaaagccccggctgcacctcctagcagggaaatggagctggctgtgagccaggttttcctctaaatcagaagcaa

SEQ ID NO: 58255 - DNA, 1096 bp, Homo sapiens
atccagagagctccctgggccacagacaacccgttaatttcacacacaagggttagctctctttcatgttgagattcttttccaggtaaatttgcagcatatttagtcacggggaaacccggtctcttccggcaattagcccccagttcagcttcggtgactgtcagtgccccattcaccctcagcctgagtaatcacgtgtcgtcatgcacaagggttatctaacccttttccaacaatggcacatgtggtgacctccctttatcacttagaataataatttataccagttggcacaagggatgcactagtccctgctcttttgatcttcagactgaaaataatttttcttctaaaccatcactgattgatttttttctttcattgttttatatcattgagataagacaatggtttgagttcaagtcctaactctactatttactaagtacgtgaccttggccaagttatttaacttctcagcaattcagagttgagagttcttgtctttaaaaaggtcataataataccttcttcagaaggattataataaggttcaataagcatctaaatctcttagcacaggtctagtacacctaataagattccctgccttcccctttttctttcacctcacatatacccagatacagaggacaaaagagatagctttcttttccaacatctacccccgcccttgccacccattcttctgaataccacattattttccacccattctcagggacaacacacataaaattaatttctccaaagcaaatggtgcaatggaatctgaattccaaatgccttcagtctttttctccccacccgctacaagggtgaacaggagcttcttgcccccactgccatggtttctactgtttctctttcttctcagttaacccagggtcttaggtggactgagtccattctccaattcaattctcaggaccctaccacaaactcacaggtgttcagcacctccatgaaagggagaaaggagcaagagcatctcagcaccacccaaaaccaaggctacttgaacacaggatttgcattcacttctgttgtctgccccacaaatacactgtac

SEQ ID NO: 58256 - DNA, 1025 bp, Homo sapiens
atgggcatatgtgcatttaaatattactacaattgtgacttaacttgtgaacttcgattttttttttcctgtggagtggggtagtaataagcactttgcatatttgttgtaaggattaaataaaatcatgtgtaaaaagtgcttaatatggtgcttggcatgcaagtgctttctattattactgatatctttgaggcttccccaaaaccccacttcttccctggctccctggggtagtgatgctgtcagatcaggctccttttcagtgacatgtttgcaaggtcagacggaggaagagaatcctgtcccctactcccagccctgagtcatgggaaaaaaatacttagaagacgggaccagctgagccgaactaatctaatcctgctggactttggcatccagttgcattagtcaccagtgagaggtttcccagtctcatatcaccaaacaatatgtactgaccccctccccagggtggggctgaaggaagtgtcagttgccctgttgtagcttcgcagaattaactaaaacaggcccattctccccctttgcatgtctccacaccaaccacagtatcctgtgctgcacaactctgccttcgatgaattatgtgatctgaggggacctcagtttattcatctggaccacccatgcctgcctggcaagattgctatgcgtatcagacatggaggatatataatgtctaacacagatcttgacataggagatgcttaataaatggcagtcattgctgcctaccacctctgttgctgctagagtgactcctcctactagtattactactaccactcctgtactattaccatgtttttctgccacagtcccaaattctctttgattctattagttcattagtcccatataattttcagatgatcaagaaggattggaggccaggcgcggttgttcacgcctgtaatcccagcactttgggaggccgaggcaggcagattgcctgaggtcaagagttcaagaccagcctggccaacatggcgaaactccgt

SEQ ID NO: 58257 - DNA, 1160 bp, Homo sapiens
ggcttatccattaagctatggaagatgaattaggcttattcagtgtggccccagagggcagaacagggccactgggtaggcgttacagcaatgcagctttccccttcatataaggaagacgttttttacagccagactgtcccgtgatggtgagagctgacccaggaaggaatgaggtcctagtcagtggaaatatgcaagcagagactggatggtcaccaaccagggtgctgtcaaggggattcctgcatcaaatctcagatcttctcaatgatactgccactgtttctctggctctgtcagcaaagcgtgcgatgaaggaggacaggctgaggcagagaagaggagcagaaaagggaagaccaaggtcccctgggtgtgggctttggaatgaggctggttttgagcctgcccttagtgtagcagaaagcccctcagggtcaggtaggaggggcttggcacagacagggcaaggcatggcctggatgatgaggacaggcaggcctagggccagatgtaggggagggaaaagcaggttatcctggggtctgggtccagttcctcatgacagcatccctcctggttaagaataggcagtgggagtccagatgatagagattaagtgcaaacaccaaagcagatggagatggaggaagagtggcaacaggaactggaaactcattttacatgattttccaggtttcagggcggagacaggaggcaaatcaagctcatgccatggggcaaaagagggaagaagtcaagctgagcaagtgaaagatgccaggacaatggaaggaaggactatcttgggttagggtgaagttcctttggtttcttccttccatttgcagctgctaaactgccgcctcaacccaggtttcacatccctgcagggctcctcacagaagctggggggtagtgttttgccgaggctctctagcctcttagtcccagggaccttaaacagcagcagatgctgctggctctcttttccatccccaccagaaacctcttctgctgctcaagcattgtgacatgtcctttattctgtcccttcaaccactatgcatggcaccctcctagaccccacagcatctggcaagggagcagctgttaaggtgtctacctcccttgagattcacagatctttgagggca

SEQ ID NO: 58258 - DNA, 1023 bp, Homo sapiens
tggtcctgaggaacattaaaataaatagaaaatgagttcaggcacttagctttacaaattgatcctggttctcctggcagaaaggtagatacaggtgacgccagctgagtggaaggttgctgcctgttctttcatctggcttcataagaaccaacatggaatttgtgggtgagctggtgagaagtttttgtctgcagcttgtattagggcccctgaactcccatgtctgcctctctgaggcctggtgtcctaaggctggaagttgtggatatgggtcgtgtagagacttcaccatgcctccactgttactcaccccaattccttccgcttccctccagcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaaggtaagagtctatgagttcagatgctccaatgccattcacctcctcagcaaagagtccctcttggaaggtagctattggtggagatttaactataggcaactttattttcttggggaacaaaggtgaaatggggaggtaagaaggggttaattttgtgacttagcttctagctacttcctccagccatcagtcattgggtatgtaaggaatgcaagcgtatttcaatatttcccaaactttaagaaaaaactttaagaaggtacatctgcaaaagcaaaaaaaaaaaaaaaaaaaaattgctcttcattcccaaatcaagcaaaactaagtttttgattatgtgcattataaatctccaaaatcgcaaatccctccctagaacctgtaaacttgattatactggtctttgttgaattcagagaagttggttgaagcagattactggtcccaattctaagacctggggtaaacggtgggtgctgctctctgatggtatatgatg

SEQ ID NO: 58259 - DNA, 1427 bp, Homo sapiens
gaggtagcattttatctgaaaaaggaaatcttataggttgactaattcaaataccttttgttttaagatcaagaaataggctcatggaaatgccagactggtctaaagtgagtgacactataattcatgagtcacacaggcagaatgtgaacccagggttcctgagtctcccacctttcttcctgccctgtgacctcatgccttctagacatcaggacgtttctcattctcagtctaactctcaggatcctgtgtttccaccagccttcctgcagtctgcggagaggctatattgggacttgtgcagtagtatgacaaagaagatcaccttggatctatttctttccccttgccacatgcttcccagactgagctctgtcactgggtcggggaggcctagggatcaaaggcacacccacagtgttcatctcattgtgggtgggaaaggaagaatataagcaaaaagagaagtcaagagctgtggcaggatttcagaagtgccatctcctgtggagtcttcaaagacaataacaggccaggtgcagtggctcacgcctgtaatcccagcactttgggaggccaaggcaggtggatcacgaggtcaggagattgagagcagtgtgaccaacatggtgaaaccctgtctttactaaaaatacaaaaaaaaaaaaaaaattaggcgggtgtggtggcacgtgcctgtagtcccatctactgtggaggctgaggcagcagaatcgcttgaaccagggaggcggaggtctcaatgagctgagatcataccactgcactccagcctgggcgacagagcaagactctgtctcaataataataataataacaaaaactaacataagttaagtgctcactgtgtgcctgcaaccatgctaagaggttggtctctatattgtctcatttactgtcatgacaacttgaaaggtacatactgtagttattcccattctaccagaaagggacatgagacttgacttgcctcaaatcccaaatttgttcccagattctgtctaacaacaacaaaagccactcactattcaaactgtgtcttgggaggataccaagcagggaggtgaggtggctgatcttaaccgcatactaagtccttccatgttatctctgctaccagaacccccttcctcccctcgcggctcctcaaggaggaaccactctccacctggaacccaaggagattttcttcccagcgacaggggcagagaatggcctcttgcaattccccatccagctggagaatttaaggattctgttatttcctttccacagctcctcttcaggaattcacgtcctgctaccggcctcaggacatagctaaaaataacctctggtttccaaactgaaagccctgtctgttgggaggctttgccggtgtgcgcctggggccggaagggctg

SEQ ID NO: 58260 - DNA, 1029 bp, Homo sapiens
tctcattgattctcaccacaaccctgtgaggtgtcattttacagctgaggaaagcgaggctccaaaaggttaaataacatgttcaaggtcaccagactcgtaagtgatagaatgagacttgagcccaggtccgtctccaaaggccaaggtcttttctctgcgccatccagcgctgcgagtttgacctccttgttgaagaccctgttctggaaccttccaaggggacttccctcaccccactctgttcatcactttatattgtgaatttgtcattttttattattatgtgctttttatgtgatccatgatattatatggttaacggctctggagctgtcttgcaaagacttttcctgcacaagtctagattatacattcttcaaagacagagctggtatcttcccattcttctccatctttcttcccacctcacccatctagcctcacccagtgggttcaaggcaaataatagccaggatccttcctaaatcatttacctccttcttcactacctcctgaagatcagtcatgacagatccctgagccaagtgtattagttcaaatcatttcttgaggccaactagtagggacagtgtccactgagaaaaagcaaatgagcacacctgggcaccccctcgcgctgctcttgacaattcaggctgaacacaatactgagtgaaagttatcatgctagccctgcacggataccaagaagcacgagatattgttcctgccttcaaagagcctctaattcagtggggagataggaaatagtcacataaaaaagacagctcaatgctgcaatgtagtgtgtgctagaatcagtgtgtgattctagcctctccacctccaatctcctttctctcctccaaagtcaattaaaaactagcagtttttagagagaaagagaggcagggaaagacaaggaaggaagaggaaatttagcctgtgtactgaggcagacctgtatgggaagggcccagagaatgcggggctgagcctaaggagctggtatctcagcatcttctc

SEQ ID NO: 58261 - DNA, 1109 bp, Homo sapiens
catccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctgggtaagcggcggctgggccgggcgctcggagtcggcagcgccctccgccctctccccacaggcgcgcacacccgtggcggcttctcccgcgcccgcctctttggggtcccggccccagaagacccggcttggccgcggcgggcgagtccccgcgtgggctcggccactttcgcgggctggagcgcggcgtgcgcgcgatcgcaggctcactggagccgctgcctcccgccgagggcttcccggccggcagcccgccggcttcccgaatgcgggctgagggcggcagcagcgctccgcggcgcgcctccaccgcgcacctgccggcgctctgcggctttggggagctcggggcggcaaggctgtcctgagagctggagcccaaagagggcctcggtggcaccagcgagacagcccaaagccacactggccagcgatcgatttgggggcgttcactccagtgccggggtccctggtggccgc

SEQ ID NO: 58262 - DNA, 1018 bp, Homo sapiens
aacttagctgtcatttttggcctttagcacactctgtcatcaaatacttaatactttggtaaatatgactcggtggtattgggtggtgggggcaggtggggttcacaaagcttcgtgcttcgagcagcaactgtctttgggatggataaaccctcaaaggaatagcagaatttgatacctaccatagagctatggaatgcagccccaggagaaacacctaccatagagagcagcacttataacttttgtggggtggggtaagagggtggggatagaaataaagtaatttattgctggcaaaggaatgtttttcttccatcaaaagtaggatttattgtctgtataatgtgtgacatacccagattggaagagtggtattttgttgaagatggttttgcctggtaaatccactcaggacaccaaaattatttaaaatattaaaataaacattttgtcttctttacagtgaatacatgctattatagaaaattcatgcacgaaaacataaagaaaaattaaagcttttcatcatctgaccatccaagataaccaattagcattttgttacaattttagatgttttctatactttttaaacatgtttcaaaatgacacattaacattttaattctgacttttaattatgaagcataagcatcttcatgttgctagaaatgttcataaaatgatggtgatgacattacaattttctatttatttctgtgcttgaatttactaaactataataatgctggtaaacatttcatgtcacttcctatgtgccagatattgttctaagtgtttgacatacattaactcatttgattcccaaaaccacgttgtaaggcttgtactgttaatattccccatattacagagaaataaattgagaggttaagtaattgccagaggtcacttgactgttgagtgatggggtcaagatttgaacaaaggtagatagtgctctatggacaattcatagcccctctaggctgttcagccactgtactgctgtaga

SEQ ID NO: 58263 - DNA, 1050 bp, Homo sapiens
ctaaaggaaatgagaaaggtattaaagagatggaatctcagacagagcttcaatattgatctcgtctcccttaagtttgatcttatgtaaagtaagtatacagagtgaggtttggtgtaaaatttgcttttgtaaggcctaaagaaactggaacaagccatccatattcatcccctctttagcaagcatattccttcctaccactttcaaatatttggatcaatataaagatttaagatcgattttcttccagatttcagatcattgcctcatagccacattatctcacaagctgtggtttgcattcttgcacactgagctgtcatatttcacataaataccttctttacatgggacaaaatataaactgtctctttctacttaaccctgtcttgaaaaaacaaaagaagctgagttttggaaaatgaatttcaagcccagtccactggaaaatgtcctttggtcatctatacacctgcacttactgatactctcttttcatccactgcctggcccgtaaaccacattgtgtccctttatgggatacttttcatccactcctttcacttgttggctccctctttggtgagctgatataggagcttgtgtatttgcatttcctttgggagcagcattctttaagcagagcaggaaattcagtgtcagttaatgaatgctcttggtgtgcagaaactctgctgagctctgggagcacagagaagaatgagatgggttctccctctctttaaaatgattgcctctagttagaggcaatgggcctaacaataacaatagctcccatgcattgagcatttgttttgtgccaccttcccaaacgcaattaattttcatcttcacaatagtcctgtgatttagatgctgttattcccatttttcagaggagaaaatttgggctccccagttgccctggccctcagtgggtatgtgtcaaagccaacatttgaatcctggtctgtgtgacatcaacacctcttcactatatgctatgctggttgaaaatataaatactagtcgatgactgaggcacag

SEQ ID NO: 58264 - DNA, 1070 bp, Homo sapiens
taacaaaggatgacagtcccggctcttcaaagtccctggggatcttacagaacaggctgccaaggaaagtggagaaatcttcgtctgcttcaaagacccgataaattatttacatctaagagctatgcttttgtttttctggaggcagaaccacagtatgcctgaaaaggagatgggggggcagtttagaagatgggccaggagggcagagccaggtggtgaggggagagttccagacaagagcagcaaaactaaggggttagatatcaagaaagagcatgcaatgtctatgtgtgagagaagatgatcattacgtgattgttggacctgttaagtggaaatcagagctggaacaatccagcactcacatgcgtgcccatgtgccagcgctggcccctgtttcagtgcaaacacatgcacatgtgatgtgcaggcacatgggggccttgtgactagtgacgcttctgcagtgctgtgtgggtgaggcggcttggagcttcccttctttggtggtttatggtgggttgttgttaggtggtttggattttttttcctcttctaagactcttaaaattgcctctttggaagatcagctaaagatgcattcactgccacccaccagcccggaagtgaatttccatcagtcatgaaatctggtccttagtcgtcgtgtctttgattactccccttagccaaggactttatttgccacttgcttgagaaggatccgaacgagcggtacacctgtgagaaggccttgagtcatccctggtgagtgagacatggagtggactctagaccccagccctgtagttcccaaaaccatgctgactcattcatattgcatttccctggaatctgcttgtcctgatccatttaatgatgtgacaagcaaggaccatgccattgttcatcaggcccaggtagagattcaaacattatacagtggagcaggttctaatgcaagggtagcagctgggttgtctggtcaagtgcaggaggcaggtgcagccgagcgctgtcattcagcactgggatagggtgcaatgttcagtactagttattcaaga

SEQ ID NO: 58265 - DNA, 1044 bp, Homo sapiens
cacaactagtaagtgatggggacagggctggaagcattttccttgccccctcatccagaactcatccctccctatatagctgcctatgagtgggagaggcctttgtgtccatttctttcagtcctgttgaccgatttctttcagacccaagctggggctccatctttggctaaaaatacgtactgttttttgttggcctttttgaggagtgtgggctcagagcagtaggaggactttcctttgctcccaatgttcaggcagctggagcagcagccacagggcccggcggccagggacccctgatgcatgggcaccaggctgctgctgatgtggagggagccattgaccaggcagttgagggacctgccaccaggggcagtgggccggcggccatgctggcagggtaattgggtcagggcagggagtgctacactgtggtccaggacaggtgcctcggtgatggtgatctcaggggagctgggtctagaggtttctgaggcttgagtttcaggcggcctgttctccacctctgggcggacgcccgggctgtgcaggttcatgtgtagcttcctcatgtggtgcaccacagctgctgcgttgaaggcttgctaaggagacacaagagcagcctctggccttctgcaacctcagagggccttggagcttaaactttccctttgccttgtggcctcttgaaacctgggtgcccacttctcatttcagagagggtacacggagctccaatgccttctgggacatcccaaggaaagcccttatgtcagcccctgccagcccagcctccaggggcccagaacagctttcccaccccctggagaggacagcttaccctccacttgctcttagcaaagttcttctggatctggaggctgactgatgggtagatgtcccggtggagggctgtgtttccgtcaatcctgtggatgtaagaggggacacctggctactgggtggctatttacactcatccagggagtgggcagggtgcctgcaggtctaggtgagagctgggtagagtgtgcagag

SEQ ID NO: 58266 - DNA, 1037 bp, Homo sapiens
ttctgtcctgttacccagatccttcccccttgccttctcctctctgatccattgccacacacgtgggaaggtgacaacccttccgaataaaaatgaaagctttcttctttagatggaacccccaaattccctcattatttataatgtcaggctgtcctggacaagggaagctgtgcacccgctgacaccagtaagaaggttgccgccatgtcagagatgtccgcggacacctccctgggctccgggtcctcccctgcgctcgcctggagtgggaccttcgcgtgcacactggccttcccacgcgccccgctgcgatggcacccgcgccgggccccctagctcacacagtcggagcgtgctcagcgcgtggccacctcctgccaggtcccagccgggttccaccccctccttttcccctcctcttcttcctccccctccgagttcccctggctctgaccgcgctggcctgggccggagagcccaggaggcgtgtctcagagaaaagatataagcggcccccggacgctaaagcggtgccagcggcggagtctccaactgggagagctgcagctgccgagaggaggagaacgctgaggtcggtcggaccaacggacgcgctgaccgctgccaactgcagctcgcgctgcctcctgctcgcgccgtgccactaaggtagtccgcctttctatgagccctccccaagattagctgggtgcggggtggtgggagccgttctttggtggctgaagcccctctcctgctgctcctcctgcaggtcattcccgcctccgagagcccagagccgagatggaaacggtccaggagctgatccccctggccaaggagatgatggcccagaagcgcaaggggaagatggtgaagctgtacgtgctgggcagcgtgctggccctcttcggcgtggtgctcggcctgatggagactgtgtgcagccccttcacggccgccagacgtctgcgggaccaggaggcagccgtggcggagctgcaggccgccctggagcgacaggctctccagaa

SEQ ID NO: 58267 - DNA, 1013 bp, Homo sapiens
gtgaaactatcttgtctgggctgggtcgccatttcaaagcagggagggacagaataacctttggaagataccgcgatttaacaggaaggctgttaataattccctgctcctgctttgtttctaggcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggcccggggactgaagccagctgtgctctatgattgcaactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgactttgctgatctcagcatctcctctgagatagtcacactgccggctgtggccctctgacttt

SEQ ID NO: 58268 - DNA, 1032 bp, Homo sapiens
tttaagtaaatttgaatttgggcttcgttgaatagatgttggcttgatgatagttttagggtaacaataagaacaatatagtttttgttcttaaaattctccttttccttttagtcagagagttcagattcttcagattctgaaagcgactcagagagtgaaccacaacaagtttctggctaccacagactacttgctacattaaagaatgtttctgaggaagaagaggaagatgaggaggaggaagaggaagaagacagtattgtagatgatgcagaaatgaacgatgaagatggtggtagcgatgtcagtgtggaagaagagatggctgcagagtctactgaaagtccagagagtaagtgtctttactataggctcatcatctttgccagaactatagacagttcatctcatgagcatggtaccttatatactgtgtgagttggatgaaaggacatgaatccaaaatagggatttacccttgttgggtttgattgtatctttgagaatctgatggaaacacagaaccttcttagcacagctaggcagaaataacatttttgcttgtaatttcagggacttcatcagtactagtgaaagacctcctaatacagaggaaggagaacacagttctgtctttgtgactgtctgaatttattgaagaggttactgttcttctcttagggagaccaagtttgatggaagatagacataaatatatataaaaaatttcaaacagtagatttgcgattgcatggaacagctagatgtaaggtgttgaagagaggcagagtggttgaacactgccagtgtaaattagggaaggcttcagggactctgtgtcactcagacttgaaggtgacttttttctttaacttcaaaatcaccttcattgaggtatcatttacatacagtaaaacgtatccaatttaaatatacagtctgacaggttttgacaaaggtatacatccaaatcaagatacagaacatttccattacctccaaaaatttttcttatccttttgcagtcag

SEQ ID NO: 58269 - DNA, 1052 bp, Homo sapiens
tataatgatgggtaagagtggatttggagaccaacatcttcaaggagctatcacattttgacccaaggcaagttcatctgcttttttgctattcactattctagtctgctagagggggataataatacctatctcaaaatagaatagtttactaatacatagtgttcagtaaaacagtgttcattaaaacagtaggtactactgttgttcatttgtttgaaatatctgaggtaggtccacaaataaattatccagatattgggcagtttttgcttctttgttcttaccactgatgccattcatgagagttggtcatcctttttttaattgaaatttttattgagggaataattatagatatacatgcagttgtaagaaatcatacaaagacatcttgtaccctttgcccagttttcctcagtggtgaaatcttgtagaactgtagtataatgtcacagccaggaaactgacattgatataatctaccagtcttactcagatctggttttactcctgttcaactgcatatgcctgtgcctatatttatatacaattttatcatgcataggttcctgtatctactcctgccatcaagatgcagaacatttccagcaaaatacaaatccttgttgcccttttataaccatatctgcctccctctgcaccctgccccacccccatttctaacccctggtaaccactaatctggtctccatttctataattttgtcattttaaaaatgttaaatgactcatacagcatgtaaccttttgagattgtttttttttcactcagcatgattccctggagagtcatccaagttatttcagctatcagtaatttatttctttttattgctgaggttgtcctatttttagatcagcaatttagctataatgcaaaaattcttaaacttgtatcccacaaaatagaaaatagtattccttaggatttaaacaaaatggacagatttcttgtcatagaacttgtcaacacctttagtatcgagtgtacattgtcaatctccctcagaggaattaagttttgtgat

SEQ ID NO: 58270 - DNA, 1111 bp, Homo sapiens
caaaaatcaagcagcccattcacccccctccagaaagaactcttcttaattatgaattcttaccgggacctgttctacccggaaaggactgctctgaagaacggggaagagatccgccatgtgtattgcctgcatgtgataaatcacatcctcaaagccaatgcccaggtgcttggcaacaatagcagacgccgaagccagaagtttggagtgggtgatgatgatgacttcagagaccaagggttaacaaggcccaaggtgagtccagcaggaaagctttgctctcgaggaggtggctgcaaggcactgccatagaggtgcctgacacttagcaggaacttgggtattttaataattgactggcataatgaatgagcccaaatgtgagcatattaagtaggccaggtagtgtcagagcagcactgcagcagcttagtgggctgtttctgacagtggatgtagctggaaacttgcgagaaggaggcacttcatgacactttccttaaagataaacccagagtatataaataaaactccattataaatctcttctttgtggttgtcaaagctggatgggaccttaatgagccttttatccaatccctccatattacagctgtggacaaccccaaattcgtagaaattcatagagggccttgctaaagagaaccagggaaagaatagcagagatgagacaagaaccatagattctcttcactaagccacatacatacgtcagcctttgaaagcaaaaatttacatttgccactgtaaagttattgctgcttaaagtgatgcgtttgtattcataagtctaagctctagtggatttgaggccttaacaggaaatggctttcaattttatctacattattcatgatgttatagaaccaggacttgtccccctgccctgaactgcatctctccgtattgaagaagcctcatctttttagaattttctcattgagtttaataggattctagaaatttgatactaatgtggcctttagagatttcttagtcaaactcccttgtgtaatagcgggggaaaccaaagccccgacgcttactgtcaccgctggaacaataacccagtcctcttaaatcttgg

SEQ ID NO: 58271 - DNA, 1058 bp, Homo sapiens
gggggccactgctctacatggagctttttagctccacttcctcagcagtttcacctcaagatcctgttccttcctcttaccccactaaggctgctgttgctgtctgcacaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggtaattcttccttatcaactttgagacctaaagtgtgaaggtctacatagctggagaccagaagctggaattagatattttcccagtggatcactcactgtgcctctttaacagaaccagtgtgcctttgagacatgttgtttgccatgggagagtcttgccttggctaatggggtggacattaggccagtggagtcgggaggatctctgaggccatatatgaaaggcacatgtacatttataacagaaatttatagcaagtttataacagaagtgtgaaagcacacccatagctggtagcagatagatgctacaaggggttctctaggatgttggaagtgatggggctgatggggtcattctggggaggctgaataaaatgactgtctctacataaaggtggactttctcctgtgtgctacatagatgcctaccctgaataatctccacacatgacttccacccaaattttcacatttttgcttgtctctcattcagctcccattgactttggttggttataccttttatagagtaaagttcttggggaaatgttcattagtcacatatgctcattcacaaatacttattgagtatctacagtgtgccaggcactgttaagaagctgggaatctacagataaatatagaaataaaagttatagttcccattgctaaggaaatccagcctacgacagagcaggcagtgcaggatatgtgtgcaacgg

SEQ ID NO: 58272 - DNA, 1043 bp, Homo sapiens
cttagtgaggcttagtatatggtagatgttcagtgattatttgttgactgttggactgagtgactgagtgactgactgactgactgaatagtgtggtgtgtacttcctagagtaattctctgggatataatggtattacatctgttttttacaatgaatagtgttgacacttatttttttagtgtgcttatcaagttttatccttacataatctctttgagaggaggtaaatcatattggcctctggggaggtaatcttttaacacgagattgtaatttgctcagggtcacacagttaagagacaccataagcttagctctagacattaattttgccctttgccattccaaatcaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtaaagtggtgccaggtttcaagcctcctctctgaaggggaggtgcaggacaaatcatggcctgctctgaatgcatggcaggcttcgtggtgttgagatcatccctcactctcgcactcttacaaagtagccagagagtttttggtttggacagactcttcttggttggttagttggttttctcccaaaatgggcattgctgaagaaggatgtagaaaccaaagcataccctgtctatagacctggcatgtagctgtggttatacactgcaagaaggacattacaggacaactcaaatgaatacaaggaaggggagggaccttccctgtattcacttgagttgtccctgtctagactttttccctctgtttgccctcagtgcacagacaaaagcattgagaactgtgttttctggggagatggaggctgagtacagtgtca

SEQ ID NO: 58273 - DNA, 1094 bp, Homo sapiens
ggagtgcagtggtgtgatctcggcccgctgcagcgtctgcctcttgggttcaagcaattctcgtgactcagcctcctgagtagctgggattacagaattgcatcaccacgcctggctgatttttgtatttttagtagacgaggttttgccatgttggccaggctggtcttgaactcctggcctcatgtgatctgcgcacttcagcctcccaagaagtgttggggttacaggcatgagccaccgtgcccggccagaaaatgtacatgtattttatattgtagtatctgactctgtttttatattctctatgacagctggcaatgttaggaagattagaattcatttttgagttagcaaaaattttttaacctgaagatttgttttatgtggggaagattaaactagcagaatcttagaattggatgaacatttggtcatgattgccctcccagtgatgggtcacagctcttttccagtgcgttatcagtgggtttccacagcagggaggatctcaaccaggaggcaagtcagaaactggaggtgggatttgtggagtttggaaaggctgctgggaatttctgattactcccttcccctacaggagaatcccagttctagaagtagtagacttggtctttatggaccgtaggaaggagccagtctttcaagttcattgtggttgcctcatttgtctttaacagtggctcgtgaaatagacatgtggaaggtactgtaagggtgattaggctgtgtttgtaggagtcactgaaaacaaagcatatataagggaggaggaaggcagggtaaggggtgctcaagctatggagacttgccactaactgccccttggaagaggccctggccatgttctctgttgccaggagatactcagtctctattgtggttgcattgggactgagacagattttcatgtgtgtgtgtttaatataacacttaacagttttattgttttgtttttcctgattgtgagggtatttcacagttattgtagagatattggaaattttaggttaaaaatctcactgccctgatataaatactctttttggtaatttttttccatcttttttatg

SEQ ID NO: 58274 - DNA, 1968 bp, Homo sapiens
tagctctttgggctcaagaaaaggaacatttttgtataatagattatctgactttttcttattggtataggagcaatattctcgagttttatacattctaagcagaagtagaactcagtgttgtttttgttttgagaactagtgaggtagaacagtttattcaagttcattagccgttagaattccttctttatggaaaggatgttgaaaggtgaaccacataatagatcacagtcatggtttgggaaaggaaggtctccagagagatcaggatgagctgtgagggaaaaagacaaggaaaacttaccttctgtgaaagaaataaaatccccaagggagtctaacgtcttcagtgtatgagagaaacttaacaggaaaaatcagaagcttgtcaacatataaaatcttttgttatggaatcccacaggggaacggttgacgtcagcctgactgaaccatactgcaagtcagtcccttgggtgtacaccaccccccaccacagggcggcactgtgcagctgggaaagagatggaaatgcatacgctgttgaaactaattgctttctcatgatgcctagtgggtccttgggcagggttttgtaaatggatgaacttgggacgtctgccatggagttaacatgtatccagagtggcaagaaaagactaatgggagtgtatttacaatctgtacaacttattttatgtactgggtctgaccttgtctccattcttttttgcctgattataataaggctaatgttccattttaagtgcctgctttttaagttttctgtgacagatttttaaatcctggtctactattctttcccatgatacctcagcctacccagtgtaggatcaagaaatgtgtatttattttatcattttcttaagccaaatattaggaattcgaatatgttgtcataaaaagaattcaaatatgttgccacctcaagttagaataacttttgttctgttacttgtgccactgtttttctccattagcaggaagcaacaagcatgaactatgcctctgtacaactcctaggtagtttttctagaacttgtttctcaagttgacatagctctttctttccaattctgacaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgcttaaaatcacg

SEQ ID NO: 58275 - DNA, 1024 bp, Homo sapiens
ccccagttcacccccaccccgaagttcttagccttgtatccaaatgaacatgtgggcactaaagcctgctctttcctccttctatctttgtattaacactaaacaaactggcctttgtttctgaccttgaagagacagtaaaatcaacatcattctccaaaatatccctcaaagatgggcctataagaattcagagagtttagagaatcgctgcttagaagctttctcccctcaaactcatcccaggaatcttctcccttttactcccactcccaccctcaacacaccccccacccacacacacacacacaaacttcccaattcactgctagactgcttgatggttctctctggtgagagaagccagggtaacaaggaggagggaatgagtctgcaaatcaggtatatttttgaatttcaattctgtatccccagcatctgtctgctgttttatcaagaggaccagagatcatttaggaatgatggacagtcctctgaggaagcaatgccagaagcatgatgagcagaaatgctgaacaagatgctggctggaagggaaatcaatctcccaggccgattagtttgggtgggagccaacagaggctgaaacttgttacagctacagtcatctttcttgctactttttttttcttctagatcctggagtaaaatcagattagccttagcgctcaaggtagctaactggtctgcacatgccatggcaatgtctcaaaacagatgactattattaaaaaattatggagaaatgacatgatgcatctctccatttggtctgtaagatacttaaggacaggggctatgacctttcttctatgatttatggagtaactagcacaatgctgggcccaaaaggtcactaaacaacttgctgaagggaataggcttaaagtagacacgaaaggaactttcttttttaaaaaaataaaacaaagagactttgtctaatctcccagctaagaaatgaaagccagatgagtccaattcattatgatgcatagagaat

SEQ ID NO: 58276 - DNA, 1159 bp, Homo sapiens
tgcaagcgcagcacaaatagtgtattattctggacagagttcttatccaatcccctctctggtttattgtttagaataagctgagagcatagctcaggtgggtcagttgcaggttttggacattttaactacaaaccaaagttttacagtttatattctgcatttatattcattatagaatacattcgtactctgcacaaaggaccacacaagcatataccgttatttaatatacaatgaggaaaatcatagttgatatgtggtatgtcagggtgagagaattcagaatataagacgggtttttcctggagcctccctgacagcactgtaaggagggataggagaagtatacatagaaatccaaattttgcccccagtttgtagggtgtttatgctcagagtcctcctgtggtttttggatccttgatgtcattgtccaaattaaaaaaaaaaaaaaactatgaccaggctccagatttctcccatctgcagagatatagctcagcacattaaatgacttcccattgaccagcaccaatagaaaagccctacatagaaaatttggagaaaataaagaacttcatctgtgattatataactaagcctcagacataaaagaaggctaaatcaaaagggaatggcccctaagagagaacagtaaaaccctttccaggaaaacaaagagaatgagagcacagaccaaggtgggttgaatacacacttcctccctcagactggcttgccctgtctggctcaaaccaattctatttaaggaattcctcatttaagcctcctcagtgaaagggaaccaggaagatgaatgaaacagagttactaacttagggctcagtttagggcccattcaattatgaagagacactctaaatataataaacataaatgcaaatatcatgagaattcttacctctgatggaaggtaggcttgggaggcatcacagaggagagaagccattcgaacctttactttcagaatatatttttatatttttaatgtcaaaacaaaaattaatattttccaattgagactcctccatacccagcatattcccaagaggcaaacttttataagtttctgtttttagttcttgcgattatcaccatatgctaaataatataattctatcagctgggcacggtg

SEQ ID NO: 58277 - DNA, 1019 bp, Homo sapiens
ctccaaaggttaagtaacaagcacaggtttgcaaagacagtactaggtgacgctgagtttagaattgaagtctgactcaattcagaagcaatgatctttatgtaacactgtgttttaaattggtgaccaaaattggtattattccttgaatggtctaattagggacaaaactaaaagatgtctagagggtagtgacgatggtctaagtggattaaattggttggggggagttgcattagtagtttcatgcttacgatgtacagtgtaggtgtctgcataaggattagctataaaagagtttataaatgtaagctaggtgatcatttaaaggctctgactaatgcatgtgctttggagaagaatctttagatgagatggaatttaagacatttctaaagtagcctttcagtgtttgaccaagaagaaataagtagaacctgtaaattgtggtgatttaggctaatgatcagaataaacatggtagacaaaaaaatacagttgattttgaaaaggactcttagatccattttaaaggaactaaattttgaggtttaattccatttttgtgtacaggcatacctccttgcacttcattttgttgtaaattcacaaatttgcattttttacaaattgaaagtttgtggcaactctgttgaatgaatctattggcacaattttttcaacagcatgtgctcaccttgtgtctctgtgtcacgttttggtaattcttgttatatttgaaactttttcattattgttatatttgttatgatgatctgtgatcagtgatctttgatgctactattgtaattgttttgggcgctacgagccatgccaatataagatggcaaacttagttgataaatgttgtgtgtgttctgattgttccaccaatcagttattccctcagtctctcttcctttccttaggcttccctattccctgagacacaacaattaataaccctacaaatgttcaatgaaaggaagagtcacatgtctctcactttaaatcaaaag

SEQ ID NO: 58278 - DNA, 1064 bp, Homo sapiens
tgtccacctcggcctccccaaattctgggattaccaccatgagccaccgcactcggctagacatcacaacttctttttacctctttgactgtttctgtctcttttgctagcctctctcccctgtcagacctctgattatatcatgtaccaggggtttggtcctgggcttacttcgtttttccatcttttactctgtttgattttatctagttctgttgttttaaatgccacacaaatttataaatccagttcttggctgtctgagctccctcatcttttatcaaatgagttacttgatgtttctatctggatgtctgttacaataacaacttgacacgtttaaaatgcaagtcttgattttcttacctgagcctataccttcctcagttttctccatctcagctaataaatagcactgtctacccagttacgcaactcctaacttaagaatcatcctgtatttccccattattattgtccacatttaatttattagtaagttcaatcagttctacctgcaaagtatattttttaatttatcctcttttttttcatcctgctgctgtcattgtagtctagttctctgtgttttttcctagatcactgtcatagttttctaactggtttccctacttggcatttttatctcctttcactaagtattagtgattttcaaaaatgtaaatcaggccaaccactttgcttgttgaaatttttctatggattctcattatacctcaaataaaagtatcttaccctgatctacaaagacattatagtatcaactcggagtccaaaatgtcatctgaatatcatcagttcaaaagtctcattatctaaatcacttacattatgtatgggtgagactctgggtgtaatccattgtggttcaaaattcctttctatctgtggacctgtgaaaatagaaaccaagttaccctcctatgcatttcttcaaatctcatttccctaagttgtgtttcaattttggttaagtcagttttcagaacttacatttttataatcaatattgtttgcagtaaagccatattatatcataatta

SEQ ID NO: 58279 - DNA, 1030 bp, Homo sapiens
tagatatcctatatctgttcaattctgatagtttcttatcctaatacataactgtattagaataatacacttataagagagtacaaggtgtgagagatgaaaatttggagacaacaggtagattactgttactaaagctaggggagaggctgaacttggtgctgcttttccaaacttatggcaattaagggaatgtttctgcatgtgctgttcttttcctttgagttggctgatgtcactttatggacaaatggaaatccagttaggtgtttatattttactgtctacaccctcggattctccctttttgctgggtagacagatttgtgctttctttctcttccccctcaagtgcatcgtgggctcttccttcttttggtagtgtttcagttatttcttttgggaacatagtagaaaagtgtctgaaatgtaggtgacaatttttcatgtagaatttgtgaaggtgtagaactatattctgactttttgggggctgggataggtacagatttcttgcttagtgaccaaacttgactttcaaggcttttatagttctaattgtccagagtagaagaacaataaagtaacttttcttttttctagtatttattagagctagtatttagtagaaagagtacatgattatgaaataaggagatatggattaagtttcccaatttgcttcatccaggctgggtaactaaagtcattaaattctttgagtctcagtttccccctctgtaaaatggtgacattattaaggcttatctgtactaatctcacaagacttctctgaggatcaagtgaaataaagtgtatgaaaccctttgtagtcagtaaactggtatgtacatattattattatcttactgaagaaggtagggacagtcttggaacttgtagactcttactagagatgaatcagatgtattttttttttgtatgaattctggaaggcatgacctgattttttctattgtttattctttcagtggtttgacactcaggactttgaatgtatgagacctac

SEQ ID NO: 58280 - DNA, 1115 bp, Homo sapiens
gtaaaataatttttctcttattgttagatcaacatgcaaattctaaaatgagaaattctaaaaattatgtaaaaattataattgtcttacttttctttctttcttgtgactaaacagtatgtaatgaataaagtgctctttttctcagtgtataatttagttttaattattttaaaaaatattgtcataatatgattctcttatttatgccattttcgttttttctggttcttagcgtagatatcttttttttatatatatatatagctcagtgacttctagacactactgttaagggatattcttgaattgaggggaccaatagatttttgtaactgccctgttggtgtacattgtaagctttttttttcttctttaacctggctcaagaaatttcaattaggttgtgaatttatagagcctcggtagtagcagagaatagagctttagctactatgattaacatgacagtttcatttacaatttagtagaaggtggagatcatggagctatattttctttgattcgttctcagcttctttgaacttcttaatgagaggtttatgtgcacccagagggagggtgcctaccgcattgactcatgcttgttatttttaattttatattccaaattcaggctgccataaattaacatatacgctaagagtaaagcagacccccagtctttgaaggggaatgaagttcaagagataaagggaaagattatattatggaggtcataggagtacaagaatctagagtaatccaaataaaaatggagagcaaatgggtgatgaagactatgagagcccatcctgtacctcactaagttctcctttactctgaaaaagccatctaaaagtgtcattttcttcttcccttatttcttcctctaatggctgtatgagttggagttttgcaagtgtaaaactaaggtgtttacagaatgatgtctgtggaccaacttcagaaatttaaagcctgtttgtttttcctaacccttctgcattattcagttgagttatggacttaataaatcacattgaaatggaacagaagttcatttattgctaccggaacagaaagactagaatgttgtttatctgcctggccct

SEQ ID NO: 58281 - DNA, 1372 bp, Homo sapiens
tatctcctcaacactcacctgactgtacagtgaccgcactgtcccctttctccaggtagtaagcttggaaaatcatagtcatacagatgatctcattttttttcttcctctgaatgatcactcctttattgcccatcttcagtgtcttgagtgccattgtttcatacgctctgtcttgttttagtgttttcaggtggtgggagaaatctgtccatgttattttatcttaactggaagtagaaaatgtgattattagaatggggtcatttttggtatttaaatagactatataaaaatctgcagcagcgatttcaggagagactgggaaattacacaggaactgagagtcctggattagagaacaagatatggtgaaatttaagaggagacagaaatttgattatttagaagaattggaaattggacaatgtaggtttatgaataaaaagtaaaaacaaaatttattaaggtagagaattagttttatcttacatttaccttaaggaaaggcattctctagctgtctgctcttcagcctttgaatcattgtcttagaacatttcatttgatttctgaatgagattacttattaagttttaacattccagaaatggtgatataaatgtagttgcttatatcatctttcttcctttaaagcttaaagttaacagtgataaaagataatgtgtattatatttacgtagaagttaaatatattttatattactttttgagcatgtcaggggaattatagtatagttatgttaactagtagatatatggtgccatctaatggctaatatgaaaatatatttagtaaatacttcagtgctttgcctagtgtgtatatatgaaattttactgtgaaattattgttgctttagatgtccaaggcgtcgtttttatttaaactctaagatatatttatattttcatttcaatttatactttttaaaattcagctatatattggtctgacttttcatcacgtttaaagccatgtacttgcagttagcacaatttaaagtatattcaatataaaattagcatataaatcaattttaataaacaagtaaaaattacagacctcctgtttgctatcttttacttctggttccttcaaactggacccaatatgtagttataaattatgccttatagaacctcagctttattgtaaacagaattcattttccctccacctttcatctgtttttgtacattttacaaaatatataaaaaatgttagaatattgtattagattggtgatttttaaatgctgttccagattgttagggcttctctagagccactcagtctgtgatggagatggctaagtttagaaaattagcatatcaatggctctagaag

SEQ ID NO: 58282 - DNA, 1174 bp, Homo sapiens
tacttattttaatatatgcaataaaaaggttggttgtgacatacaataaactaatatttgagctactgttctgtaaaagatctgttaagtaaattatgttcaggtattcttctgttgtttatgaattgctgttacataaaggtgaattgtctactatgacaaaatgacattttaatttttcgtatgtaagatatgcttttgagcctataataggagcagatacacttgaggaagaaggaggtatcttgttactttgtgtagtgtacttccattgtccaagtagctctttagagagctttttttctccatatccctagaatgcttttgaaagtattcaccctttttctttacctgctatttaattttcagctaatgggtaattttattgtttggaggagttggaggtggttttacttagtaacttaatttatatataaattccgatgataaaaaatagtgttccactccctcccttggcaccatatattatagtgttactagatactaggaaagatgagggctgtaataccattctttctcctatggaaacattttccttggagtgttttttttttttttaattactacaagagttttaaaaattttctatttccaaagactggtttataaaaatgatagcagaaacaaattggaaattataaaagcaaagtgttaatttagaagaatgtgacaaaaaatagctgagaaatctggctttacttgtctgtgtacctgtgttggagatatgcttttctcttacatttgataacttaaaaggcgatagccccattacttataagactctattagttattgaattatattttgtgacttttgcattaagaaactataaatagtattttatacagttttaatttggttaagttcagtgtttctcatattccactccagttctgctttttgatcatttgtgcagaaagaactggctaaaagtatctctttactggcctttggtaattctctggttcagcatttctggtttttcctttgtttaatgacaactttgtacttttaaattttattgagtagtcccaaagagctttttgtttatgtggattatatctattgatatgtaccatattagagttaaaactgagaaaatttaaaaatattatttaccaatttaaaacagaaaatttaaaaatattattaa

SEQ ID NO: 58283 - DNA, 1232 bp, Homo sapiens
gaacttaatttttctgagccttgtttttctttcacttattaaataggaataataatatttacctcctagaattactgtaaaatcaagtaggataaaatgtgtcaattacaatgccttgcatatagtagccactcagcaggtgtccacacttcctctcccctattcttaccactatgcaaaattgtttagatatttctctttaatatttttcttaatgtgaaatgatactgggtagtttattagtaagatagggtagttcccttacgtagactgttaataagcaaactaaaagtacataataaaaatcctttttatacttcttttttcaggtgtagaataaaaaaccaatagtatttgagggaaaaatattgtcttgctgctgttataatagctgtggagtgagaaaaaatgtcataacgtttaaaccaagtggtttgattttttttttccggaagaatctttacttcaacatatttctttcaatgcataatgtatttacagaaagattaaaagctacaatgtgaattgctaatattgagctgacgaatagcaacatttaagtaaatgttaaattcaagttccaaagtggttgatattttcagaagagaaaattccattattgcaccttttaggaacaaggaattagaaaatggcatttttcagaaatttccaacagaatctgccttcagtgtcctctctagtagacacaatcagtagtgctgtagaggatttgaccactgctgttggggaggtcagctatgctttaactgactcagttgctgagcaggtaacaagtatgatgagtggctttcgcccagaagaggaaagctctgtagcagaagaagctgtagacacttctaaacaaaaaaatgccgggttaacagaagtctccaaaaacactaattgtcagaaaacacaagccaatttagagcatagagcaaagcaaataaatacttgtaaaacttcactaaagcaagatcaaggaatacatgaagaaagagtatttaaacatgttaatgataggcaacaaactctatcagaatatcaagacactggtaatactggtgattcttctttgaaaggctacatgaataatggtgggatatcagttatcagacagaatacaagggctggatctatttgtcaagaacttgaaagtactgacagatgtaaaacaattggagtaggaatttccaataatggtaagaatgatttaaaggaggtaggatatc

SEQ ID NO: 58284 - DNA, 1041 bp, Homo sapiens
agctatagtactggcaatacttagaacttcacttgtgtgttacttatactttaaaaaatgtaaattggtattataatttactttatatgtaacatggttgaaaaatccctgtgactaacaaacattatttatataatagaatatacaaactgatctttttccaaagcttgggcttcttatgtgaaaaaattgtatttttttaaatctgaaaattcaggttgtgtataatatatatgtgtgtgtgtgtgtatatatgtgtgcatatatgtatatgtgtgtgtttatatatataacttcagcaaattttctatactttattgtgtaaaaattatcatttgacgggcccagtagggccaggtgaggggagggaatttttttttcaattaccgtttgttcttcatgtcattccaaatagataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggtaagatgggctgttttattttttttacatgacacactatagtatttgattacttgtgcctgaaattctaggaatctgtggttgcagaataaacaagagagcacatacagtacagtcacatttctgggaatgtaatttattcaaatttgtatctttgggctcaggccaaaaatcaaaaccaataccaaaacaccccaaagcaaaaaccaaataatttacgtaatgtgttaattgtagctcttatttcacagtgaacatatgcttagcaagcatgatatgaaagatgtgaatctgctgttctctcagatggaattggtttctctatacctgttataggaactgatagagtttaagtctctcacggtgttgaatatgattccagtgtgtaaatgtatactgtctcattcaat

SEQ ID NO: 58285 - DNA, 1050 bp, Homo sapiens
tttgtgaccaacttatttcacttagcataatgtccccagtttcgtctgtgttacagcatgtatcagaatattcttcctttttaaagctgaataatactctgttttgtgcatgtgccatactttgcttaaccatttatccattgggggacacttgaattgcttctgtgttttagctgttgtgaataatgctgctatgcacatgggtgtacaaatatctctttgaaactcttctttcagttcttttgagtatggacccagaaatgaaattggtggctctatggcaattctatttttaattttttgaggaactgccctactgttttccacagtgactatactattttacatttcctccagtagtgtacaagcgttccaatttctctgcctcctaaccaacacttattattgtctgtttttccaaaataatagccattctaataggtatgaggtgatatcttactgtagttttgatttgcatctccttaattattagcgacactgaacatcatttcatgtgcttattggctatttgtatatcttttttggagaaatgtccaaatcttttgcccattttggaattgcattgtttgttggttggttgttgagttttaggaattctccatatattttggatattaatctcttatcagatatatggtttgcaaatattttttcccattttgggatggcattttttactctattgatagtatcttttgatagacaaaatgttttaattttcatgaaatccactttttgtattttttgttgttttctgtgcctttgatgtcatatccaagaaatctgccaaatccaatgttgtgaggctttttccctatgttttcttctaagagtttcgtagttttaagtcttatcgttatgatgtgatccattttgagttaatttttatatacgatattcggcaagggttcattttcattcttttacatttggatatccagttttcccagaacatttgttaaaaaggctcttctacattgtgtggtcttggtcccctgtcaaaaatcatttgaccatatatgcaaggtt

SEQ ID NO: 58286 - DNA, 1048 bp, Homo sapiens
attaattcgatttgtgtaaaaaatatatgagatgctttgaatgtagttaatttgtagttcatttatttcagacccttacatttcaaattaacacacttaaaaatttataagtttagtacactttaatggaggacatattctttttttgttgttgtttttgcgttcagataaaattaactttaaatacagaataatgctactagcggttttgaaggaatattctttcctataagatgaaggcattgaaaagagccgcctccagccatttcttatctctgaattaatagtatagttacattaataaataaggactttaaccaaatgaaaatgcaacttcttatcttcctgtactttcatttagaataacatttggagatatatttatcagaagtaaataggagactgtataaaaccaaatgaaatattagtaataaatgagtaaaatcatgttaaaacaaactatttttaagtctgtagggaaaatttatgtttctattctaggtataatatttttatgtcactttagaacttctaaatcttcaggaaattatcgttatatattttcattaattctcagaaatttaacaattttattgtatgttctgtttgtccttggaaaatatattatttttgtatcttgattatatttgatattataaatcacataatacaaagaaaattactttatcttaataattgctaacacattgaacacatttttcactaagtatttttaaattgctttatggagttatgttttttctttaaaatttactcatggctgggtatggtggctcacgcctataatcccagcaccttgggagggtgaggcagcaggatcacttgaggtcaggagttcaagaccagtctggccaacatttaggtgagatcctgtctctgctaaaagtacaaaaattggctaggcatggtagcaggcacctgtaaccccagctacttgggaggctgaggcaggagaatcgcttgaacccaggatgtggaggttgcattgagccaagatcacaccactgcacttcaacctgggtgacaa

SEQ ID NO: 58287 - DNA, 1167 bp, Homo sapiens
caaagtaaaaagaaattctggtctttgttgatattgagttgtcctcatagtattttaaaggtgataaaatatatattgttaaatttaattctagatttatctagtttggttttgtgaagttttctgaggaataccaattatctttttaattttgtcctcaaaaattgctgcattatttaggataattcagtgaatttaaagcaatggatttgaaatatctactctgtatattttaaaccagatcagccttttagcaggaacacttgtcatttcatttaattgtttaggcaattttgtgaataaaacaccctccagtgtcccctaaaagaaatctgaagtcattttcagaatcataatttagagtcataatatcatgtagtcagattagaaggaaatttttaaaataattgttttcttggcttttttctaacagcctggtatttctgtgacatgtttcagttggaagagttttataactgaatagtcacacctcttgatatcacgtactctttattttcttaatgttacaacagaaaatatagtgtgagttcatgacatgggaacccagaggtttcactgccctgccagtcatggttgggtcacattgaatacctctgcaacaattattttgccctttattcaacaaactgtttaaaaattgtgatgtagcaactgcatttcaagcaagttgctgggcactgcaggtacaaagataagagacagtttctgctctttcaggaagctcacattaacatctaaacagagatagaaaagttaatgttaaatgttaacatagtgcaatacattgtaaatgatggaagcaacgtgtgctgtagaaataagtacttaggaccacttaacccaacatgcatgcatagatggatgtgtttggggagagcgtggttatgtttggggatggggtgacaaatgcaactgggaaggataggagagagtgaatctttgaaattcttcaaagaggtaacaactaagctgattcttgcaggataatatgtgaacttacccaagtaaaaaggaggaggaagtgaaggatatcacaggccaagggaagggcatgtaccaaagagagcataaaagaccatagcgcattgaggaaattgccagtgtacggctgtgactggattgaggggtataagtattctgagaagg

SEQ ID NO: 58288 - DNA, 1029 bp, Homo sapiens
actcttctactctcctggtcataatagcttgctgtcatcagagcaagcttgatccttcaaggaaaagtaatatggaatattgaggcagccaaggtttctgcagagcagatcgtggcatagaacaagaattctttgtttccttaaagcaggtcagtaaatgtattcctgtccttgccaggtgaagacaacctgttaacttttattctttctggataaatataaaggaaaagagcattcgtaggttaaagctacatatcagataccaaagctgtcttaatttgctcaataagaagactccatctggagcaacaactgcagttgaagtcatcttctaattaagtttatgataatctgccatcatttttcaagccgactaatttttgcagtagccaaactagtgaaagcatttgtcaaacctgcaattctctaatctccgatggtagactagtctctgcctttcttttgagatgccgtgttactggagaaaggaagctctgttggttttcagctgtcctttcctgtaccatgcaggcactgcctagaatgccaaagtttggattccaccaattgctaagaatatacattctaattataaacccaagaactggaaaaataacaacaatgtcatttcttagcattatccttaggtatttgatgttacctgatgctattatatgtgagatttttaaaatttttgctttctaattgatcgagtgtagaaattcattttttaaaatattgatcacattgccagtgaatttgctaaatttaccaactcttagtagattatctctaaattattttgggttttctacatcacaatcatcatctgagactaatgactgttatttttctctttccaatcattttacatcttctttttctccccttattgccctggctaggacctttaatacattgttgactagaagtggtgataacagtcatccttgtcattcctgatctcagaggtaaaactttcaacatttcaccattaaatacgatgtttgctttaggactttcatggat

SEQ ID NO: 58289 - DNA, 1077 bp, Homo sapiens
taaacaaattgcccaagtgatagtagcatacactaaaatatcagaaccactgatacataaattgttttcccgaagaacattgtggatatgagtgagttgaagtatatattttggaataagttctgaggacatattttggtctgtttttttgtgtttcatcagatttttccatcttttactgcctttgttttccttttcaaatatttagcaatgtatgttccttaggtatccaaaaaaatagcttcaggagtagaattataaagaagtacaaatgaaattatagtaaaaatattaagaaaagtttcctttttagaaatcccctaccatcatttaatcatataaaaagccagagattacactgaataattatttgcatcagttaagattctgtcagtttcaagtgaatgcacaccaactcaaaatggtttaagcaataataaagacctagagagtaggcctttcttcaggcatgacagaagtaatattaccaaggtgctggtttctctttctactctcttccccgaccctgccttccatgcatcagctgcataatcaggtttcacataatggccgtcttgaaactccttgtgtctcactgagttgtgtgcccattccagaaccaatcacagtggctacagggatgggacgcactgattagcttatgccctggagctgctggttggtcggtcaccttccaaatcacattagatgaaagttagaaaggagttaagttcatggtaccaccactaaaaggaagtgatgaatggatgctagggacataaccagctaatgtctactgtaatatttatttaaactttcttgataataatgttcactaaacctttagtgattggacataatatacatgaaatcctattttaatcagtttgatgctgcatcagaattaggcagaattttctgcacattgcctttaggaaacttgaggtctatttcacacaatcagtgtctttctaatatgcttaattggctatgagctaagtaagccctgaaaacggtgattctcaatcttaattacactagaatgagttggagagtcttcaaagtaaagatgctcag

SEQ ID NO: 58290 - DNA, 1036 bp, Homo sapiens
agatgaaattgcattatggaaatatagtgatctatttttaaaacacttatgtgttagctcacgtaatcttatcacttgagaggacatgaacatgaatctctgttttataacggagaaaaatgagactttcagtagatcaattacttcccaggcttagggctagcaacaggtagaactactcctagctcttttgatttgtcaagtactttttgcactattagataataacactctattagaggagttttagtagtaaggaagagcctattttgagatactatccggaggaaaaatcaccagtgtatatctggttggtcatgtgagattaaaaaagagaagatgcccaaaagttggaaaaggtaatgcattagaagtgtaattttaaaacattgcagctagccaaaaaacaagtgccattctaatgtagggaaataaagatcaagttgctattaattcggtgaaagaatcagggaaataattactgaatatttaatcttagccagaaatgtctatattttgctaatttttcaccatgtgtcagcagcactgtaaacaatagcaattacaatagttacttggaattggatatctaaatttgttaaatattacacagttgggagtatattatattcatttgctcccgtttgtttatattttaatatcttgaaaaatgtcatatattatttagcgctatattcaatattttaccatctatattattactgtccaccagactactagagagttacttaagtgtaatactgtaagttttgacttaagtgaagactcaaaatattttggagaaactgggtcggcagggggcagcacagtcttacaatgtataaaatgtggtcatttgaatgaccattcagaaataagatataaagatagtgtagttcatggcttttcaagcttttcaagcattcagaccctttatttcaaatgaaatattatttataactcaaaaaagtaaggcagagaaaagtgatattttactaacaaatcttattttataatatttacttgtaacatctgt

SEQ ID NO: 58291 - DNA, 1046 bp, Homo sapiens
cctgcaaggctaataactgcacagcaagagcctgtggagggtacttacaattggagcaacagcaacatcacctgctccccagtaatgtggataacagtctcactgaagaccaagggggagaaagcagggacagacaactcagttgaatgggctctgtagttgacgtctgttttttctgcctagcattcatatctttcttatgcacacagtacccagattttggttgggagactaacctgcccctgtattatgctgaagcggactttattgcaaagccctagaattaaatctcatgggctctaagcagcaagttccaggatttgggtttgagcaagtaggatgctgtcttcctctttcccatgacactcagagctgccggcaactaggagggaaaagtctgccaaagaatgaagccaaatttgggaaacaaacctgagaaatggataaaggagaactggttcctagtaacatgggttgaggcctggatcaatgagtgcctgaagctgcctgtgtacaaactgtacaaagccactgctcactccagtaggctgtccctttgatacactcggtatttttacaaaccctactaaaacccagcctggctctcctttacgctagacttacagtgtggaggatggaaaggaggtgggatttggagcaatcatgctctttcttcctctctcctgaaattgcctctggtgatctcctccttacctagttccctggggctaggaaaggaccctgaggagggagccttgctgctagagatgaagctcatcattagcggcagctctaactttgcagcaggtgacttcccttgttttaacttcagcaccctctgtgatcgccccattttcagaaaagtataatggaagcatttcacatataaataaaattaaaaactgaatgctatcttccagacacagtgagaattaagttgcacagacactattcaatagataattcaattatagtaattatcattgtacagttcagtagtttcaccttaaaaaatattgaacataagtagttacaagtaagctgga

SEQ ID NO: 58292 - DNA, 1084 bp, Homo sapiens
taatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatt

SEQ ID NO: 58293 - DNA, 1021 bp, Homo sapiens
ccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaaaaaagaaaacccaatgagaaaataactacctgattaatatacacatgtttaaatgtaggacctggtaaagcagtttcatccaacctagcgaaaatgcccagggctgtttgttaaatcatttgcttgatac

SEQ ID NO: 58294 - DNA, 1398 bp, Homo sapiens
aagcatgctgcaaagcattttctaacgttaattttaaaacattgtctctgccctccaaagtgatggttaacagctataatttactaagatctagcacaataatttattacttgcttgattctcaaaacaatactgtgaggtaagtaatgttatcaacattttattgataaagaaactgcagcatgaagaggttaagcagactttcccaaggtcattcggtaagtaagtagtagaactgggattggaacccaggtgtaaattactctaaaacccatgctatgcatgttgcatttgcctccctgtttgaaaaaaaaactacttaggacattatatttatcaataatcccactcaccttgattgaatggcagaactaagggggaaaaaacagctggggaaagagaaaagactagaaaagaagatcagaaattttttttcttctcaggacacaagtggtggtacttttgtgtcattttgtagatgactttgatttgcaaagatttggaattgatttattctaccagtttagcctatacttatattccaaaagcatattaatcagttctgctccttgaccacttttaggaatccaaggtgttttaattgttacatgacccccttactactctatgaagggcataacctgtgtctagcccatatctcactcatatcagtggtgagacaaaagatttgtcttcctctgtcctctcattgcaatttatttatgttttattctcaattttattaagatttgtcaggaattacagctagtttattacatatgtctctcttccccctaggtaagtagtcaatgccttgttagtatctttctgtacccctttgcttatagtaggcagacagtaaatattgaattgaactaaattccctgtggaagaagccagtcacactattacatgagtcttagtttttatgaatcttgtgttatgtatggatttatttattccttcagttaatatatatttaagagtactagatatgtgccatgtgttgttgttccaagtgctacagatgcagagataataaattggtcgaagtctttgccctcatggggcctacattctaaggtaggaagatggccacagaatgggataatttcaggctagtataatgaagcattaagataggggcatgcatagagtaccgtgggatttagtagaagagtgcaacatggaattcaaaaaaatcttcctggaaaagataatccctgagttgggtcttaaagaacaaatacatgttagactcccatcaaacttgaggacacacgttctttccaagaacaaaatgtaaaataatggtttctaaactgtagtatccttaagaattattttgaaaatttaacttgggccaggcgtggtggcttacgcctgtaatcccaacac

SEQ ID NO: 58295 - DNA, 1030 bp, Homo sapiens
tttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcatt

SEQ ID NO: 58296 - DNA, 1029 bp, Homo sapiens
ttataattaaatgaaatccctggtttaatcagattttcttagtcacctctccttgcctatctaatgccctattgctgttccaggatcctgtttaggatctcacactgcgtttatttatatgtctccttaggcttcttgtgcctatgacagtttctcaaacactccttgtttttgacgaccttgacagttttgaggaggactggacaggtattttgtagactgtcccttaactgggatttctctgatgtttttggtttacaaacctattttcccatctggaaatattactctgctcagcatggagttatgagttttaaatgggttgaccgaggcaagttatccaacacttaataagtgttcatgtaattttattttcatcttttcatgattaatgaaaggacactcattatctttggcataaacagtcacttcatatgcttggggggcattattaaatcaaccatcttttttctaaataatattaatacctttaataaattttattttccagatttcctattctctagatcctttctaactagcttgacatcccttaatccatgaaatctgagcctctattcacttatttatcaagggttcaaacacaacaagggcttacaatatggctttacattttataccacttatcttacttattttttattttttagtcacaaagcaagtataaagattctattttaattatttataaactgtcaaacaaaacttattcatcctgtattactttgataattatttctaaccactgggtaatattttgctacagtagctcttaaactgtacaatacagatgatttttgtttacccaagatagtttcagtctttataggatgttaccatatgttgcataccatccatgcacatagatatccagagattttgaaagcaagaaaaaatatgttaaacttcagtgaagatattttttaaatgagtcagaaacagtatcctataatctttattatgaatgtcaatttttttcaagcttacaggtaattggatttcaaatta

SEQ ID NO: 58297 - DNA, 1018 bp, Homo sapiens
agagtggtttatggctcaagactgcccttaccgaaaacgaccacggatggccaaagaggaatgtgaaaagtttcatgcctgctgcttttaccaagaatgtggtggccactacctaaatttacccctttctgtcaatgctaatgttggaagtgcctccactgctgcctcctctccctccgcctcttcttcctcctcatcttcctcttcctctccccctttgcctttaccgagttgttcccgccaggtggattttgatgtaggtagtgcatctatttacaagagtgatggccagatacctgccaatgaaatctttgtcactaatgtcagatcacttggtgttcaggaaaaggccaaattaaatgatgagaaagcaaatgatgacaccaacagagatggtggccccctcagccacgaacctgtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatatttccattgccccccaaggagcctgtcactagctaagaaatttctacatgtttgccagttaattagggagttatttggtaagcaaatcaatataaccagcaaagatacctgcttcttctatatgatacaa

SEQ ID NO: 58298 - DNA, 1035 bp, Homo sapiens
cacttgtttagattataaaagcatgtgggtttttatatatgaactttgctgttgattaagaagcacaatgttaataaatgatgtggtgatcaataaggtttatcttaaagaatgtaaagactttaggtttttgaaagttattttggagaaatgggacttaatctataatagttactatgtatttggtctacattttccaaataatatctttaacttgtacatttgaaaagtgttcagagtggccctcctaccatccttccttccactccagccaactcttcctgctaaactgtattccagtttccaagtttactaattgacttgggcctgttcaaataatacttcacagaaaccaaatgccaaacggaggaaataagtaagccctcccagtttctccaagataaagctttttttattattgctattaatattaaatataggtctcattcatacagtgtatgagtaggatcatttggacaattgtccacaaagaccaatttttaaaacattttcttgtgttatagttaaatagtctagtaatgttttgtcctttattttcaatatttgataaacatttgatgttcaaaacttagctaatagatgcttgtatatgaatgtgttgtaataaagtgaggttttcttgatatatatttattaagatgataaaaattcattaagttttttaaattttaatggctattggctatgtttctcttttccattattctctctcctttaaaaaactcaaaacatctagaaactgtagtggatagtggccacacaggagttttctaaattaaagagtattttaaaatgccaatctgacaggtgtttcagaatgatcctagttcgtaagtttaagtttctattgattaagaagcacaatgttaatagatgatgtggtgatcaataaggttatgtctgaaagaatgtaaagattttcctttctggagtgtctctgaaaaaaattgtataacacgaagccataaatactgaatcttagctgattgcattatgaactgtcaaactgtgaag

SEQ ID NO: 58299 - DNA, 1025 bp, Homo sapiens
gtctaccatcaccttttgccgtgcaatgatccccagccctgttcctccctgtcctggctagagcttagaatgggctttggaagcccaagctagaggttgcatttctctcccatcaagaatgggaaatgaagaccctctgctgctgctttttatctgcagctagagcactaagaacatggcctcaaagctggctgccaggtacacaagtagccaggatctctgctaggtcccttctgtcctggtctttggcatccgaggtagacctagcctgtgttccagccgcctagctgtttgctgccagctcagtttcccaggacttgggcctaatcccggtctcacgcctcacatggagctggctggttcccgttagcatttcagtctacccctaatggcgagcaccgttgctgccaagaactcatgaaactggattcccatttggccccttctgatcagactcttctggacaactttgcctgcttggaaacaggcggcagttatgccacgtcccttggacttgtctatggctgctcagggaagggctgtgtctggtccgtatgttctgattcatgatatcccctccccccagcctgtagtgcaattggcttcaatctggaattctaggtaatgctaaccccttttggaatagctccttatagctatgatctgtgctgaacgaaataatcttatcaagtgcagaggctttcagagaatgttatctacctttcaaagtaaagttctcaagaacattctagaagatcacatgttttgttttttctccacagcctagctcaaggaataggagatttgatagatttatgacaaggcctttttcaaatgcattgatctggctagctttggtcctcaaaagaatgttctgccctggagcaggccggtcttatcagacacagctacgcaaatgggttggttcttgcaaatggtccaactgaccatagagaaaaataattagccaagtctttagttatgcctaagagtgtactttttttttttaagataggctctcactc

SEQ ID NO: 58300 - DNA, 1035 bp, Homo sapiens
aaagacctgacccctttgacaggcaggatgcacatgtgtggtgtatgtgtgcgtgtgtgtgtgtgtgtgtgtgtgtgttggatgcaggatggagtaagttcacagggaggaggaagcttgattggggttatgtctgtatcaccttgaatagtgatgggtctccgggagtgtgaactaactgaattgatgtttagatgctgttctctagtgtcatgttcatggcttaaagttttgtctctgtttctcagaaactctcagcgtaggcatcgggaaccttcgtgccaaggagccatgctgccccgatgggaactggcactttacctacttgcctcactaggcttccacttctattccttctatgaagtttacaaagtctccagaggtaaggccccaagcttttcagacctcctatcaaacaaggaaactcctgtcaaaaaaaggagcagaggtggaagattcaagaagatgatccaatagtgtcaagatgatgtgggccttgatttgcttccccatgtcttggatagtttgaatcagtgacctgagtccattgagttttctaccctaaacctaggtcttttaggtgatgctgtggcttgtcttctataattggtgggtttgattcaaaagctattgaaggccgtggaggggatttgcgttcagaattcaaagtaaactcttaaatttctctttcatcattactcctctgagacatattagatctgggttcgttttgtcttcttctgtcatttttagtgttgcctttgtctgagtgttggagataaatcatcatcaggtcacattccagcccaaaggaaggggaatgggggccctcctttattttagcggcagtttggcaaggagcactagtcactcctgctcacacccaactggccagcactgagtcccacgggcacagctgggaggctgggaaatagtctttaggttggtggctatgtgctacctaaaactttttttttttttttttgagacctagtttcgctcttgtcgcccaggctagagcaatggtaccatctc

SEQ ID NO: 58301 - DNA, 1014 bp, Homo sapiens
ggatggggcagtgtgccctgaggatgtggtgagccttggtctcgttcttctctgtctctattcccagtctcccaggcccctgggctgcctgtgacggctggtgggttcaggggtgcgctgggtggggaggtgtctcttggacagcttgggcagctaatgggcaaaggggacagatgtaaagatgtatgggagaactccagcatagttctgctcacctgtttccctggtctttcaggcagtgtgtaaagtagaaaggtggtagctgggattatggagggttcccttcttcttcccctagatagatggcaaaaatgttagttctccctttttctctctgagatcacactttctttaattggccttctgccctgggggcctccaacattttgggactccatgtggagttccagtttgctatgtctgcccactgcagagatgttctgtacaaatcagctttcttgcatatgtgaagacttcctaagtataaagtaagttctttgagtgtgaggatcattttaggggctgtggcccccaacaggctggggatcttttttccttccacgttattgtgactcactttgtctttttgatattctgggaaagtgacactaatggtatgtgtgatttattagcatagtttgaagctgaggaatcatgattctgtgtaatttgttctctagtcatctcattctattacatttttttcatcatctccaatttgtttatcaccttttttcattgtttatagctcttttttccatatgctgtgtagaaaatagtgtttttccaatttgagagatgtggggaaaataatacagttttgtgccttcaacttcaccctgaaacttaatatttctttttaagcatttgattccttctttgctggctttaggaggaaaggaaaggtgggaatatggcatagacagagcagggagacagaatctattcaagttaaaccgaatagactctgcagtcttgctctcctgcataatccaaagtgacttctgagaaaca

SEQ ID NO: 58302 - DNA, 1042 bp, Homo sapiens
tcagaataactgactttaagccattttattagtgtccagtttacatttctcagtgaaaatatctagttgtctaaactgggatagcctcaattcattacttgtactatccctgtgaacttgggtaaatgaattgagttccttacgtctctgtttcatgttttgcaaaatggaaataataatagcatctatactacagagggccctgggagatcagctgtaacaaagacactgagttgtagaaagtccgaggtgcatttggggaatggcaatggcaatcattccggttaggttggtgcaaaagtaattgcagtttttgccattactaatagcaagctggaggggagtgtacaggtgggtggggaaaggctagaagtgtgtaaatcctcttttacagagtttggactcacactggccttctttccagttttattaactggagtttgtgttctgactcagacgtgtactgaaatccctctgataaactattttgtcctatttaggatgcgaccgactttgagtggagcttctggatggaatgggggaagcagtggctggtgtggcttctccttggccacatggtagtgtctcaaatggccacactgctggcaagaaaggtatgattatatgtgttgttaccttttaagtgtgtttttcctttgcttcttgtgaagaaagagtccaagctaggaatcggaagacttggatattagcactgggagcctggaaaaaatgataaagttgttaacaatcaatataacatttaagataaaagttcatagttcatatcctgcacttgctttctccaacttattttcaggcattgaatataaaggttgtagtgtaaaactaaccatggagggtggtggtggtctttaagatcacttctaatcaaatgatcaaaaagttgcctgtggttgagaatctggatgagttcacttgcaaattcagaagaaagttgatgatttacttaagaagtgggaataattttaaagtcaagtagtttatgctgctgtcactgttttagatgggaagtccagtagca

SEQ ID NO: 58303 - DNA, 1049 bp, Homo sapiens
ttatttattatacacataatgggggtgaattgttgattgtctgcctttccctgttggaacagaagttccatgagaatgaagatgttttcccgttttattcactgatgtacaccaacagcccaaacaatgcctagcacccagtagctgttcaatgattattcattcgatgaatgaatgaatgaaataagaggtaaaacatggccaggcatggtggctaatgcctataatcctagcactttgggaggctgaggtgggaggatcgcttgagcccggaagtttgagaccagcctgggcaatacagtgagaccttgtctctacagaaaatttaaaaatgagtagagcttggtggtacacacctgtagtcctagctactcaggaggctgaggtgggaggatcatttgagcccctgaggcagagatcgcagtgagccaactgtggcactgcactccagcctggacaacagagtgagaccttgtttcacaaaaagaaaaataaggtaaaacattcacagacatagcaaagaagccaaaatggggacctggagggaactcattctccggtttggcttaagtgagaaaggaactttccatactaaaaagtggataacagaagcaatgctttgctgaatggttcatgacaaattctgttaattgaaaagtcttaagtaacgttctttctacctgtatgtgttcattcaagattccagctcattgacacaaagtcattattttgatatcattcatttagggtacaactttatttaaatgcagtgcaagttatttctttaaaatgtgctgatttgtaaaatattgtgttgttagtaaatagttctctgctgtccctaaacagctagtagcgggcggggatcagggagtggggagattaaactggagggaagagagttgaagaaagtaactggagacagggctaagctgggattcttcaggaggagtgacagaaaagtcattctgaggctgtcagcttaatgccataattgccttacataatttaatacataaatgctgaataaacaccaattaaagccttca

SEQ ID NO: 58304 - DNA, 1223 bp, Homo sapiens
cctctagcctcagctccccaacacaggtacttccatctcctaggatgctctctttccttcccctccacccctattcatccttcagatttcagctcaaatgatatctagtttggaaacccttcactggccctcctaactcaattagatcccatttgataatttattttgggtaccttgtatatgttctcttctgctatatttatcacagttgaaatgaaatttttgacataatttattccctcgctgaactgtaagcctcataaggtcagaaatactgtattcttgacccttatcccaattcctggcacagtgcctttttgaataaaagaaagaatgaatgatattttctgacttcactcactgagggagtttaagatgaaatagacttaggcagcaacatgaagaatatagattgaataccgaaaaaaactaaaactgagagttattgagtattgggggactatcttactaagcagcagcatagatacaaataggtctagtgatggcaaaatgctgttataatgctcagtgcacaaaatacatatacaggaaagaatggggtaaggaggaattagtcttcctggtagcctgctgctttatgagaggagggattgttggttgtgactcactgaggcacagagctgtaggaagctaacaaaaggcattttcacaaagcacccaagctgggtggacgtagaggagttactgctggagcactgtgctttttctctgtacaagtactctccagggagtgaggatttctgtttagcattgaaatattttaatcagaggaaacattttgaagtgacaccacttcatgccaattctcagtttgatctctcctttgaaggaaggctccttcaggctgcttgtcgattattcctacccaaagaagagtctatatctcaaatagttcacctactcccacccctgatttccatttcattgaataatttaaatacgttctcctctcccagcctggcctccgcctctttgccccaagagtgtcctgctgagctgatttatatcctttctgaagcagtaaaatttctatttatacacttaattgaggaaacatgcctccagtgaaaaccaccgagaatcagtctgatggtcatggcagggatttgatgttctggggcatcagagagaacccaaagactctgtggtggtggtaattcaatgtattggccatgttgattagtttgattttgaagatagag

SEQ ID NO: 58305 - DNA, 1023 bp, Homo sapiens
tttctcccattcctgggttgtctttttactctgttaatagtatcatttgatgaataaaagttaatttggtaaggtcaagtttatctctttttacttttgttgatggtgctttttgtgtcatagccaagaaatcattgctaaatccaatgtcatgaaggtctccccctgttttcttttaagagttttatagttttagttcatctttttagatacttgaacccttttgagttaatttttgtgtatggtataagggtccagtttcgttcttttgcatgtgtatatccaggttttccagaaccatttgttggaaagactgttctttcctcattaaatgctctttctgcccttgttgaggatcatttggccttgttgaaaactatttaaccgtatataagggtttatttctggtctctctattctattccattggtctatatgtttatctttatgtcagtaccacacagttttgattattgtagctttaagtgttaaaatcaggaagtttgtgtcctgcaactttgttctgctttttcaaggttgttttggccagttggggccatttgagatctcaggtgaattttagggtggggttttctatttttccaaagaatgtcattgggattttgatagggattatactggatctgtggatcactttgggtagtattgttattttaacaatattcttcccaactgggtgcagtggctcatgcctataattccagcactttgtgaggctgaggtgggaggatcacttgagcccaggagtttgagacctgcctgggcagcatagtgagactttgactctacaaaaaaaagcaaacaattagccaattgcaattagccacacctgtggtcccagcttcttaggaggctgaggtgggaggattgcttgagcccaggaagtctaagctgcagtgagtcatgattgtgctactgcactccagcctggagacagagtgagaccctgcctcaaaaaaaaaaaaaaaaaaaaaaaaattcctcccatctatgaacgtggga

SEQ ID NO: 58306 - DNA, 1006 bp, Homo sapiens
caaatgcattggatgtttgctacttgcgaggcactgagaacacagagatgaaaaaggaagctcacacgaatgtgagtgccaaacacacaaaaatgtgcagtagattcagggaattgctctgctggatgtatgagtgagttactggaggtcacaggatagagtagctgactttccacagaagatgggcttttcagaagaggtggcatttgaattgaagtaataatttaggagtttgctaggtagaaaaggcaggcatatcagggaaattaacactggctgctttgtgtgaaactccaaaatcttagtaatttctcaccatagaagtttgtttctctgacagttcaatacaaatccagtggctttttctaagcagtgactccaggacctagaatctttgttttgattctccactgtcttgtgctggcatcatggaggggaagagaacatgagactggtgcaccaggtgctcaaacatgtgacatttctgcttacatgtcattggccagagccagtcatatgaccaacccaagtacagggcaggggtgtgtagggaagcatgcagatatcagtgtgcaccagctgtctatggcacagcaggagaggcacatgggcctggtcagaaatgcccaagaggcagttggaaatatgagttggagaagatggtgggaccagtgattgagatgtgtgggggtcaagggcgtaaagattgtatgtgaggccaggggagtagacacaattaaccacggagctgtgtagaatgagaagagaacaggtgggagaaaccccagggaatgctggtattgaagggggcagagagaaaggcaggaagatcaaagtgtgacttgcctgacatcctatggagttaacctcagtcacatgggattgggctctgaaaacccggtctgctgctgcctcatgggaccagctatggtctgtgactgaacgcactatttgtgtcctccttggactcaggtgccacagccctgggaactctgattctataaaa

SEQ ID NO: 58307 - DNA, 1027 bp, Homo sapiens
agagttcatttagtccccacaagggcctggacaaagagcttgacagttggcataatacttctaccttccatttaaggatttggagaggaagcttgctgaatgggatggggtggtatagtacatttttacccctgcccagccctccccacttttgaaagaggaggattccaggaaaggggctgatgtttggccaacagcagcacactggatcgaagaggttgtgggtaaaacagtccccagggattggataacaagaagaaatcaagtaagaaatgcatttccaaaagtttgctggaaggctgctaaatgggctcagctttttaaatacttgggctatcctgtagcattaatgttgtaaccttattagcataatgtagcattgcattaatgcaatgagttgcattcatgaatgcaatgagttgcattaattgtacactagacaatttggtttctcaaccaaatggtcgtctctgtttccgtcctttggctatcttgtcatgtccagtggaggagccctttgtaagtatatgggatggcagcgcccattgctggagtcaatgcccccccaccaagaacaaacaccacctcattgaccatcttagttcttagagttaaccttaaacccacccctccatcagccgggaggagcacgttcaaccagcagccaagtgacagggacaggacctaccctcttcaaagcagcctgtcaggatattctctgggaaatggagcttcaatatgaatgacattcaaagtaaagaatttagtagaaatcaaataaccagcacttactagataatggtgccacatatcatgccccgactcctcaaagaggaaaaacatacatcctgggcaaatctgttctctcttggcatactttttctgaagtctaaatgttctgtcccatacctagtaactttttgtttccctaatctctctccagccaccagataatggtttatactggaaggctcaggtcactggtatctgaggcacatggtcctggctcgggaacccagagtggcat

SEQ ID NO: 58308 - DNA, 1078 bp, Homo sapiens
tgcatggagaagattctagaagactttcttttttttgagaaactatttaaaagcaagggctgtttatctgaaaaagggaagatttttggcaaacaggtcatgagaaatgtccctaaatctgaaccattcaatataatagccactaaccacacgtaactatttaaattgaaattaaagttaaataaaaaaaattgttcctcagttgtaccagcacatttcaaggactcaagagccatgtgttgctagtggttaccatactggacagcacatagatacagtacatctcaatcatcacagaaagttctattaagcagcattactctaagtacttgaagaatttcatgaagagaaaaaacagactcatcctgtgtatctccagaaggtgcagttatgttcagtggagaagacctagaggggaaatgtttccaacacctgagctggtcagtaacagaggaagcagagttagaaggctgtctaagaggggaaatatttactcttggttaccctattaggaatgctgtaggaggaagtatgaggagatgatttctgcagctattagacctcatgagtgtgccccatgtcaagtgctatgccatggcccagatggcctactgaggcatctattcatagctatttgcaacttcctccattgtttggtgataggaagtagctggtgacctggcagaggctaatctcagctccctttctcagtctatcttaatctgatttgaaccctccttgggaaggatggtaatttacaaaactcattaaaagctttcaatgaaattatgcctagtaaaagaatttatttctggaagcctaaaaatgggaatatattttctgaatataaacttggatggatgattgatgaggataattaaaaggctttgtattttaacccctatttaggctttgagttagccaagataacttgaacttaaacagaataaagcatcagttagaagttggcaacagtattttccttggataagccacaaagcaagtaattggcctatatgtttggagaagtctgtgtttgcaggtgtctttatgacaaaatcacgctttctcaaatgct

SEQ ID NO: 58309 - DNA, 1035 bp, Homo sapiens
tcttccagtagttgcaggagaagatgcagcgtgtcatacggcaaaattgttagaggtcatcgttctgcagtgcaaagggcgtcacgttgaccagtgcattcccttattcgtggaagcagccttagaaagactgccaagagaggttaagacaagtgaactttgaactatgggtatgcaagttgcaattgcagctttacattataatgcatacctattactaaataccttagaaaatcttcacttccctaataatgttgaaccagttacaaatcattttattagtggcttaatgatgttgactgtttcttggggcttcatgacagaaggatgtgtgttctcagtctctgtgctcttattgatatggaacagataccccaaggtttaaatcaggtttctggacagattttgccagcttttatccttttatttaatggattaaaaagagcatatgcctgccatgcagaacacaagaatgacagtgatgatgatgaagctgaatatgatgatgaaaccgaggaactggggagtgatgaagatgatattgatgaagatgggaaagaatatttggagattctggctaagcaggcaggtgaagatggagatgatgaagattgggaagaaggtgatgctgaagagactgctctggaaggctattccacaatcattgatgatgaagataaccctgttgatgagtatcaggtatttaaagctatctttcaaaccattcgaaatcataatcctgtgtgggatcagggtctgactcatggtcttaatgaagaacaaagaaaacagttacagacacagtaactctggccaatcaaagaagagcagctcatgaatccaaaatgattgagaagcatggaggatacaaattcagtgctccagttgtgccaagttctttcaattttggaggcccagtaccagggatgaattgagttatctctttctttcctactgtgtgattgtagtgaagagcttgtgttcctcctagtagtggttctagaactggttcatgttatctattctaaactaatg

SEQ ID NO: 58310 - DNA, 1057 bp, Homo sapiens
gtgagactccatctcaaaaaaaaaaaaaaaaaactgaattcaattcctaactcccaactcttctttttgtggtctgagcaagccacaggctttccctgagcctcagtattcctagctataaaaacttttttttttttttttttttttgaggtgaagtcttactctgtcgcccaggctggagtgcagtggcgtaatctcggctcactgcaacctctgcctcccgggttcaagcgattgtcctgcctcagcctcctgagtagctgggactacaggcacacgccaccatgcctggctaatttttgtatttttagtagagatggggtttcactgtgttggccaggctgctctcgaactcctgacctcgtgatctgctgcctcgacctcccaaagtgttgggattacaggtatgagccatcgcgcccagcctataaaaactaatggaattcttgccaggattaaatgatgggcatatggcaattattctataaacattaaaatttgtaattatgaagaattattctggatatattcacacctttctgatttggagctttcattgggagtctgtgtggttttttttggtagtgatagttatttccaaattatacctcagcagctacaattattttttaagttaataaacatacctatatttttgccccagtgggtagatttctgagtcaatatttatttcatagacaactatatacagttcgattaggggtcttgtgtttaagagccagacttaatgctggaacaaacttgtacatgccatagcattacattggaaagcattgatctgatcattggaaagcatcttttttgtttcaggataaacactggaacaaatttcaaaattttgagaataatcacttaaacagaataatattaatgtgattttgcatggccactggtttttttttttttgaagaagctatttttatctttattttttaaacaactttttttttttattattatactttaagttttagggtatatgtgcacaatgtgcaggttagttacatatgtatacatgtgccatgctggtgtgctg

SEQ ID NO: 58311 - DNA, 1058 bp, Homo sapiens
accattgataataatgtctttactaactagatttctgattattttctttccgttgttcactagatcttcccaacgtttatttagtgcctactaactgtacttacatcatgaggaacaatttttgtgtgtagaggctaattttttatcatatgcctttaatctaatatggcataataaccttggatgaactacctgacttctctaggccttagttttctcgtttgtaaaaggttgatgatgttaagtatatcacaagattaagtgaaaattaatgtgtgtaaagtagtggttttcaaaatactttacttacatatccatgaaataattttgaaaaaagattcacgtatttttagtcgacatctgttatttgtcactgagtttaaatagttgaaaaatataatctgtagtgtattgaaaatattaagtttgataataaagtctttatctgtattttaaatgtatccaattaaatataaatactacagtgatgtgatagtactagtttgtaaaatatgtagacaagcttctaacattctcaaagtttacattgttcctttttgtctttgaagtcatttccatgcattttctccacagaattttatcatatataattttttttgtgctttgaagtgctttattgggcccggcgcggtggctcacgcctgtaatcctggcactttgggaagccaaggcaggtggatcccttgaggtcaggagttcaagaccagcctggccaacatggcaaaaccccatctctactaaaaatacaaaaaatcagctgggcgtggtagtgggcacctgtaatcccagctacttgggaggctgaggcaggagaattgcttgaacctgggaggcggaggttggagtgagccgagattgcaccattgcactccagcctggcgacagagcgagactctgtctcaaataaataaataaaataaaataaaagtgctttattgatcacctgtgagtaaggttctgagtgttaaatctcttctggcttgagttattacaattagtgcataattgattaaaactctagtagttatggtgccttg

SEQ ID NO: 58312 - DNA, 1038 bp, Homo sapiens
ggtggaaggggagaatagggaatgattgctaatgggtaccggatttctttttgagattatgaaaatgttctggaattagatagaggtggtgattgtacaagttagtgaattcaccaaaaccactaatatgtacacttaaaatagagaattttattttatgtgaattacatatattgaatactaacatggctgcgctgggaacttctggggacattctcaccagattagtttgtgacctcttcccctcctctcccagaacaaataggaatattcattcagaaatgtcagtgaaattgatatgggatactgactgtagtagtactttttagctctataattcataaaggtacccatgaaatatttttttattatgcctttactaaatagtaaagatatcatcaaaattattcattttgtttatgaattaaacttgctgatattaacatgattttttttaagcttccagataagacaattgcaagccttgtaaaatattactattcttggaaaaaaactcgctctaggacaagtttgatggatcgccaggctcgtaaactagctaatagacataatcagggtgacaggtaggttggttaccttcatatagttacattgttagggacactgcattgtattgcttacatttcctaaggcagaaaagttatcacaacacattgtaaatattccttattcttacatttatgtttctactctgacaagaagagccaagtggttagaagttttaatattaagagctctttcacctcttttaattttaatcacaaatgcttccttttagtattgatatatttaatacacatatttagaatatattaaagaatatgttctatgaaaaaggtctttttataattacctgagtaactgaaacccttattattgaggctaaatcttttgatagtataaaatcattttgtttcatttttgtctgtctttattctccaatgaaatttaagtattatgtcaatttgtatgtgttcccatttcccaaatgatatttctttttaaatccctttccca

SEQ ID NO: 58313 - DNA, 1015 bp, Homo sapiens
ccacactaggggggaaaaacagaggaaaaaagtaaacaatcctaacccttaacagtctaaatggagactaataatattgctagtagagtaaaagttaaaaacttggtatagtttaaattcaggttgtatctcctagccttaggaaggtttcttaacttctctgtgccttatattcctcatctgtaaaactgttataatataagtagagtctgttctgctataactttttttgaaaatgtggatttgtcctaatgcagttaatatactctggaaaaatttgagcataacatgaattttttgtttgtttatgtatgatttttgtcagcaaaacaaaatgtacccagctgaactgagcgcacacacatctcaaacatgtagcagctacctcaattcactgtatgttatgaaccatacatatatggtgttaaaacttttcatctgatttcaagtaaccctcctaccacttgcataataattcacaaactacaaccattttgactcccacttccataagcaaccttcaggttttttttcaaggtaaagtactgtctttgttgtagcatttatggattaaaaacaaatcatttagattgtgtaaaactgtgttgccatttttattaggttcctgtcttatgtgtcattgaagttttttaatgttgtgtcccaacctcttttaccctacaagccctgtggtttttattatgaattttgcatagcacacactgacttttctttctttctttctttttttttttttttttttttgagacggagtctcgctgtgtcgcccaggctggagtgcagcggcgcgatctcagctcactgcaagctccacctcctgggttcacgccattctgctgcctcagcctcctgagtagctgggactacaggcgtccgccaccacgcccggctaattttttgtatttttagtagagacggggtttcaccatgttagccaggatggtcttgatctcctgacctcgtgatccgcctgccttggcctccgaaagtgctg

SEQ ID NO: 58314 - DNA, 1338 bp, Homo sapiens
atagatttataagcaaagtatacagggaaacaagtgggcattattcattctggcaaggacagttagagaagacttcttagagggggaatactgcagctgaggtttgaaggataagagggatttttttgcacatacagaaaggaccatagaggtcattccaggcagagggaataatagcaatggtttagtgttgaacagtacattcaaaaatataaatctagtaggggaaaattaaaagcacttttaaaaatgagtcaacaggtattccctgagcacttattatgtgctcattattgtgctaattaatagctattgaggattccatggaaatgtaaaacagtcttttctcaaaaagcatattgtctacttaggaaggcaaacttggatgcagagaaggaatgaacatggtatatgagagatgttagcagggttgagtaggggcatctttgtgatagacatcagtgggcagggtcagagtataaagtccttgtgaaagccagaaagagggccaggcgtggtggctcatgcctgtaatcccagtattttgggaggccgaggcgggcggatcacgaggtcaggagatcgagaccatcctggctaacacagtgaaaccctgtctctactaaaaatacaaaaaaattagccaggcgtggtggcgggcacctgtagtcccagctactcgggaggctgaggcaggagagtggcgtgaacccgggaagtggagcttgcagtgagctgagatcgcgccactgcactccagcctgggtgacagagtgagactccgtctcaaaaaaaaaaagaaaagaaagccagaaagagaagtttgtcttttaaattaagtcaaatggaaagaccctttagtttctttagtacagaaggatgtaaagaaaatttttaattttagaaaagttatgacattattatacaggataaattagaacagggaaacttgatagctgctaaaatattaagcatgtaagtcgtcaatgataaaggggtatcagtagggttgggtattagttataggaatggaagcaagtagtaaacccaaagaacattgcaaggtagaaaattaatatgtctccttgaaagtatgtgagagtgttgagggtgtcgctggcatgtcttctgctttgatttgttttggatggaggtaaatgggtaggtggaggaaagattgatgaatccagaaggaagaataagtgtaactgaaaaaagagtgctttttgaagctgtaaattccccatctatagttgttttcctgcaaaggtagacgacatcctttcattatggatgttgggtggaattttcagcatcgagtagaagatttaatttggt

SEQ ID NO: 58315 - DNA, 1041 bp, Homo sapiens
acatttcagattgaactgcaatcaaccttttattttcttaccatttactataaaatattttgacctgttttaaattgatttcagtaccagttatccttgggtaccaagggccttttttatccaccttccacagccaaggtagcatcagattgcctgtgcatgaactcagtgtgaacttccttagtgtaaagttagggtctcaattaacaatatatatcccttctgaatagagttcctcctccattcttgttacttcccttttgggggaacatatgtttacctaatttttcctatctcctttttcttttttaacttttttagatttgttgtgctcttttattactgtttctttatgtctctcatagtttttgtcctattctcccctttctcttttcctttttactgtttttcctttgccttatcaccaggttcctaaccttgaggcgtatccactgtctactaccttgcctgccctgctgtccctttttaatctcctcatctggaatacagtggttcgttttaggtttttctctccttaattctaactccgtttttttactttttcatttctcctctaacaaattttttttaactttgggtttttgtttcattcttcattctgagtacttgcacctccttacttttggtgagaaagctggtgttacctagaacctctgtgtgctatagaaactcttattgctaagaccataagtgaggtaagacctaaacgccccttctcaaaggaagccctctttctgttttgcccaacatgcctcggtattacaccaagccactttatcttggcagttccttctgcaaacccctgcatgctggtgtagttatttctgtccatctactgtcaaaggtccttgatttaccactcagtgggtatacactaatgaagtctgattagatatttgctgttgtaatattaccatactgaaaatcctaaatttaggatttttgtggggagaaatattgggggtgtctggagaaaaaaatattcttaccaggatcactttctgcttcagaaattttaag

SEQ ID NO: 58316 - DNA, 1506 bp, Homo sapiens
acacagtgaaaccccgttgggaaatgggaaactaatagactttctcatgttttgatatctctaattagagcataaatgcgaatgttgttccttcttgcaaattggtacatttccctttcattatctttctgcatgggtaaaaggtaactcagaatatatatttttaatctttctaaaaatggaatcttcatgaatcagagttgtagtaatctcatgtctgtgatttgatgaaaatttaaaaaaataagcgctttggaaaatgtctgtcttcatatcctcattaggaaacttctctttaattttgtagtcaaatcagaaaattaatgcccgttggaccacagaggagcagcttctagcagtgcaaggtatattaaagataagcagttattgttgttaataattatttaatttgtcatgaaaggtgactactctagttcttcccttcctttagaaattgatcaagaaagggctcttgtgtttatcacaaagtcctggtgaccaggaattctgtgttgtatttgtggatgtgacatactcaagtctatgtgcattttgagtcctgaacagcacgtaatgcattctcagcactaaataattgatggtgataattaagcatgaaaaagtcacatgggctctctgtgcttctcctttggtattcctgcagttgggttcgttcttactatatatcattcattaataactcatagttaaaagcatcaataaactatagatgtttctgatttctctactctgcaaaatagtgtttatctgataaatgtcaggattgaaaatattaactatatgtttaactttcagtgtttcatacttcccttaagagatgtaccactgaatgcttagaaacctgattttaaataggtatattttttaaaggagacttaagagcgatatcaaaaaatcacattcagcattttcaatgcactatttctaagaatgttttgttgaattatatggtagaagactttttgtattatgaatacccatgggcaaattggaagcataaacttggattttctcatgtttaaatgacttaaagacaagttgtatatttttattcattgttacagatttgtttcctcttcatgataaatttatgtgcaggtctgattgtacagtttaaagtttggtctacattttgtttcttcctggctgagcacctctgtgttgagtgctaatagcttttttttttaatctaggttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagagagtaagaattagccagccagcatgatttgaaaatgtcacaggagggtgccagcaggatgatgtcagcccttgctttggcctatgcagcatagcacagtcatttcataaagaattgatactatgacacaggg

SEQ ID NO: 58317 - DNA, 1042 bp, Homo sapiens
tgtgttaatggtgttaatgtctgttttatttattctttggatttttttgttttcatttttgggtttttgttgttgttacataaaataaaactatataaggctatttgtgccctatataaaatagctattttaaagagaattttaaagtgtcatattgtcttatgtgcccatgcatttatatagtggtcagaagtgtgtcttataaatagtataatcatgtagtaacgtcccctgtacctgagtttcagtgcagttaaggggcgtaattgcagggtcttttaatacacagtttactatctacaagtacttaccttagcaggcaattgtttttgttttttctttttttaaaaaaaaaagtatggtaaaccttcatactttagttttacaaagtaataataaactgttttgatattaacatgttttaatttgtatagcactttatattcaagacattttacacatatatttctgatttgacacttatttgttaaatgctttattttatctggctcatagtagaagactattacagtgacctgcagaaaaaaatattgactctgggcaactagtgagatttacaactttactattaaataagcttttttattacaactcttttgaaaccaaacatattgagatcatttcctttcgtagggcttaaatatgtatttcccaccttattttcctgttccatctactcatattgttgttaactaaatgttaaccatttaaataagtttcccttctttctctcttaatcagaagagaggggaaccatgctcagatcaaataggaatgtctgtttacacttttgtaatcagtcactttattatgttaattctagttctacctatgttgtaattttaatagaattcttcaagactctccaggtagggtatcattaatactgctaatttaatcctcttaaaatatttgccaggaaaggtatttctacagtttttatcatgtgttccaaccctaagtatctaaatttttattatgaccaaattttattatgaccaataatgatctttccatattt

SEQ ID NO: 58318 - DNA, 1071 bp, Homo sapiens
cctttctagctaaacataaaaaaaaaaaaaaaaaaaagattcagattccattttcacagttgggaaataccacataaattctcctgaagttaccacaatcttactagccaaagattaaaacaaaaaaattgtatggacagactccactaattcagaatgtctgataattcagataatggctatgctaaagtctctactgctaataaaaatatctttagcaagttaaaagtgttaacaagaaatgtttaaaaaagatgtttttgtgttgggtaatatagattcctggttggaatatgtgggctttcataaaatgtaatgataacagaatatcctaatgacttatatttttatgttaattcccaaataaaactttacatattaaagattataagatatcatctgccagcatagaaagccaagttgtttcattgtaactttcaaatgaaatttagaaatttgactgaaaacaatttttttcttcctgggaaacttactatttgcctgtttattccaccaacctttgaaaacgacctcttttcctagaagtgagactttaacaactatggttcaagcataccttttacatcttcaggaagagagattgacttaatcatatttaactcccttcctgagaaagtaatcagattttatcaactatgaaaaaataatggagtgcccttcccccagggacagactgaaactcgggtagctctgatgccgtaagttgttaaagttagttgctgcttatcactaccacctgctagttgtttcagacgcctcactggagattcttttaaaggagcagtctcattgagtcagttggggtttcactagagtttgcttagatgctagcaacagtatagagcttaagagttccatcttctaaccaaagtgctcttgagccatgctgttctgagtgtgaaggtgatgaagaattcagccatatatatctaatacctcctgtggtttagggaagaacaatagaatgaggctttatagggaagaaaaatcatatttccttatttcctaagcacttcctgtgtactcagcattgtagtaatgctagtgctg

SEQ ID NO: 58319 - DNA, 1002 bp, Homo sapiens
taaagtccattgaacaagggaaaattaagaagtggaagatcaaaaggagtatagtcagaagaaggggcacttatttaatggaatcagacttggggacaacttagagttttggaatatattttgcaaaataagtgttctgaggtttataatatctttagacttggagtcagagttagttttaatgtgacttcttcctaggaatacagtctaatcctagacttatttaaggttttcacttctaaactcgtgtattcagtaggtttggccattgctagaatgtaaattaagcgtcccttatgaaaattagtaactgatagaacactatatttggtttctaattagtagttattcttcactgcagcaaactcaaatttagaatttagaaatggcacagagactcacccttataagagttgctattttctaaaatgtaaaagtagtagagaagtacttgaatatataacagtaactcctgtgaaataaccttggatttttattaccaaataaactctcagtggaatctagtcactattagaatttatacttaactgtgaagttcaaactggaaatcaacctcatgggtttaaagggagtataaattcatttatgctgataaaacattataaacgatgtctatcattgttactttattgtcatgtacatgtattttcctttgagaacacagcaaatgagcatagcttacaaacccaaaactctaccttaaaaatgggatataattagaggataataatgtcagacctcctgtccagaatgctcttaaaggaattccccttagagtcaagcccagctagtttaatgtagtcagaaatgcttatttccaaattctcaatttaaaataaagcagaatttaaaagtgggattgttacatcatgatagtgctttagggtaattgagtatttcatattaattggtattggtaagaatagcatttctgctgggtattaacatatccatatattattctctcatctgtgatcatat

SEQ ID NO: 58320 - DNA, 1031 bp, Homo sapiens
ccatctctactaaaaatacaaaaattagctgggtgtggtggtgggcacctgtaatcccagctactttcccgaggctgaggcaggagaatcgcttgaacctgggaggcagaggctgcagtgagccaagatcatgccattgcactctggcctgggcaacaagagcagaactccgtctcaaaaaaaaaaaaagttggtgactatgtgtcatttgtaagtaatgataatggtaatagccagcatatttagtgctcacatgtgctgggcactgttctaggcactttacatatatgtgcctgtatgcacaggatcgaggcatacacaagacatggagtagggccccagcgcacctcagtcattgggaagttcctccagaggagagcagcatattttccacagggttctagaataggtcaagaggccagtggaagttcctgcagccttcactcccacctccgtcagctgagaactggccagatcagacttgtctgcaccagagcaatcatgacccaatctttccagcccatctctggggctgatgccctctggccctcctggggaaagcaaacattatgagagggcctcatgcagtggctcacacctgtaatcccaacactttgggaggccaaggcaggagaattgcttgaggccaggagtttgagaccagcctgagcaacaaagtgaggctctgtttctacaaaaaaattaaaaaattagccaggtgtggtggtgtgtgcctgtagtcccagctactcaggaggctgaggtgggaggatttcttgagtccaagatgttgacgccacagtgagctgtgattgtaccactgcactccagcctgggtgacagagggagaccctgtctcacacacacaaaaggaagaaagaaagaaagaagaaagaaagaaagaaagaaagaaaggaaggaaggaaggaaggaaggaaggaaggaaggaaggaaggaaggaaggaaggggagtagagaaagccatggggataagtggggaacagagggcaggaggtggtcctgggctgggc

SEQ ID NO: 58321 - DNA, 1875 bp, Homo sapiens
attaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctacttcatttgtgcatatggcctcccctccgatactaggcttagttacacagagagttggatttcagataattgaaagagaaatttcagtttaacacaaatgttgcaagtgtacagagtgactaggttacaagatgggtgtggaagaaaatgtaagcaaaaattgcaattaaaaattgaaagggtaacactgcaaaggctcactaatatgaaatactcagtggctttgaattttattataagcattaagcttatagattatatagttgtggttaacctgctgcttttggcacttgctatttttttatttataagcatagttactaataaggtttattaaatattttacacctgtaaatcatctaaaattcttaacgcaatagtatattattgtggttctatgagcctcaggactatcacaaatgtagtttcataaaaaaattcatta

SEQ ID NO: 58322 - DNA, 1027 bp, Homo sapiens
gcgtttgaaaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgag

SEQ ID NO: 58323 - DNA, 1665 bp, Homo sapiens
agaggaggaggcaggagagtggttaggagggtgaagaagcagtatcacaatgacttaatttagccctggctattatgtcctggctcattcccagaatgtcaatttatattaaattgctctgagcacatttttttaattgtactttctgaaaaaattttcaccttcatcaccacttaaaaagaattagacaaggatgtttatataaacactttaaatgtatttgatataaaatttttatttctttgtagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctat

SEQ ID NO: 58324 - DNA, 1150 bp, Homo sapiens
aagaaggaaaatgccgtaggatcacagagaaggatacagatgaagtgacaggattgagagtcagtgagagagtatcttgctaaatgtagtttagaaatgcaagggcagtacttcccctaaaacagaccctagcaatgctaccaagccccagcacaagatgtgccaatcttcagggattgaaccttcttagaaaggtgaaaaggggaaaagggaaaaaaggtaagttaacatctgcattaccttgtggacccagaacctcatgagttaaaaccaccagtgaacttatttttccaagtttttaagacctagccataaaggagtcctttcttttgtcttggaaacacatttttgtccttttattttaactgctgtcttaggaggactattctgttatgcaatctgactataatactgagtattttttccccaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcgtaagtctgaatgggggtcaaagcaaaggagaactaccaagtgggttattttgatgtgtctgaatatctctttgagcagaatattttatacatacagatcttattagaagcttttgaaaaatacttgagaaaccaaaatatgtattttagactttttaataatcaggcttgctggcaccttcatgttggacatctttctctgagatcagttgctagttatatattattgggccttaactgtgatggccctaatacgatagccttgtattttactctagagttacttttttctttttcgtctctactgtgaataccctaatgttttcccactgtaaaggaaggtcttaaaattgctgctttccataataaaaaaccatgacttttgtcttttgaaatggccactccaacagaattccaggtctaaaaccctacagtatgtagatgagatatgttcaggcaattcttttctttttttttaactttttatttttgaaaatgag

SEQ ID NO: 58325 - DNA, 1061 bp, Homo sapiens
gggcaacatagtgggaccctgtttctacaaaaattagccaggtatagtgacatgtgcctgtagtccaagctacttgggaggctaaggcaagaggattgcttgagcctgggaggtcgaggctgcagtgagccatgatcgtgccactgcattccagcctgggtgacagagtaagaccctgtctcaaaaaatataaataaataaataaataaattccctatttgtacactggataatttatatcatcccatcttggcaatgatttttttagaagttatatgctgtataactgctttggttttaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgtaagtatttcagaatttagctactttttaaaacatcttttatttttgttttcttgtttgtttgtttttgagacagagtctcgctctgttgcccaggctggagtgcagtggtgcgatctgggctcactgcaatctctgcctcccaggttcaaaggattctcctgcatcagcctcctaagtagagtagctgggactacaggtgcatgtcactatgcctggctaatttttgtatgtttagtagagacagggtttcatcatgttgaccaggctggtctcgaactcctgacctcaagcgatctgctcacctcagtctcccaaagtgttgggattacaggcgtgagccaccatgcccagccaaaacatcttttaatgttaagcattctgaagcagggaaattgagttttctgtttgtttagtaatatctagtagccaagaattgaaaatactgttatatttttccacatggaccaccagaccaataaagtctatatcagtttttgtttgctgcatgagttatgt

SEQ ID NO: 58326 - DNA, 1044 bp, Homo sapiens
gtaggtagtgtgaggggccagagtgcaaaggtcagaaggcatctggtggaagcggtgtgcaaagaagcctgaggggaggaccttagatctcggttaccttggcgatctctatcagagggttagagttgccgagaggcgccagctgccgcttcctctctcccgccctccgtttggcttagctcgccgggttctcccacaggttaaaagcagacgccgacgcggttgcctagtgacacttttcccaaaatgcctagggtattgttgtgttcttcttagccaatgagagaggcgaagcggcccaccgcctgccaatagactgcgagatcagggcccgcgacggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaaggtgagcgtgggacctaccctgcgcctgcccctgcttaggtttcgtcgcctcggggcgagcgccctgcgccaccgaagggaaccgacagggctgaggaaatgggtgcccggaagactaaaccgtctttcctgggtctgcatctgacagcctgtcctgggtggcttaaaggatgggagaccgcttcttttgatatatgtatttccatcttttcccgtttctctccccatttctctctttctcctgctttggcttgctaaggaccttccattggtgacaggtaactaattcctgagctgtttttagagctctaagagtggccctctcaggcacaagaaaggggcaggactaccagaacccgaagctttgtatctgcagtcagactccctcaaaatatccattattaggattattggattcatatttcccaatgtatataggtagaacttttacagaaagtaacattg

SEQ ID NO: 58327 - DNA, 1432 bp, Homo sapiens
atagctggttctattttttttaaacctagaaaaaataaagttgatttttttcaattaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgctt

SEQ ID NO: 58328 - DNA, 2958 bp, Homo sapiens
ttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttggggactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttctgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggttt

SEQ ID NO: 58329 - DNA, 2758 bp, Homo sapiens
ctctgtgcttctcagactttcccaccaaaagaatattgcctgacatttaactaaatgactgaacatcctgatttaactgcattttaaaacttcatctgttctaaataccatttctacttaaacccacaaacatgggaagacataattattctctgtagttattcatagatataaggtaatttaatagtatgttttcagcatctaacactggacctaaacatagtagactagtaaatgtttgaattaatgcataaattaactctcttgtgtaatcaacaatttttaataaccaagatacctgaaaagctgaagaaaccaacccttgttaaagcaaaagatgacaacacaattttattcagcttttcatcataagttgtggttctgaatgattttgacttctgaactaaatagtttttgttcttttcttctaacccttaataggatctttccaattaaagatgtacccctggagactgatgaccttaccacttggctctatcagcggtttgttgaaaaagaagacctcttatcacatttttatgaaacaggtacacagtaacctttaaatagttgctaaattatagcaacagtaatgaaagcctcttttaaagaaagctgtttgcatattagatcttgaaacttgaaaatgcactctgtaaattgcctgtgagaagcaaatcccctcatgaatcagcttaccctggggattatcagcaaggacaaagactgcttgaaatgctgatgagtgttatcaagatgaccttaggtaatattgctgtatgaagttatctagcattcctttccagaaacgaatttaaagacatctgtttactttgtatttcttttattattaagatacatttcataaagcatattgccttttaaaaataatgtcagtgttatacaactacttttttgacaaaaaatttgtaaatagaggaatcagcataaagtgtgctatttcagaaattatttcatgtcaatctcacataatcctgggtcctgatcactgtgggaatctctagggatccagcagagacaaggcagctagagtgcctgctctcatgcagattatattccagtgggagacatggcaaacaagtctgcagaaagaaagataattgggatcatgaccaattggaaaaagttccaggaaggagataaacagagatgggagggggaatatcttttctgatatggaaaggatgcacatgagccagctattcattaagtggaggaggacagcattgcaggcagagaaaaggcaaaggctcagaggcaagaaggggctaggtagtacagaaattgtatttcaaataaaatctctcctctggggcactggaaagtcactgaaggtgctttaacatgtacaaatgtagttaagctaatattcaacttttattccaggagacctaccattacagtaaaacaaactaatatttctatcttgtcttttaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacactgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattag

SEQ ID NO: 58330 - DNA, 1379 bp, Homo sapiens
tcagtaatttgtaatacctttcacttaagaaaaatctgatttttaaattttaagacatgcctctaatatcaaggtgaagttaattgaccttcctaaatatccaaacatttaaggacatttaaattggaggaaagagaaagaaacaattagatttcctgaatagttaatagttcctatgttgctccgagcacccttctgtctagaaccgtaatgtattagctaagaattgcggagctttattctgctcggagtctgccccatacatacatagttcagaggtcatcaattttaagaggtgagaaaatagagtttgcttttaagtatgcacccatttacttttctggacctttactttttagtactgctttgtaccaaaattattataaatataggcaccaaattccaatggtagtacttaattatagatacttatcttatgattcagaatgtttttattaatgaagattaatgttgaaatgaaaacacaatatatctgtattcttttttgaggggggttggggggacggagttttgctattgttgcccaggccggagtgcagtgatgcaatctcggctcaccgcaacctctgcctcccaggttcaagtgatcctcctgcctcagcctcccgagttgctgggactacaggcatgtgccaccacgcctggctaattttttgtatttttagtagagacggggtttctctgtgttagccaggatggtctccctacctcaggtgatctgcctacctcggcatcccaaagtgctgggattacaggcgtgagccaccacgcccggcccgatatctctattcttaaagagacttcatggatggatttccacgaatatgtccccagtcaggcatagcccagttagttaagaaacactactagccatcctctatacctaagtgagaaccttctgacttggtaattctccaatttaaaaatctttcagtaagaatcagtctcacaagttgctaatgaaaatataaattggtacaatctttataaagataatatagcaatatctttcaaaattactactacatttagcttttgacacagcaatttcacttctggaaatttatcctataaacttacatatgaatgaacatttgtataatgctatttgttgccacattgtttctaataacaaaagatgagaaactgtttatcagtagagcataagaggaatttaatgtttactgtgtattaagagattacaatgaaaattcaaaaatattgtttgcagaatgataatgaaaatattatctatcaaaagttgtgagatgtagcttaatctatgcataggaaggatttatagccttagaatgctaatattatagaaagtaagaaagctaaaaatcagtaatctaaat

SEQ ID NO: 58331 - DNA, 1991 bp, Homo sapiens
tcatcttcttttctctctttccctctcaactaagatacagtccattagaatgtcttttttagctttactttcacatttttcctaaatgtaactacttgttatcaatacaatataattgaatctcatcaaattcccttgtgtggaatactgcaagtcttctaacttatctcctgtggtcttttggtcacaggaaccagcagattttctttcttttttctttttttttttttttttgagacagggtctcactctatcacccaggctggagtacagtagtaccatcagggctcactgcatcctcgaacttgtgggcacaagtgatcctcctgcctcagcctcctgagtagctgggaccactaaatgtgccatcgcacccagctaatttttgtattttttgtatagacggggtttcaccatgttgcccaggctggtcagatttttttaaacagaaataagattataacacttccttgttcaaaactatccaaagatgtcctctccaaaactacttaccatgcataaggcttttctcatttggtctccacctccctctgcagcttcatttcctacccctgacttccttgtttatcacacttcagccacactggccttggtgctgttctttgaacatgccatactcgttcccaccaaatgacctttgtcctttttgttttgtcacctggaatattatggcttgcatcttcacatgacttattccctcacattatcagttctgctcaaatgtcacctcctcatagcagctttctctgaccctcttgaccctttctatccttttactgttttcttcctaacacatattactagttgaatttgcactccacatttaccatcttcccaaactagaatgtaagctccatgaaagtctctttatttcctcctctatgtctagtgcctaggacaatgcgtggcacatagcaggcactcagtaagtagtgactgaattgatgaatgactgcactttcaagggcaatcagaacaatttccttttccttcagaaagaaaggtttatttatataaatgctaataacttctctctttttacccctgtggtcaaaaagggcagtaagttggggtggggtgggggaatcactattctattctgtgattggattttaatttagaagctgtaatttctgtttaattttatggcattttaattttggatatacctgtacttattacgtgtgtgtgtaccttctagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattaggtatgatggtttttagcattttttaccttgttggagttaaaggattttctggagttacagaagatgatcattgttcttttttatatttataatttttgttaaaaataatagggagaagatgaaactgtaattttttaaaaaagtttccatttacaaaagtagtccatgcttataataatttactcaaataatacagaaatgcgtaaagtcaaagatatctttctcctgtcctacttatacggagccattcccaccgctgcagtaaacattcttataaacatctttacatattggtggaactatttctgtagtacagattcctagaagtggaattgctaggctaaaagatataactatagaaataacatgtttgaaaaactaatcttttcatttatcaaataatacatattttcatttatcaaattgagaaagctttttggttttctggggtttttcttgttgttgttgtttttgttttttttctgggttttcttg

SEQ ID NO: 58332 - DNA, 1193 bp, Homo sapiens
aaatcattctattaatttttaaatgttttatttgggacactacatttttatactttgccatgaagctacactcagattttataaagccacagtgaatgttcattaaatatatagtcttgtttgataacttaaccattttattatattgtttcaaaataattttgtaagttatataagaattatcagagactttggggtagaacaaatttgaaatcattaagtccaaatttaagaagttaattgagtttcattttttatatagtgatatatgtacctgtgacttaggattcgaagacttggaatcaagacctgtaatttttcatgtagacactattagtaactgtgctttgtttgtagaaatagagttagacttaagatattttggttaattaaaagtatgcttggatgattatatttaaagcttggagactcagctcaactatagtcaggtttcttctatccaatattatttcttgcttttaaatattttaggttgttgctcagatgatgtggttgatggatcatatttttaagtacacaaactttggaattgtttctctagttcatggagacttctttataagacaggtaagtaatgagcactttttccccgcagtgatagcctggtcaaattgattcttgattataaaaagaggtataacaaaaccaattataataggtagggctgcttctaaccagtcttagggagcttttttttttttttttttttgagagacagagtctcgctctgtcgcccaggctagcgtgcattggcaccatctcggctcactgtaacctccacttcctgggttcaagtgattctcatgcctcagcctttggagtagctgggactataggcatgccactacgcccagctaatttttgtatttttagtagagatggggtttcactgtgttggttagggtctcaaactcctgaccacaagtgatccacccgcctggcctcccagagtgctgggattacaagtgtgagccactggccactgtgccaggctcagggagctctttctcggaatctttgttccctaaccatttatttcaatctaaatttgagtatggataagtattaaaatacttaaaatgcaaatattctaatctctactcttctcccatttagaaggtacatttttagtttagtaaacattccccactattcagtttcttagctatgtg

SEQ ID NO: 58333 - DNA, 1642 bp, Homo sapiens
ctaacttatgaggtagtcttagaaatatatctgaggctattcaggcctagctagtagtgtagctcaatcgagttcttgctttaatcaatcaataaaaataatttaggccgtagtctgaataaaatattaactaattagattttatgtttgtaaattttgcagtgcttcaaagcaatttattaattcagtcacctattctaatgcaaaaatttgagtgccttctctgtgtcagatattgtgctggtggctgggagtacagtggcaaacaaaacaacatagttgctgttcttaagaagtttacatgttagtgtgggagagagacaacaggagtcacatcataaccacggaatcacatgtgaaaagggctatgagaggatgagacagaggacttgagcttgagactagtggtgccagggagggatgcccttgagaaaggaacactgaaattgagacctgaggaatcagtaggagttggccaggtgaagctaggaggagggacagcatgcacaaaggcagaaaagccaggcgcagtggctcacgcctgtaatcccagcactttgggaggccgagtcgggtggatcacaatgtcaagagattgcgactatcctggctaacacggtgaaaccccgtctctactaaaaaaaatacaaaaaattagccgggcgtggtggcgggcgcctgtagtcccagctactcaggaggctgaggcaggagaatggcgtgaacatgggaggcggaacttgcagtgagccgagattgtgccactgcactccagcctgggtgacagagcaagactcagtctcaaaaaaaaaaaaaaaaaaaaaaagaaaagcatttgtcatgtttgaggaacaaagggaaggccagtggctgcagcagggagggagtgagggggagaggagtttagtggttgagggaagctggtgaggccaaatcctttaaagctttgtagtgcatattaaggattttgaaatttatcttgaggaaaccatcgaagagttttaagtaagggaatgatgaaatcagattcccatttgtaattctactctgcagctttgtagaaatggactcaagagaagccagtgtgtgtggccaggagaccgtgtggaagattctcaccttatcaggtgagggtgatggttggtctagtgatgatggcagtggagatggaaagtgaactgattggagagttttataggagggaaaattgtcaggacttgctgagagattagacatggaggatgaggtagagagagaggtgacagggatgcccctgaggtttctggtgtgagctgctgggtagatggggaagtttagagaggaggtaactgagaggaaagattttaaaaatttaaaaatttagcatagggtagatgaaaaacatccaagtggagctgtgaaattgacatggatgtgcagtctggaacttgtaagggaaacttgagctagaaagagaaatcggcaaattatccatggtgtttaaagctgctatcacctagggatatctcagtacgaagtgacgagaggcccaggattaacttgtgagggaatgccaccatttggaggttaagagaggaagatgggaagagaagaagtggaaggaatgccagccttaagagtgtggggtcacagaagtccacag

SEQ ID NO: 58334 - DNA, 1105 bp, Homo sapiens
gtcatagtctgatcataaaagaaaatagtcaagaagtcaaacaaatgtaggaatgaatttggttgaaagcctcagctgagtttaaagaagcacatctaagcagaggttgatgaacaggtgtacccataaaataatgtcaggtgttatattagcctttctttagataatatatttcacttcttccctttacatcaataggagggtgggcttgtgaagaagttcttttttccctatgcccaagtttcacagatggaaaattgaacattgccaaaggaattctgctcagcagattaagtatgttcatgttttagaataaaaattgccaaaactttgttgagaaaccacttatgaggaaaccttaaatactaattaggaagctaaaaattgaatattggtatattggtatagaatgaatatatatatatatatatatctttttccaaattatgacattccgtgtaatatgagtgaattactcagctctgctgatgaggacttatgttgattatctaacctacacagccccatatagtagccactggctgcatgtcactgtttaaatttaaattaattaaaatgaaataaaatttagcatttagctcctcaggcacaccaaccacatttcaagtgctcagtactaggtggctagtggctactgtatggacagtgcagatacagaacacttctatcatcacagcaagtactactggacaaagctgatatagtaagcatggttttcttttcttaggaaaactaaattttatttttattaaaaaatctttccttagttctaaacagattttttttgtgaaagacaagaagatttattaaagttttattaaactatctcttaactcatcacaaaaatgagccctgtaaattcatacatgcttcttggatgagtaatggtgaggccagtaagcccaagaacttaaatgaacattcttatactttagtttgcattctcagagctggggaactgtctgtaggcacagaagatggaaaagggattttctggtctgtttctgactttaagttacacattttaaaaagtactctgaagacactggggtttgttcatccccggcttgctactaaagtagta

SEQ ID NO: 58335 - DNA, 1027 bp, Homo sapiens
tgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgaggtactacacccggaaagcttcgaccctcgctgttttattttgtgctgggggcgatttctatgttggtgactgtttagatgtatttaatgaattttcctttttaagtgaatttttctttcaccccagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacaggtaagagtgagaacacttttctttaatgcataagaaaaaatttgtcaggaaccatgattaaatgtatattacactttgggttgaggatgctttcatgtcttcactattgaaaaaaataaaaagaaaacagttctattgggtttctcttcagaatctcaggaagaccaatgttttcagaagtataatttcataattatgtattggtaaatttcttagtgtttttattgtgattgacatacatttattaaaactggtctgcaaaagctctggtagaggaataggagtgcgttgtataggactcgagagcttataaagtgaaga

SEQ ID NO: 58336 - DNA, 1050 bp, Homo sapiens
gaggctgaagagaagaaggctcttcaagctcaacaacgagcccaaggtgtttgaaaaggtcctaagaggcatctttgctgtcaactcaatccaagtcagaagcaaaagatcattgtgccaacagtcattgtggtagtgggtttcttaggaaactactgagatagaggttgtgtgcaagaagcttattgaggaatgcccttgggacccacacctatgggggagtgaagagagtgcaagggcagagggatgggttgaactgtggtgtagatgcaacagaggtctcaggccaaacccatgggacaactcttcacagttggcccaccttgagacaagggtgtaggaggttaggttatacttcctcatcaaccagtcaatggacacgggcttcacccctggaggaaacgtgaacttggaacacctgagaactggcagcagccaaccaacactgccaacagttgagggaatgagtgactggatcttgaagatgggatgtgtgggctcaccacagcaccatggcatccactgcaataattaatccaacttccttatttgacagataaaaaatgtccagagatgaaatcatatagctggtgaagagcagagccaggacatttctcaaatggtcactagcaaattcccttagtggacttggaatttggtagaggattcaataaatccatcaatatggataagaaggagaaatggtgattagatcaatggttcccaaacctagctgtcatcagcatcacatggagggatgttagaatacagattccggggctccattttcagcaatgctattactcgggggtctggggcaaggcctgtgagtctgtacttttttgtaagtaccaggttattcttatgtggcctgtctctcaccctgcacttgggaacaagtggctaagatcatagaacactggtcagatactagatttttaaacaatctacacttacagactattactgaatgatgttgctctggaaaatctcaggtgggtgcatggaggctcattcctgagttctgtcttattcaaaaacttcaaccct

SEQ ID NO: 58337 - DNA, 1550 bp, Homo sapiens
gtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccccttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtgttttgcctttttctcttcaaagtcaacattaattcaaaggagaatggagcttaagataaaaaataaaaaggggttgttgttttttttttctttcttgtcatgcggcctctgggactgagaagtgatttgcaacttgggtctctccaagattgcttgccttcatgagcacaacccattgtactgctaacagccagaacattctcataaaatgtgtaca

SEQ ID NO: 58338 - DNA, 1050 bp, Homo sapiens
attaaaaaaagtatatagcatttctataaaatgatcagataaagtaaaatctttttttaagagtgtaaccctagggatttgctgccttgggaactcaggatataggtaagtaataacctgaattaggctacattgttagccagagctaagatgctgaatctgtgcccatgaaatgccagtgttcgagataaagaatgttccttgctttagacatttatttccgattccctggtggtttatccacagtaaatgaagcaagggaccaagtccacagttgtagcagcgaagttactcagatgcccagattggctgtgtccaggtttattgtggcatagcatggaaggcagggtatcagtgaaggtataaaaagagagcattttattatctttggtggttttaggttaaaaagccaagggaaggtctggttctaaactattattactttcttaagccattactactttcttaactatggcaagttcctctcactttggcactctgtccactctgacacggctgagccttcattctcctcttttcctctgttttgacttctgtgccatacagcatggtaccttatgtagccactcaataatttgtgaatgatgaaaaaattatttactatatttagagtataactgttaaaattgggtatctgctgtcacagaaggttgtaatgagaatttacataatttatccctgtctgcaactctctcttcactttgaatttgaaacagtagtaaccatgattctctttgttacttgcatataatttctactgttaagaaaataacattcaaacctagaagctatggtcttctgcttgttgacctacctctcaagaggcattgattaaagtcaggaagctgatataataagccgagtaataacatgattactttgcagtgttattcacagtgagtttgcagcttaagatgcagccatccattcagggtgatcaggttccctaggcctatttctggtccttttaaggaagttctttggttggcatattctttagggaaataaaaactgtacaaaggctaaatg

SEQ ID NO: 58339 - DNA, 1457 bp, Homo sapiens
aacaccgcatgttctcactcataggtgggagttgaacaatgagaacacatggacacaggaaggagaacatcacactctagggactgttgtggggtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataatgataataaaattaaaaaataataagttaaaaaaataaaatagaaatgccttttttcacttagaaatgttttcagaaatttgcaggggttcaaagcagtagaggaaaaagaaagaaatctaggttaaacttatcccagcacgctgtgtatacagactgtcttctgaacgtgcctatgcgtttcatctccatgctttagattcatgccatttctctagctatgaatgtcctgtactttccatctctccaaagtttacccatcttacttacctactgatatgttcaagactctcttcttctgtgacattcctccatgttctgacctgttatttatatatctaacctgttattacatatctttatggatggtttggagcttatctgctggctttattgatagtccccttttcagatgtgtttatgtctctttcacctgtggcagtaacactgtcatatttcctggcaaccaaagagattaagaattacataacttgaagtcagacctgggtttgaattctggcttgccatttactagctgtatgactgtaggcaaactacttaccctctcctagcctcaattttctcacctgtaaatggaaataacttcattattttaaaaattaaatgaaaatatgttgaaagtacctgatacatgtaggcattaaatagccatgctattttgatggattaatgaatattgacctttacttcagtttccaggaatatggatctactggaacagcccatgctgatagtgaatatgaaagaagaatgatgtctgtatataatcatgtcttggaggaggtagaatcactcaatcggaaatatacccctgtttcttatatggcaagtggcatttgttttattgagcttttattgtatggatgtgggtttttcatacatttatggcacttactgtgtgagttcaacaaattaacctttctgtgcctgtttccttatccataaaacagggttaatacctacctcacagcattgtagtggggagtaaatgagataatccatgaaagtacttagcacatctctagctgctacgtagttatattaatatataaaaatctgctctaccagaatgcaaataaaattttttctttttttaacaatttaactgaagttgcaataattctcaacgcaggctacacattagaatcactttgagggctttttaaagaatacattaatatacaggcctcacccctga

SEQ ID NO: 58340 - DNA, 1780 bp, Homo sapiens
gactacaggcacccgccacaacgcccagctaatttttttgtatttttaatagagacggggtttcaccatgttagccagggtggtcttgatctcctgaccttgtgatccacccgcctcgacctcccgaagtgctgggattacaggcgtgagccaccgcacctggccgtgattatcttcttgatgatgttcttgacaattcacatattatggggtctttgtgaatgtaggcagtaaggaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctcttttttttttttttcccaggcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcaggcatgtcttaactttcagtgcattttttatttacactttagaggttttcgaagttataagatgaaaagttgtaaaatataaaatcagtggtttgactcagacattatcataaatgtttattcactcaactgtctggctaaaaaataggctgatgtgttattagaaagataaagtgattcatgttatctcaatgggtgctacatatttatataaagagaaaggacagatttttttaaaaacttgagaatgtttataactaaattattttagtggaacttgaagacgctaaaatacaaatgtttttgtttctatatgtcatatataataatcttgtgaacatgtatagtttcatttgccatttttgtttttatttaacaaagtttatgaaaatgaatggaatgacagtgaaaagatggcagtattttttttgaattgttattgtttgaaggtgcttttttttgttttggtttttgtgttgtttatacaataatgatagcatgtttgtttgtcataattgatttttttttatagatgaaacagtccatggaagaatttcgaagccttgcttctcgatatggagatctttaccaggcatcttttgatgctgactcagcaactttgaggaatgttgaactgtatcccaagcttgccctagtacttcttgttctttttggaagtattcttttaaatacggactacctcagatatgcttacctacaaaatacatgttaaataaccctataaatttattatatagtttcccctttaaaatatataagcagaataatcttactttttaactttacccaggattttaacaaaaaatggtgactcgaaggtgtcttttttatatccagaaagagcatccaaagcaacatccaaagccagtgttgcttacctgtgctcacttgagctacaacagacaacacaacacattttcccaccaaagaacatgtatttcacctcacctttctttgtggccaacagtcctagtttttatcacctttattaatgatctcttcagtagcattagttgtcactttttttttttttttttttttgagatggagtctcactctgttgcccaggctggagtgcagtggcatgatcttggctcactgcaac

SEQ ID NO: 58341 - DNA, 1039 bp, Homo sapiens
ggtattcacatttctccctgcaactatgccttctcccctggggtttctctcacccactaaatagttcatctagaataacataaaaaagtatttatacttcctgtattttgggctaaagttctagacttggtttatagttgattccatttattttctctttcggaactgttttagtaaagaatttcaagcattatgttacataaaagcaactcagcatattttctctgaggaaatatttagacagagtctcagcgaattacataatatgaggaatgattgttcagacttatccaaggtttgggtttctcttttagctgctgcatcaactctttcaaatgtaagaacctcaccgtgtgctccttctattcttttttcttttctttttttgtttttagggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagtaagtcctcttaattcacctttggtggtgatgatttatgtgagagttctctcccttctctttttggattgtcctatttcaactaacttgagaaacctgctgatatgaaataggtcatggaaataaacccttaaccttttcccctttttaacattcttagattgataaaagtttatcactttcttgttaaaaataactgggtaccacatgtgaagaggattgctgaatccatgcagaatgggtaagtggtgtgtagacaggatgctccctctacagactaagattccagcctgtgtgcatcagtaccaccatcaaacataaacccctgacctcatctcatacctggcagctactgactaagtaactaaagtttcttgctttatagataaagagaaattatcgaagattctagtgtcccactttgtatctctctgtgg

SEQ ID NO: 58342 - DNA, 1007 bp, Homo sapiens
tacagtgatggtgacatttggcctatatttgcctcttcagcattattccttatgatttccatctttcttaaaagtattttaatagtcttagattgaaatgagtggttgacgtgcagtcctaatttgttattttaaacgtagtgcacttcacaaaccctaatgtgagattcagtacctcatatttcttatgaagtaaaatgttatgcctacaagaaacctcacccttgagtttccccagtaacctgtacaaagctcttttccttaaagcttcatctgtatcttcaaaatgtaactagttcattttctttttggcgtgcagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtaaaaagcccattttgaatctcctttgaatgactaggatctggtctagtgggaattacttttaagtcaacattactatttgactttacttaaaaaacagaacaaacaataggttaaattcattacctaagaccaaagagtgtgctgatgtcaaaatagaattggctttatgagctttttacttttttcacttttgatttagaaagccgtgttttgttcacctctaaaactgctttcttccgaaaccctgtcaaatcagcctagtatagccaaagccttcaatctcatgtttttttttattgcaaaggacagaatgaaaatgaaatttttatctttcttatacagagtaaataatgaactaaaccctgttttgtactttagaaaatagaagttaaaaatctaatgataataatgaccataaattagcccaaatttatgttttccattc

SEQ ID NO: 58343 - DNA, 1257 bp, Homo sapiens
tgattccacctgtaaaaatagggtgtgttaaatcagatgatcccaaaattctttccagctctacaatcacgaattcatatgaggtataaatgtgtgtcagcaatctgagatggaaaaaaaaagcaaatttaaatttttttctcttttctctcctatcttgaaagtatggttttgtctgacaagaggcctataatgatacctgttttaatcagaattcatttgaactcttaggatagttgttttggcttttgtactgttagtcaatttttattaatattttttaagaaattatacgttgattttagatcttagtcattacgaaactgttggcacatacctatttcaagtaccttaatggagagaaatgctgatatgtattgatagtgggattgtggtaggaaattttgttgaagtttattgttagagacttttctcaaaaattaagaaaattgaacctatgagctgaactgcttttgaactatttgaattacaatttctactacttttctctgcttttttaggaaatgtgagttcttctcccagatcttctgatttagtcaaattagcccaagagtgctgttaccataataacaggggcattgcagctcatggagttagagtcctaactaatataactgtttcttgtcaagaaaagggtaagtttgatcaggactgatattacgtataaactttggtttagaccttggacagaattctgtttgatttttttttaatcccttatttttagcctgtgtgccttgatctacaaattgactcctttcaaagtgttcttagagcatgtgttcttaagactactttatccttgtgaaaaataataaagagatgaagaccttgggagtggaattgaaaggttttatggagcattgcccatttccttccactgcttacctttgcatatatggtgcatatatggtggataaagattgcttaggactctaccccttttgtataaggtggtatgttcacttatacaaaaacctagaaaatttacttaggttctccagggacttaaataacaaatagtttcacctagaggcaagtgaattcacagaccaatgtgaattaaattttcacagaatttactctaggtatatgtggcattaaactgacttgcataatcaaggaggacatgcaaggaaaataatgcacatattttgttgtctacctaacatcttttgacttgtgttcaagaacaagaaatgcattttggatattccatctgtttcagtgctgatt

SEQ ID NO: 58344 - DNA, 1046 bp, Homo sapiens
cgagttgctgggactacaggcgcccgccaccatggctggctaatttttgtatttttagtagagatggagtttcaccattcagcccaagctggtctgaaactcctggcctcaagtgatccacccaccttgccctttcaaagtgctggggttacaggcatgagccactgtgcccaggctggttgttttgttttaatgcaagttttgcggaacctctattgcttccttttgtagtcagttagtttgaattaaagaactgtaatgtacatttgtttgtcccttttatggccgcatagtatatgatactttctaggtgtagggaattccctgccacgtaagtcttaataggaagctaaaaagacctgatactccgttgtcacacctcccttccagctagtgtgcttacatgtggcttggactcaactaatcatttccatgccacagactgaattgggagccagtaacaacaagaaagtagggatatgagagaatggggatatggtgatgtagcaatgacagagcaacatttgtttccagaatatactctagcagtgggtgtttgctatgtctggtaccctgtaacagaagttaagctgtgacatgaaataatcagtaacaatggctgctgtgtcctcactggactaattccatgcatggtcttttgggctgtggtcttggttgctccctggcgtttttcttatttattttctgaccttgtttttctattagttttgcaggctttccagtgattctctgaagtacattatcagttatctattgctacataacaaaatcaccccaaaccgagtagcttaaaaccatgacctttttatttgctctaattatgtcaatcaaccattttgactgtactcaggtgggcagtcctattggcctcacttggggtcacttgtgtgattatggtcatgtatgaccaggattggatggtctaagacggcctcattcacatgctagaaattgaaaggctttctgctgaggcaccttagtttttatccatgtgactcttggtgggctaacttgggtttgttttc

SEQ ID NO: 58345 - DNA, 2036 bp, Homo sapiens
gttccatgttacctcatagtactttttacagttttggttttttatttgccataaaaaaaaaaacagggatatagttttattttaccaaatgactggttaattgtctttgtagttttgattaactggtatctttaatttaaaatgccattatcatatattaaattctagtatatatttgaatctattccttgccagtttttctggatgttttctgatttttatttttccacatgatctttaaaatcagataatctaaatcatcctgcagttttgttgacaattttattgatggtcatattaaatttattttaaccctttctgaaatgttatttttaacttttttccttagactttaagttttgcttattttctgaacctttatctttgtgggagaatggaaattaatttaacaaaacagttatttgacttgttatattacatgcagttatatgatacagaatcatgtgataaaggataaggcaagagtcactgtactgtgattatgtattcatagttcactgcattgaaagaaaaactagcatcttatttttggtaatacttcaaactacctggtcaagagtagagtaaatgccagaaatgggaggaagatagctctgttcacttagaaaccagatagaattccatattccctgttatttttaaaaattacacatatatgaaataatattcatatctctcctaagcaaaatatggtgggggtttcagaatagttttacatttacagaaaaatcgagacgatagtacacagggttcccacattcccccaccatttcccctattattgacatgttacaatagtatagtacttttgttataaatgaaccaatattgatacattgttattattaaccaaagttcattctttattcataattctttagtttttccctagtgtcgtttttatgtatcaacatagtttacatttagttatcctgcctcctgaggctcccctaaagagtttggaagtttgacctagtgctttttttgtttttttttttttgagacagggtcttgctctgtcccccaggctggagtgcagtggcgtgaacatggtttatagcagtctcgacctcctgggcttgagcgatccttctgcctcagcctcccaagtagctgggaccacaggcacgtaccaccatacccagctaatttttcgaatttttgtagagacaaggcctcactttgagcccaggctggtctcaaactcctgagctagagtgatcctcccacctcagcctcccaaactggtgggattaccagaatgagccactgcacctggcctcgatttaagttttttaacatgaaaaaaagtccttaatatataatttttctaaaagccagaaaatgtaaatggagtagacagtttagaagtatattgatgttttaacttctatattcatttctcttctgcattccaggcactttgtgagtgtgccctccagactccttatgacagcttaaaactagggatgttgtctgtcctttccacactatcagggaccatcgccatcaaacattacttcagtatagttccaggtaaggaaaagacaggagataccatataaataatgtgctaactcctttatccatatttatgtttcaggttgtttcttctataaagctttaacatcagggaaaaaaatctcatactccattgcatgctagtgatttatttgaacatgatttcttaactaatgcctatgataacaacatctcgcatccttgatcttaagtcaataatatatttttctaggtttgtccttttttttttgaattatatgtgggtgaaaatatttttgaggatgcttaaaatagttggtttgcttttgtgtatctctgactcaaagtgccctttgaatttaagtacatttcaaaggtcaagtagtagtgagttttaaaagcaaatgtcatatgcttccttttaggtgcatattatttctctggaaaacaattaaaataaaacttgactccagcccaataacactttcctagttacctattcaagatgattaact

SEQ ID NO: 58346 - DNA, 1182 bp, Homo sapiens
ggcgtgatggcgcatgcctgtaatcccagctactttgggaggctgaggcaggagaatcgcttgaatccgggaagcagaggttgcggtgagcctagatcgcgccattgcactccagcctggcaaaaagagcaaaactctgtctcaaaaaaaaaaaaaaaaaaaaggaattctgccctcaagggagcagagaaatgatatggtattgctaaagggtatgctgtttgtttgtttttatcctcggaggagtaaacttgttttttattgatggaaatgacctggtagaggggaagaattgcaacagcaatggccttgagtgggtgagactggaagggatccagtgtagaagtagataggctttctctagttcacatagaataggaaggaagaccttaagaagcctaatgtaggtgaatgagtaggtattatggtaaaaagttatagaaagtctcttgtgatggattttttttgggttttgttttgttaggtaattaggaaacatggtcattaggtatggttaaaaatggaggaggcaaagagaaaggttttaaagaaacacagaaattcaaataaactagggaaatagaggattgccatgtaagatatttgagtaaagcaatatataatgtggtgtctggcacatacaaataaatgcttttttaagggtagctgtaagttatattaaaggtaagtttattctttagtttttcctttttgaatactttgacagattgtagggttggggttgtgctgtcttaaaatgaactgggaagtttctctttctatactctggagtggttaagaagtataacagaattttctgtttctgaagatacaactttaaaagtaccacaaatttatctgaatgtagaactttttccagcgatagttgttttgagaacatttccaatcactacatgttattgtcctgtcagttttttacctcttctggaatcagttttggtcatttgtttcccatttaatttacttctcaaattcattagtatcagcataaagagtctttataacttctaatagctttgatttaaaaattttttttatcttgtacatttgtgtttatatccctttttcctttttcttctttctttctttcttttttttctttgagacagagtctcactgtgttgcccaggctggagtgcagtggcacaatctcggctcact

SEQ ID NO: 58347 - DNA, 1019 bp, Homo sapiens
tattattacacacaaaaaacctgcagtctcctagtttgaagtttcttagccctaaaggtctgtaacagatttttaaattctaagttgttatgagaagtctttatatggttattaaagaaatacttactgaatatccaccatgttcagacacttttctaagttccagaaatataggagtgaaaaaggtcaggccctgttgttatataaacacaaaataatttcagatgcttgttagtgttatgaaaaaataacactgtattgtggtaatggcctaagtgagctgctttagagcagtgttggcatagcccatttggtgctggagtttttgttttagttgtgtttcttaccacctcccctaacccgagcacctgaccttggaatattagttgcagtttggaatattgtatttcttctgcgctaattgtgttttatttcttttaagtccttagaaaatataagcaaatgtaagttttttctgttctctgttctctttttccaaagggattttgctgtaggaatctgtaacaaaatcagtgaaatgattcaaggtatgtattcttcatttagtattatgaagtgacttaattagatttataatagttgctaacactaattaagtacttattatttgctagtcaccatacattcaaataatatttattaagtatcttctatttgcccaaactgttctaaatgctgaggatacaggaatgagcaaaacaaagtccttacccccatctaacctacactctagtcaggggtggggtgtgtggggatagacaaatgtgcctatgacatttctggtgctatggtgaaaaagtgagagaagaaggatagagagtctcaaaagtaagtcgttggtgggttgagagaagggacttatctattttatatatattgatcagagaagggacttttttgtatatattgatcagagacagtctctgatgaggtgatacttgagtgagacatgaaggagagaaaggagtgagccatgcagatatagtcttgcattgctt

SEQ ID NO: 58348 - DNA, 2148 bp, Homo sapiens
aataattaggtgattacatgtcacattggaaggttatttaggatgttgactttgaagaaggttgtcattgtaggaacattgtaggttttgtttactgcagtgttttgcaaatttctaaaatgtatgcctttctgctgaaaggatttttcaaactactttctgtagtttataccacaaacaatagatttttttcctttctaaatgtatgattttattataaagtagactgtgttttccaagctttaccttctgcaccgttgttgattctggtgtgagccccaggggcgtcctcaaccactgctttcttgatcttgaggacatttgaaaatcatcataccaatatttactgatgtgggaaaaaaagattgggagctcttacttttttttactttgtgtatctgcttaacagcaaaaatgttgtattcttaatgctttgctgaaatggacttctttatgcaacattggaaaattgatattttgatgctttaataattcagaagtttccttcctgggctgtttggtacctgggaggtacttcaaggtgattgttaaaaattttgctttttagataagccattttaatttttctgacatattgaaatatgtaaaagcgtttaaaatttgagtcatggatttctaaagttatgctttattaactggagttacatagaattacctataaactttagttttgataatctgactttgccttgcctcttacttttctgaccttgactttattttatgcccgatcttcttgggtttctctgtttctgtaggatgttgggaagtctggcatcaataattcctgagaggaagaatgctcatcatagtattcgtcagagtttagattcacatgataatgtagaagttgaagctgctgtttttgctgctgcaaacttctctgcacagtcaaagtaagcttacaaaagtacatcccttttagtaatttggcttcccaagaaaaatttttgaaggaaaaactgatcaacttatataaacactgagagatacaggaaagtgtaaattacaaggtgtgttttccaagaaggtttaccttatgttggggaaacaagacttaaattcataaaatggaaaatgtaagtacaaatgttggcattaattgtgtaaatgaaatgagtttccagaaggacaggatcagcatagattagttggagaaggcttcattgggtagcagaagctttgttgactgaggagcttctcccagacatatagatctgtaatactaaattgcttacttactgtcttctaatgttaatttgttttgcattagagctgtccacagtttggcaaagacaataacttgaattaaaaccaattttaacctattcagaatgtcatgtcctacactgttgttttacagaacagtattttgttttgggcaggaggattaaatgttgaccatggttttattactatgtttgattggcttctcttctgtaaaagaaaatacagtatctccctgactgacaggaaaagtagcattgccttctggggtgcattttggtaatatgtatgaaaagccttaaacaagtacatccctttgacccaggaaattcacttctagaatttatcctaagataacagcaatatgtactgataattatttgtatggatgctggttgtagtgttacttgtaacaacaaaagaaatgagaagcaacctaaatttcttccattgagcttagataaattatgatcatacaatagaatacggtaacaacttaaaaccaatgtttttagaaacatatttggaagcaggttacataataggttatgtaatataacaggtttgttttaaaaaaccccaatagcttatataatgtaacagatttgtttaaaaaaaataaaagccgtaatatttgtatttatgcaatagaaaaaaagactagaaggatatatatcaaaatcttggtaagatggtatataatttttattttctttttataaatttctctatatctctatatcttggcatgagcaagttccagttttataaccaggtgaataataaattttttgaatcctgaaaagttaactttttttttttttttttttttttttttttttttagtatttattgatcattcttgggtgtttctcggagagagggatttggcagggtcat

SEQ ID NO: 58349 - DNA, 1514 bp, Homo sapiens
tttttaagagatgaggtctgactgtgttgttcaggctggtcatgaactcctgagctcaagcagtccttcttttcccagccttccaaagtgttgagattacaagcatgagccacctatgggttaaacgtgcttttttttttcttatttctaatttaattccatgtggtcagaaaacatacgttgtatgatttcagtccttttaaatgtgttgagatttattttatggctttgaatattcttaactcttacctttaaaaaattttttttcattattatgtatctaaaagtagcgatttccagattactatttcaatataccatttttacttttaaaagggtaatgaattatactttacctgcttcttaagaatgattatttctttactatctagtaaattatatttgctatttttgctttgtagccacaaatatgcaaactgttcttccctctctgtgcttttttttttccataggcctaagatctggcaaacttggtgaacagtgtgaagcagttgttcgctttcccagactttttcagaagtatccattccctattcttatcaattctgcattcctaaagttagctgatgttttcagagttgggtaagtctttttaaattctcgatgtcctaaagtactttgttcatatttcttgttttatattgtggtctttttctttttgccttttagtacttccacctggttagttaccattagtggacacacatgactgtgtgcagcacatcagtgtgagatttaatgacatttaaagcaaaatgaagagtataatttagacgatacttatttctttggagaacagaataaaattaagacaaccttaatattttactgtgtacttcaggaaaatctgtgtctttgtacagattgtttttgagaagtttctgatttaatttaataatttattttatagcatgagatgcatgtctgtgaagtacctgaaacatgtaagcactgaatacatgcctatttgctttttctcccccgaccattccatcttctgctgctttctgccattctccatgcactcgtgctcatatgcacacaataccacactggaaggagaaaagaagttgtggaataagcccaagagaagagaaagaccgtctgatttcctggccttggttataatatagtttgaggagatttagttctgctctaggtcttctccttgtgtcactgccattttggtgtcttgcagcaagactgtagcatagctcactgcttatgcttaatgtccacctaaagtacaaactttaactcttttagtagttaaacaaataatgttaagattgaaaaatatttgtgtgttgctaaaatttaatattattagtgttgctttggttcctaattaaatattactttctaaagtgacctaatttatttctggtttttctagaaataatttcctgaggctatgtgttcttaaagttacccaacaaagtgagaaacatttggagaagattctaaatgtggatgaatttgtgaagagaatt

SEQ ID NO: 58350 - DNA, 1004 bp, Homo sapiens
ctcaccatttctcaggacgccaagctggggctggcggagcaccgaattgaagagcatcagggtcggaggaaaagcctcagctgagagaaaagtcgtagaaatgcctccaagttcagcagaaatcgcagcttgcgcctctcacaacacaaatcgttatcgcctccaactcccgccactgtaagccccggccgccaaactccgcgccaaactgacgtcacgctctctgattggcttccgagcgacgtccgggcgcctcagagtcatttcccccttcggatccccgcctccttttctcccagccgcgggaacctggagtccaagagctccttgagcgcctgcgcagggggtagcagaggcgcggacaaaccgcggggtgaccagggcgcatgcgtaacagggcttgacagcgcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggtattcgaaagagagggctgaatgggtgaaacaggcgtggggggaagtggcgccaccaggtggtggttgctttgggagaagacggataggcgcatgcgcatgtcttcgctgggcggggagcgcctgtgcttttgctggggcgtgggctttgaccccttcgggaggttgcgggaaatttgcaggattgtgtgactggccttataccggctaaacaagtagcgagctctagtgagaggcccgttttgaccacttgagggagcagtcccccgattttctaagcagtgacagtggctagtttctaagagacactgcaaagaaattgtgaaattggttttcagtctgttcagttgagaccaggtcttcatgaaatgtgctgaatagtaatcttgcaccgacttga

SEQ ID NO: 58351 - DNA, 4264 bp, Homo sapiens
gggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggtgagtaacggtcccaaccgctgctcggagctggcggaattcatttcccccgaaacacacgccacctccgaccagggccgactccaattctgaactcagcttctgagttctcccatggcaagggtaaattagtgttagcagggactactaaagaaagctgtactttcatcccctcgggacacttgtaatcgtaatcgggcttttaaaatcgtaacgtaggcagggacgtcgaaataactgccttccaaggccccttacagcttacatctccattgcgcgttaacgggaaaatgcatgcatttgtgtgtatatgtttccttcaacggttatttgagatgctcaaaactcctaatcattgattaattcattcgtttgttgtagaatcttagtgagcccagctatgtgctataggtatataccagtgaatatgacccgctgttaaggaactcagtcaagcagagaagacaggatatctgcttctaacaggaacaaaatcttattttccccgtttactacacggtcataaaaatttaaattatagagtgaaagatgcctgtaaccacatccgccagagatgacccctgttaatagattgaagtatattattccagatgttttcgacgctagaggtaatacctattattttcagaaatcggatcaaaacgtccagttttttcactttaatggtataagttgaacgtattcccatgttaatacgtagaaatctaacttattttcttacgctaaaacattggcaataagagatttgaggttagatttggatgtcatcaacttaaactttttggtaagtttcagataagggagctaactacccagattaaccttggacagaaataaaatctcactcatgtgaaggtcgactatagccagaggttctttttccccttgaaactatgtggaaaacgaacctgagaagggaatttttatattcagcgatgagtctaggaaaataatattgagaaagagactgagaagtagtccctcaacttcctgctagcagtctgaaactttataccatccttatttatttccctcttagataatctttgtaattatacttaaatgctcctctttctgtctctcctgggaccttgtttgagtaacttctttgtcctctgtttaagagtgacagtacgcacagtggctaagaactctgtctttgaagttaaactgcctgggttttattatacttccacaccttactatatgtgtgttctgggggagctgttcagcctctattttgtgacagattttctcctaattctccatgtgtttacctttcccttccctctttcctattctcaagtactcattcgttgttacataatagtcactgaaattcattcgttattatatgaaatctatagaatcatctcctttcctcttcagtgttggtgttccatccttgaccccttttcttcttctacctactcctttggatgatcacagccacaaccagggcttcttccacttctacatacatacaaccttctgttacttatatagtaagtcctcacttaatgtctagataggctcttggaaactgtgactttagggaaaacagtgtataactaaactaactctaccataggctacttgatataaataagaattgtttcagtggcatattttggtcacacaaacaccaccgaacttctaaagaaagactcaaagtacttttaatattaaatgttgaaataattgtgtgctatacatatatttgagaaagattaataaaaacaggtgagataattatccaagttttggtgtatcagcgagtgacctcggtcatagtggtggtgggctaaatcaaggaataaatgtttgcaaagtgaaaattggaaggagcacctcctaccaccacccaggtcaaaaacaatcacaaatatggcagctcactgagccctttcataccaaatcgtttattgtcattcatttgtatgattattgtaaagtttacccatttttattttacaatgatttgtattcattcattttctgacacacttattccagctcagggctgtgggtgcccggagcctatcctggcagctcatggtacaaggtggaaaccagctctagaccagacactatttcatcacaggaagcactcacacacactcattgtctactgggaccatgtagacacaccagtgaacctaacatacacatctttggcatgtgggaggaaaccagagtacctggagaaaacccctatgaacatgggaagagcatgtacaaactccacacggccaatggcctcaaacaggaattgattttttcctcatgaacagtataacgaaatgacattgtacaaaattatgttattggaagacttcctgtacctgagattcatttctataaaagctgtgtgggttgattagcacctagacggtcaatcccacaagcatctcaaactcaaatacccaaaactgaactcagcttttcccccaaacctgcaatattaccaattttagagagtggcctcattatttaaacctgccagaaacctgagtaaattaaagacttcttcatcttcctcacagttacacattcaaaacatttcgttaaaatctcttgaatccatcctctcttctttatctgttatgattatgcatctttactgtatgctggatgtgttctatttttactattccatttccctaggttgggccctaatgccttcttgtctggattgtaagaagtctcccagatggcctcctagtttgtctgtcttcggtttattctccacattgctgctaatgatccttctaaaatggaaatctgattactcttctgtgtatttttaaattgatatctaaaagtttttattataaacttaaacaaatgcaaagaatataatttctgaccatattgggaatattgacattttaaaaataaaaatgctatatcactcctttaagtgtatctaatataatttaaatactatagtgatttgataatcacatcatccattttttagaaaaatacaaactcctctttatctgctggacattccatatagctgctttttcctcttgaatttatttccatttcatttctcctacagaatttctcctaatgtaatttaattttatgcttgaaaagctcttttactgatcactctgtcatacccttctgtgtcaaaaaatgtgtttaaattgctgttttctgtcataagcctccaagtattaaaacttctttatggattgaattttcaattcaattattagtactatatgattgattaaaacaatatagattaccaattttgataattattaaccaaaagtaaaattttattggaagtccatctttttaaagagatgaatttgggtgtttatggtccctttattgaaggaattatttaattatctcttagttaaggttccaccagtttatttgtttttatttaaaaatatttgatacccaaaagtttttattctttggatcagtgcaaggtttaagattggggcacgggaatgcctttcttttataaagtggaagaaaggaagtgatgaagggaaagggaaaaagtggtacctcaaccttctcagagacatcaggtttttcagacaggtgagttttagaaatgcgtatatagtcatccaattgcttataaatggagataacattttgagaaatgcatcattaggtgattttatcattgtgcaaacatcacagagtataaacacaaagctagatagtgtaactactacacacctaagctatatatttttcctaggctataaacctgtgtagcatattactgtattgaataccgtaggcaactgtaacacaatggtaagtatttgtgtatttaaacatagaaaaggttcagtaaaaataggatataaaagataaaaaatggtaacacctgtggagggtgcttactatgaatgggagcttgcaggactgggggttgctgtgagtgaatcagtgagtgagtagtcagtcagcacgaagacctgggacatta

SEQ ID NO: 58352 - DNA, 1238 bp, Homo sapiens
cctgacccactaccactagccagggctaattaaatgttttctaggggtaggtacataacacttcactttacaatttctctaatataatttaaggtactataattgctgctattgacattttagattcctacaatttcagcactaaaggaaaacagaagtaaatttggtgaatatgttactggctatagtagctgcattgacatattattttctttggctctttgaccattggattttgtatgatgttctggaataagaatttaattgaaggggatagcagttttaatggaatgcttttgtggttgtctctttggtaggagaagggggaagatctttcttaatatgcagaggcctcttgtttcttctaatctcaatgtactagtgagagtctccattttagatagtaagcccaaagctatacctccccagaagttggaagtgctctttcattttttccttaggactccttaatgaaataacagaaatggtgtcttccatagatattaatagtaagtggatctatgttaatatctaaagtttcttaaggacaaatatttacctctgaatttgttaaaaatgctgaaatgtgatgctgtattggaattctataaggaattatcttgttttaggatggtcttcacaataccctcttcaatcccttctgactggttatcagtgcagtggtaatgatgaacacacttcttatggagaaacaggagtcccagttcctccttttggatgtaccttctcttctggtaagagaattactatctaggcaaggcttggacagaaatgatctatttcacacttatagggaaaatatactagagtatttccctttcaaagaaaagtaaattaggtggatgttagagtttttgtaaaaactgttatcttctgatttataaaatagacttttcttaatctctatacatcattagcataactatatttcctctaaagcataggactattatagcactatttttaaaaaatcaatataaggaaggggttgcaaaggttcagctactatgaaaactgttttatccagtagatacataccctttgatctggttgaatgtatctttctgtgactcattggggaatatatgaacagaaatagaagtacttcagccaggctcagtggctcacacctaaaatcccagcactttaggacgccaaggtaggtctgggcacagtggctcacacttgtaatccccgaactttgggaggccaaggcg

SEQ ID NO: 58353 - DNA, 1045 bp, Homo sapiens
tttctaagtttgagaaaggtaggtttgtgcttatcttctttcatctccttaaccttctttgcagttgggagataagaacctgtaattgtttctaccctttcccctgtcaaagttactgctttacctacatagatgattaagattctttttttggagacagtttcgttctgttgcccaggctggagtgcagtggcgccatctcggctcactgctacctccgctgcctcccaggttcaagtgattctcctgcgtcagcctccggagtagctgggactacaggcgcacatcaccatgcccagctaatttttgtatttttagtagagacggggtttcaccatgttggccaggctggtctagaactcctgagctcaggcaatccacctgcctcagcctcccaaagtgctaggatcacaggcgtgagccgctgcacccagccaggtgattaagattctaacatgactgaaaaccttaataaaattaaattggttttaggcccactcttctggacattatctctagcttgtccctgaaagtcaagagtctttgataagtttttctgtaatcttgcacataaggtaaagatttataaacagctacaataccattgttcaaccttgattgttcattgaagttaaaaccttgtactgggcactcattaactatttgtaaaacagagttactttaactctgcttgtaaaatctaaatgagctataaggctgataaacaacataatttttttctacctaaaaatttatcatgtatttggtttaaatggcctgttttttgttttttgtttgtttgtttgttttttgagacggagtctctgtcacccaggctggagtgcagaggctcgatctcagctcactgcagcctccatcccccgggttcaagcaatcctctccctcagcgtcccaagtacctgggagggattacaggagcctgccaccacgcccagctaatttttgtgtttttagtagatctggggtttcaccatcttggcgaggctgatcttgaactcctgacctcgtgatccacctgcctcgg

SEQ ID NO: 58354 - DNA, 1885 bp, Homo sapiens
cccaggttcaagcaattctcatgcctcaacttcccaagtaactgggattacaggcgtgtaccaccacgcccagctaatttttgtatttttagtagagacagggtttcgccatgtcggccaggttggtctcgaactcctaacctcaagtgatctgcccgcattggcttcccaaagtgctgagattacaggcatgagccaccatgcccagcctggcttggacttttaagaaagtcggttttaatttactgtggttgcagttgaaactggaaccttgaaggggaaatatggcatgatttttcttatttctgcataactttattaacatatttaagtagttaggtatgcttgtgttctagttttctacactcttgtgtcatagttcactctgagtttgtaaacataattttaagataatgaaaatttacctaactaaagagtagtggaaaacatatcttttggtccttttgcttaatttttacaactctgcatgtgaatcagcctgtgacaatgagctgtagaagaaaaggcactgagttagagattggggcaggtggcttttttcatgattttcagtagttcataggtactctagtgtaaattagtctgatcggatactgctcccaagccctgtggtttgttttgttaaaacagaatagataatagctccactcactccatcagccataagccctcttgcagggcaaacctttgcaactaaacatggaagccctctgttttattctggcctcctgggcaaagtgattttaacctccttgggccttcattttctaattttatgagataaatacctagtctatttaggtcacaaaaatattgtagacataaaagtgaggtgaaatatgaatacttttttttttttaatctgagctcattatggtggctcatccctataatcccagcaacttgggaggctgagaaggattgcttgaggccaggagttcacgaccagcctgggtaacatagtgagaccctataagaaaacagaaaattagcttggtacagtggtatgcacctatagtccgagctacttgggaggctgaggtgggaggatcgcttgagcccaggagtttgcagctgtagtgagctgtgattgtgccatcatactctagcctgggcaatagagtgagacccagtctcaaaataaattaattaaatcaatcgatctatctataatcaatcagaggaccatataaatacttagtgttttgtgggggtttttgtaggtagtatggtagaaaacatctttggtccagttccttccaccctacataggtaggatacaaataatcctaactggacatagtcacactaatggaatttgccttccctaagtatctaccaactaaaagcaaagaaaatggactcagataagtgctttgtgtggcaaaagggcaggtattagaacttctagtggataattaaaattgattataaatttatttcctctcctacaaacttacctatatttacaccttctttctcattcttcattctcaagttttaattaaatgagaatctcttgcaagtgggccaggcatttattttttcaaagttcctcaagggatttcaatgtgtagctaaaattgagaaacattcttgatccttcccaagaccttccaccatcacatgtatccccactaccctgtatcttcaagttctccctctctattggctgtttctccttaggagaagatatttggcctattttcccaaatatcttaaccctgtgttctcttttagttgttactgtttcatattttccatctcctttaatttggtttaatctattttccacatctagccctcttcctgaaatcactcttgctaaggttattaattatctaattatcagaaagcacgaaac

SEQ ID NO: 58355 - DNA, 1213 bp, Homo sapiens
tatttaacttttcttatagtgtgagtctgatggtaataatttaccttagtttttctttacctgaaaatgtccttatttcatcatcattctcgaaggacatttttgttggatatgaaattcttttttttttttttttttttttttttttttttttttttttttttagcccagaggtcctttattttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagaatgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccgttcccttgatgtctacaatatcacctttcttatagattcgcatatatgtggccaaaggaacaactccatgttttctaaaaggcctagagaacatatatcgggtgcctctcctctttccctttgtgtttgtcattttggcgaattactggaagatggcggttccggccgaaaagaagctggatatgaaattctgggtcaacagcttttttttcctttcattgctaaagttgttccactatcatctctgctttcattgagaactctgtggttgttaaaatcatttccctgtatataatatgctgtttttcctgactattttcaggattttttgtctttggtttctagcagtttgactgtggtatgtctagtcatggttcccttcacagttttcctgtttgaggcttgttttagctttttgtatttgtaaattcctttttactgaataggaatttttctatcatttcttgaaatactttttctgggccaggtgtggtggctcaggcctgtaatccaagcactttgagaggctgaggcaggcagatcacctgaagtcaggagttcaagaccagctaggccaacatgatgaaatcccatctttactaaaaatacaaaaattagccaggcgttgtggtgggcacctgtaatcccagctactcaggagg

SEQ ID NO: 58356 - DNA, 3541 bp, Homo sapiens
agagagaacttaaaatgttcccagcacatagaaatgatgaatacaaggtgatggataccccagataccctgacttgatcataacacattctatgcaggcatcaaaatatcacatataccccataaatatgtaaaatactatgtatcagtaagaaaaattgcatgttttcattcagtttccacagagccctcaggtagctgtttttgtgttttatcccatgtacaactaatgcaagtggattagtttaagtgctcactctttcacacaggaagcagggtttttttctggcttaattttaaagaataaaacattacagataaattgaagttctcctatagtgccttttccaatcccattgcatcccaggcaacctctttaacaaacttcatatggatctggtccatatttttatactgagccaatacagtttagaggtttggagtgtaagctctggattcatactgccaggaatacctttacaagttacttatcctctctgtgcctctcttggtacttacctaataaggttgatagcaaggattgagataatttttataaaacacgcgggatagtagctaacatttagaataagaagcactctgtattttgactcttgattgttattcttattacaactgtactatatattttatatgggttttaaaaaatttacagaggggtgattctatgaagttttggttcaacattagcatctcaagctcttcataatcctttttcctatttgttattgagccatatatttttaaatgtttgatctccagtgacagatacagtacctagcacataatagatagtctacaaaatgtaaactgaaatatatgtgtcattgactggttttgttaacctcttaataatctgtttatttccccacagctgtattctgtacgggtggaagagatggcaacattatggtctgggataccaggtgcaacaaaaaaggttatctagatctattttaattttgagagatttgggattaccctgtacttaattttgagtgaaagagttagtgatttcatctgattaccaccagggggcatgtactcataatttcccatttctgctcactgttccagatctcaggatcttcactgagtgtcctgagtgataaatacatgagtgtcactgttacaagtattacactcatgtatttatctcatattgtcttctgaattataatgccatttacccacattattgatggacttaaaaatattaatacgcagcctcactggtaaatgtctttattttggtttttaagaattttttttattttattattattattttttttttttttgagatggagtctctgtcacccaggctggagtgcagtggcgtgaacttggctcactgcactccccacccgctgggttccagcaattcctctagctcagcctcctgagtagctgggattacagccacccgccaccatgcctggctaatttttgtatttttttaatagaaatggggtttcactatgttggccaggctggtctcaaactcctgacctcaagtgatctgcccaccctggcctcccaaagtgctgaaattacaggcgtgagtcaccaggcccagcctgattttaaagaattagattgaattaaacataagctcatggttgtctcatgatgctattaagcagacgatgattatctcactgttcacttttagttaatttattaaaatttttttttgtgtctgcattttaaaaaattggtaacatagttctacatattttcaggggtatatgtgatatcttgatacatatatagaacatgaaatgatcaaatcaggataattgggatatccatcacctcaaacatttatcttttctttgtgttgggaacattacaattcttctcttctggttttttgtttcttgttttttttttttttggagacggagtctcactctgtcacccaggctggagtgcagtggcgtgatctcatctcgctgcaacctccgcctcctgggttcaagtaattctcctacctcagcctctcaagtagctgggattacaggtgcatgccaccactcccagctagttatgtatttttagtacagacaggatttcaccatgttggccaggctgatctggaactcctgacctcaggcaatctgcctgcctcagcctcccattcttctagctattttgaaataaataataaaattatttagaaaaattttaataaaccttattttgtagagcagttttaggttcacagcaaaactgagcagaaagtacagagagttcccatatagcccctgccctgcccacacacagacttccccactgacaacatcctgtgcctgagtggtacatttgttataatcagttaacctatgtcaacacatgctgtcactcagagtttataatttacatcagtgttatatattcttagtattacacattctgtggatattgacaaatgtgtaatgacgtgcgtccaccattgtagcatcatacacaatagtttcactactctagaaatcctctgtgctccagttattcatccctacctccctctaagccctggcaaccactgatcttattacttcccccagtcacatttcctccatgtcattttatggctttatcaagctcatttctttccagtgctgaataatattccattgtctggatgaaccaaagtttatccattcacctactgaaggacatcttggttgtttccaagttttggcaattattaaagctgttataaacatctctccctttttatacattatagtctcaccacaggagatgtagtgcagctggctctgctggcttctaatttcaccaacttggtcaaaaattacttaatattgaagttttatttacacatgttatattcagcatgtaagaatcctgaaacctaaatttccttggaatatctttcagatgggttttataggcaagtgaatcaaatcagtggagctcacaatacctcagacaagcaaaccccttcaaaacccaagaagaaacagaattcaaaaggacttgctccttctgtggtaaggttttacagatgtatacatgtgtgcagatcttatctgtaggatagaataaatgggaggctattgattaagtgaatgagaatcttcatgattctcatttgatatcagtggtttattgcttattcagtacctacatttgtggttctcaaattttaatttttggttcttctgaattataatgccatttacctatattattgatggaattaaaatatatgtagcctcgttgataaatatctttaaatttattttggttttaaagaattagattgaattaaacataagatgttgtctcatgccattaagcagaaagtggtttttttttttacaatttcaatatctacattttaaaaaattgataacataattttacatattttggggggtacactatgtataatgatcaaatcagggtaattgagatagccatcacttcaaatactgtgtgcatcagagttgcctgaggcacatgttgaaaattcaccttactcatcccta

SEQ ID NO: 58357 - DNA, 1348 bp, Homo sapiens
gcctggccagcttatttttaagcatttgacaaaatattgttaaatatattgagaaacacatgggtagaacatagtaccactctaataacttacagtcagagctcaaacaatgcccataatatatcctttttctttaaaaaattgccctttttctcactttaatgtaatttttttttcatattcctggtgtgtagggtacaagttaatattttgggggaagtatgactgctaagacattaagacttaaaactatacaccgtgaacaggacacaagcatgaatggaagcagatagtagaggccatatgaagttaaaacgagtagcatttcagacatttaatctggttctgagccaagataacttgttaagtaatagcaattaggaggtacgactccactgggcctctttttcagggcatgaaataatcttttattcataattcttttgatactcctatatgataatctaggtagacagcaacattttagagattaaactggcacaagaaagttaaataagtttcctaaggatacacacagcatattagtagggctgagtctaagtagatgcagtaggctcagacgagcaaaatcttttagtcaccagtttgttttttgagtataagttgaaatattaacactgtatactaaaacttaatgatccttgctaaaattacctcttggtcagcatatatatctgatcgagatcattagacaagacttcatctaagtcagtctggggagaaaagtcgttttttagcaccttgttcccttgatggtaaagattatgatgcccaagatagaatcttcttcttttcttgtgctatcaggatttccagcaaagtgttactgtggtcctctttcaagacgagaataccttagtctcagcaggagctgtggatgggtaagagtctatttcttttttcttccgacgagatcttttttatgagattgtgatgaggcagtcacatagtctcattataattgaatgtgtgtgctttcaactgtcaacatagcaagtaccccaactgaggaaaggagctatagatcacattggaaaatacctagttgaaggactcttgctggataattaaatgaaagaatacatgtgtcacgcttagcacattgtctagcacataagagcagtggtagctgctgttgctatcttagaaaagaagctggctgggtagcttgcttgccttatgcaatataatttagtcactaattctcattttgaagagtaaaatttctgttactttgggttttgtctttttcaggtttaagaatatcctaaaagaagaaatctgattctggggatgtaattgacatttctgggagtaatctaactag

SEQ ID NO: 58358 - DNA, 1197 bp, Homo sapiens
aatcacatctgtttccgttctgtcagaattataagcctgatattggagacaacagtataagatactttaatttgtttcccaatgaaatatccttactgtacctagttaatgtgccagaggagttagattaaaagtcatttcacatttagtgtagttgaagttgtttggggttggaagaaggtctacaaaatatttatttgccttggtttttaggataatcaaagtatgggatttacgtaagaattatactgcttatcgacaagaacccatagcatccaagtctttcctgtacccaggtagcagcactcgaaaacttggtaagcctttaataggtcttttgggggagataagagtttttgtttaaaaaaaaaaaaaaaggctaatttccagtaacattgatatgaaaaattctaatatgtgaagttcaaaagataaaaactcagaagaatgtttttggtttgtgtatattttggggacaaagaattctgatgatgattcttatgaaatgatctatttttgtctctacattttaacctcagatctactcaccatcatcaggacgtgctaacttaagtttcctttttccaggatattcaagtctgattttggattccactggctctactttatttgctaattgcacagacgataacatctacatgtttaatatgactgggttgaagacttctccaggtaagatattagtcattcaaattctcttaccaggaaagcattatgggctttttttggtaatgataatttaatgggctttcttctaaactgaacttattaagccatatgaggactttggcatctttgattacatccagtgataatttcataagtgtacattccttgtgatgatttcataagttagctgaattgtgctttacatggtgactttattttaatagagagtatctcctgaaattatgccctttggcctatatttagaattctctcaattttttatttaataagctgtggagtagataaagtgcttctgctcagcttttttcctctttaggggctgctggttaaaattagggggctgaaattttcatacccccaaaatagtttcagcctatctcagccttctccttaatgttagaggcccttttatttctagatgttttccccagcctcaccttttttttttcctcaaaactttaaaaatagaatctgatacttaaaact

SEQ ID NO: 58359 - DNA, 1485 bp, Homo sapiens
ccttttcatggaacaaatgtttgaggatctactctgttcaaagcactataaagtctagtgaggaaaaagtaagatataaaatttatcctcaagaggcctgaagtctaaggggaaattagatgaatatattatgcagtggaaaaaatcctaccctgggctggagagagagggtcttataaaggcattttactgcaagttggacattggctggattctttttttaaggaatgttttccctccaatttttttctcttgatattgccattttcgtaccaagtactcagactgagttcatgagattggatctaatataaagcttccttctagggttttgtttttctgccaatgtctagttcccttgtatttgatggataaagctagatcatctgcttcaataggcaatacagtgataaaacttgttagaatatatatgctgtctatatccatttgaccactagaaataacaagagccaagtaatttggtttttttcctctggcagtggctattttcaatggacaccagaactctaccttttatgtaaaatccagccttagtccagatgaccagtttttagtcagtggctcaagtgatgaagctgcctacatatggaaggtaagttgctaaacttcacccacaagtgttagactgaagtattcttgcaaatatttgttctgtccaatatgagataagtttaatgtaaccacgtgctatactattcctgcatcagatatttagtaaaggttgctcttggctcttaatatagctgaaaccttactctactacagaatgtatgacactttcagggccatagcttgtcagaaattgacaatttgtatcctctgtttcaaaaattattaggaaattgagaattcagagggtgataagaaccttaactactttgtcctgcatcctggaaaacatgctatactgactttctgccctatgttttcaaactctcgttcagaatacagtattttgatccctaggatcctgtgcttgaatcacccatggagccttgcacaaaacagaaactcaaaaatatttttatgattaatttattctttattctctccttacaagtagctgatcttcaggccactaaagtagatatggctgctttatcagatttttatatatttaatagcattatttactaatcttttttttttttttttttattgagatggagtctcactctgtcgcacaggctggagtgcagtggcacgatcttggctcactgcaagctccgcctcccaggttcacgccattctcctgcctcagcctcccgaataactgggactacaggtgcctgccaccacgcccggctaatttcttttgtatttttagtagagacggggtttcaccatgttagccaggatggtctcgatctcctgacctcgtgatccgcccaacttggcctcccaaagtgctgggattacaggcatgagccaccatgcctggccaataatcttttaaataacttt

SEQ ID NO: 58360 - DNA, 4152 bp, Homo sapiens
tatcaaatcccttctcaagagaaagttatatcattttttatcctgccaagctctagaaagtaatattgctaattttttttaggacaggggtaaaacctgtttagtatgaagcataattcttcagcttaatttcttccaatcctgagggaagtacaaaagaaaagtgatttctatataactggagttgtgaaaatgcaacactactttattaaaattttactaacaatatcctaaatagtcacagggtggaaatattgctctatccaagatgcttctatgttgggcctgcctttttctacaagcatatttctttcttttgttatatttttaaatgcctataaagtatatacttgactccatcacaagatggagtttcctctttataatattcttcttacttgagattttaagtttaacaatgttatgtcgctggcactaatgctctgtcttatatttaaaattttcagtttcaaatttggtcttaatgcttattttgctacctttttcctttcttctttgctcactgtcttgcctatgtttccttctccactttggctcccaacttaactagaggattttattcctaccacaggtctgtatcttttaaggtttgtttcttgttaaaaaaaaaatttttttttccaacatcacaaaaagcatataagaataattcaaaaaatacttatgtattgatcattcttgttaaattattaagttttaattatatgtacataattatgtatacaattacatgtgtgttgtatagtttcttgatagtttttaaattcttaataaatttttaaattatatatatacataattatgtgtataattatatattatgtgtatcttgtgtaaagttttcttgacaattgttaaagttccttcctcttctctagtgcaaaggcctttttaagattttgtttcagggaatgaaggttgtgggaatacttgcctttaaagatatacactaaatatagttggccattgtttctaagccattttcagacaaccaatcagtgtctaccacatacaagggttacccttttttaattcctaggctgggtcacatgtcagtgttgaatgacgtggttcagacgtgatgttcttctgcctgtccacacataactcggtgtacaggctctgatatttgagatcctggcaagcttgcacctcctaaatttgaatttgcctagtgaggtggctcagtttctcttttccatgattaaaaaaaggaggagtggtattttaagagcaattccattcaagctgagtatccaggctgttagattgctcttctacgtgttcaaaaagtcagaattctcttaagtattagaattttttctatgctaaaaagccaaaagcccatgggcacaagaaaacaaaatagaagggagttttgtatcttaagacagaagagaatggcctcttaatcctcactactgcccagcaaagaggaaatataatatattcgggctgatattgaggcccaagacttaaaaagatttaatattataccttttctttttaatttcctaactattgtctcacccccaccccatcctcttttctctggtttgtttctgatatagccactgaatagcatcgaagtggttataaataaactgatttggcatagtcattctaccactgactggtgaaacgttgagcctgacactttaggaagtgtaaatgatctcatggcagaaataaagattagacttggtttccaactgggcagagaagagattttgtgaggaaaagtgctgatattctttgtatgtttcagtacacaaaataactttatgacatctgtaagttagagccacttacttctagaggtaccttcttagttctaggagatttaactttgggattccttgtgccttgaattaaagtctttattttacaaaaagtagaatatgtaagagaggacagtcttctgtgtctgagcatctccaaaatgcatggatataaatgtctcttagacttaatagtcgccttcctacttaaaagggaaaggaagctttaaaaaatgaagttacgtaattatgatagtgttcttataataatgtagggacaataaataaaaatttatttgaataaaaatgaaggatttaaaagccacctgaatctcattagaaggaatgaatctttcttgaagtagtcatactataccctaggatagtcctaaactatcaaagcataaaagttcataaaaacgtgttagacattagtttctcattttaacccataacacgcccttcctcccatttttccttattcagatagaattcatataacatataattcaccattttagtcattttaaagtttacaatggagtagttactattgtaatcacagtgttgtaccaacatcaccactatctaattcccaaacatcatcacaccagaaaaaaacccgtgtcctttaacagtcactctctaatcccctcttcctccccaacacctgctaaactacattcagtctctatggatttgctattctagacatttcatataaatggaatcatacaaaatcagcattttgtgtgtgacgtcttttacttagcataatatcgaggttcatccatgttatagcatgtgtcagtacttactcctttttatgactgaataatatgccattgtgtggatagaccacattttgtttattcattcatcagttgatggacatttgagctgtttccattttttgacatgaataaagctgctgtgaacatttgtgtataagttcttgtttaacataggtttttaattctcctgggagtgtaggaacagaattcgattcctaagaatagaattgctgggtcatataattgtttaactttctgaggaaacttccccccacttttaatgctatgtaaagtgcctggcttagacttttactgtcgtcattgataccttgttaacgtattccaaaatgtttttctaatgggtctctttcttttttctctgaaaccctatagataaatgcaaaaatgtgcatatattctattggtgggtatttagggggttttttgaaacttattttaacccttggtgtacacatttaggttctcctaggtattataatacagaaactgagaaaggaccaatatcatgaaattaaaaagctataggcaataagcagggtgaatcaatggaagacaataatgtatttctaccagggatgctcagtaggacttgaggatttcctctcccttctaatttgctgctaccagacctgtttggaccttgggtgaagagaaacttaatcgactggggccatcccaaacagaggaggaaaggaaaatttctgtgactactgggatagttagagacgatcttcaaagtcttttctaaaatatgttacattgtgaaagaatgaattatctctgtgccattgtaggagtaggcagtaagtgagattcctgtagatgtggaaaaagcttcctttctgataaattttaattaactctgcaagacaagttagactctgctctttgtcttcttttgcttttttaattattgcatatgtaccatttaagccaagagaggagtattaatgattgagttgaataaccttatcagtcagtgtgtcagatctcttaaccataatctgggggaatctattaagtttacttagtcattctcacaaataatcattccagagtcacctccactttcttcatacaaatgagccatgattcagagcctcaggaaaatgaaaagagaataacttctctcagccccaacctccttgctcttttgaaacacacatgctaataatagttatgtgtgtttgtactcgttattgtgctgattaattcccatggcctatgaaagagattgacatctcttgaatgagtcagctgtatgatgctgtcaaatgtacataactggtggcatctgatgatggaaaaatatgattcttagtcacatgtacaggacagtacaatgtgacccttctttctgcattaaaatatattaaaatgcgagtgacacttacttgaaaattcaaaacttctctcagaaaattaactgaaatatagttttagaggaaaaaaatgtttttcagaaaggataccaaagtgccatgtaaaatatagtttataccccttcagaatgaaggttatccaactcaaaatga

SEQ ID NO: 58361 - DNA, 1424 bp, Homo sapiens
ttcttttggaaggaagaccatcatcttgtccgaagagagctggtagcatgtttcagaaatcttcaggtttcacagttaatttagtgttcctagaagtagctgactagggatctgaagatatatatgctgtgtaaaaacaggactgagttgtcgagttgactacttaaggatggataacatccttccagaaagtttaccacctaaggaataagggacaatgccagtcttgaattttagtcaaaatatatatggctaggttgtcctgatatgaaataaggactatccttgtgtgtaagctcatgttatttacttattttgactgttttcattgtgttttctcagattagtaacagaaatatttcattgcccattggaaatctgttgttttttttttcctaactatagctaggcaggtctagtggcctttggtaacaatcctaaagctctctaagacacacttctgaattcaaaggcctctatctgggaaatctaatattgctttgctgacttgtttgtttttgattggactaggtctccacaccctggcaacctcctactgtgctcctgggtcattctcaagaggtcacgtctgtgtgctggtgtccatctgacttcacaaaggtttgtaaatgaatctctatagttggtttaaaatgtagatcacaggtttgtaggtttttctaaggtttgttttgagaatgatataaatttttatgtttaagttgagattttaaagacctaaaggccatccaggatctatattcacattactcaggcatattctgcttttctctacccataccataatggtattatgccctgtgaaataaggatagatttctggttccctacagttatttctttcctaaatgtaggattaagttgttaacttaattaaaattttctattaaaatctaagataaaaatacaatctaaggtgagaactagtcttttttactttttagatattatcaatgtagtatattaaaggtaacatcttgacagcccaatttgggttttcacatatggctaacaaaatggtaactgtgaagtcttaacatgttaggttatctattgcttaaactatgtaagtaggtctgaaatgttttagatactccagaaagaagacaatatgcccaccttttaatttttttatagtgacactttaagaaacaaaaaaaccctaaaatgtagaaaggccagaaacattaaaaactatgtatctattggaattgcatataatagtagctcaagttccagtcattctcccaaaccccattgcctctggtctttgagttattctgggttctacaggaaatcttatttctgtggaggtctcccctttcacgtatgacgttttgaggttttgttgcctattgttcccatctgttttttatcttccagaaacttctcatggtctggtc

SEQ ID NO: 58362 - DNA, 2076 bp, Homo sapiens
tccatttgattgtggttactttgggcaaataactttattcccattttgcatatgagattatttgagtacaaagcttttagagtgtgagaattaaataagataaagaatgtaaactaccagacacatagtaggtgctctgcaaataactattgttaataaactatagaagaactgtgagattccaaacatttcatattgaacagttaaatatgtgtatcttcttttggcctcccagtaaggaaaggaaaaagctgccagtctcttgggggccaagacttaagagaacatgtattctttttttctttctctttagtgactgaaatagagaaattatataaacaaatgctggggaacagctctggtaccagtggccatttgccacaagctcttcaagctggactttctctgccataaaaggcttgggaccaagatctagaatagtcagatatttttaaagggacaaaggttattttttaacttctttcagcctagggaacttgttgttttcccagattgctcctctacctatctgaaaaagaatctcaaaaggaatggtttccttctacttgtcacagcctactagagtcatgggccaagtctgatcttgcaaatggtgccattactttagcaatgtggcacaacatgcagaattcagaagaaagttgtagaaattgaatgttggtaacatatactgattgatcatttaacagaagagtaaaaagagtgtcttaactacatattttgtatttatacagaagatgataaagagccagaactttagattagataagaaatgaccagtaacaaaagacatactagtagaatgtatatgaagaataaactaaagagtcagctttgttggaaatctggaatgattcctgaaagcaagaaatggatgtacatgatctttaagatattattttctatatcctgtttattagacaaaataattatccagtcacaaggccttaagacacacctgttttttaatgtattttgaatcttgattgaaatttcttaattcccttcttggtactccctcttagattgctacctgttctgatgacaatacactaaaaatctggcgcttgaatagaggcttagaggagaaaccaggaggtgataaactttccacggtgggttgggcctctcagaagaaaaaagagtcaagacctggcctaggtaaggatatcatatactttccaagttttttatggtttgactagtttagtccgacagtacagagtaataagctagatttgatcttgctttggtatgtttttaaagaaaagcactatcttcttgccattcattctttttgataagtatttcccaagcactactatgtttatcatttacacaaggtactacagtggtggatttattcaacaaatatttcttgaacacccagtatgtgctgggccctgttcttagttgctagggattcagcaatgaacaaaagaataaaaaatcctgaagatgtaaatagagctaacatattagtgtgagaggcaataaacaagataaaaaagtaaaatatatactgtgtcaaataacaataagggcttaggaataaaggaaataggaaagggagaagggcaagggtgaaatatgctatcaaaattttatattaggtgaccaggggggcctcaatgaaaagatggcatttgagtaaagaaagtgaagtagtaagccatatagatattttaaagaagaatattccaggcagataaaagtacacaggccctaaagcaggagcatgcttggcatattttctcttcctcagagaggctagcatggctggcccctagggctgcagcaggcaaaggaaagggagggaatagtagtagaaaatgaaattctgtgagactttggcttttattttgatagacaaaagtccaccagagggtttggagcagaagagtatcataatttgacttttaacttgatcattcttgctcctgtgttgaggataaattgtaagggggtcagggtaaaagcaaaaagctacttttaaaaagccattgagataatccaggaagtgatgatggtgacttagaccagagtagtagcaga

SEQ ID NO: 58363 - DNA, 1134 bp, Homo sapiens
gtaaaaataaaagagcaaatggcagaacatgtacagatatatatatagtataatccatttgtattttggggttttttaaggtctgatacatatatacctttgtatgtgctaaataggcacagagaaaattgcggaatgcacaagaatgtaaaagtgaaatgaaaaagttgaaaagaggatcctgtttccaccctcttcccctctgtactggttgaatttttttaccattaactttcatactgttataatgtagttactgtttaaaaaacatatacacacacttaaatttgacccagcatttgctaaccttcaaagctaacaaaatttctttgacccccatggaccacttcctctttcaccatgacatcctgaaggaagaggaaatgccccaactttccaacacatcaatttcataccagccttatcagtaaatactccagtgtgtgccatgcaagtttcagaaacctagatacctggtttgtccctgtcccagctcttccttcttccccaatcctgccttgttaatcggcatattataggactcataaaattttaggactttctgccctaaatgtacactttgacccacttaaatggaacagatgactgtggcagctgtgcagtgactattaacctgcaccgaggagtgcagcaaatgaaaacttccttttctgctgaaaaaaatagctgttatcaagctctagagcgttagtgtgagaaccataaccagaggtttcatgaataggtccctgttactaagtccttttcatggcatcttatgacaaaatggggtttttcagtaattatccttattaaaagagcagtatcattttggctggttctaaacatatggttgatgagaaaagtttaggcaaaagtcaatttgtagaatttctctctctcaaggcaagactgctttaggagtgaaaaacacagggtaaaaaaaggacaggataattaactgactaaagtgagtacttgccaatctttatttatgctaaaagagagattgcatttttatatcagcccatcctaaattcagctggatataaatgcaattaggtaattaaactgaattaaaaattatagttaacaattcaaaggctttgtgactgagaataaataaataccctt

SEQ ID NO: 58364 - DNA, 2073 bp, Homo sapiens
ttagggactttgtatggctttcacttctgatcttcatgatcctctcctctttttcagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtaagtcagcagtggtgggaagatacatttcctaacttaaaaggggccagacacccagatgtctcaagtcaggatgcttttttttttttttaaagaaagaaatctatttattcctagtgctgccaaattcagcacataaatacaaaacaaattttgcatgggccatatttttagtaaaaatgttttatgctaagaaactatttttgtttgtctgaaattcaaatgtaactgaatgtgctgtattttatctggcaactctacttactcccattaaaatccctcctgtcagggtccatactcctcagccctgttgcctgattgaccaaagccttcatcatgctccaggatatcaattcaaaaatatctcccctctcctgttagacagtatgccatcctctttttatagataaagctgttgttcatgggaaagttgccaacatccataagtagatttccagtttgtaattccattttgtgattatttaaaatacagtgaaacttagatacttacaaaacaatttgagtgcaaaatctttctagatttttatgacttctccacaatcttttataatcattttgccacaccacagtaatacttttgacacctatatctattctttttaacattcagtgtagtgtcacttatctttttaggactcatttcattgactgacttaatatttaaattagataatatcagtcatcagtgattgatggcagaaataggtttgtgaaccttgaaaaacaagattcattacagtggtggaggcagaagtagctgagtgcattgggtgagctatgggcaccagtcagagagaataaaaagcttctgttgtttgcatgtgaaggggagatgggttaaggaagtttccactgtacttcacagtagctcttgtggtggcgggatgattgaaatagaatccagaatcatgatcagcatcatctgccattttaaagggcagaagctagataaccaaccttaggccagttttagtttaaaaagtgttcataaccccgacctgctctcatgaagacctatcccataattttagaaaaataaactgatagattttaaagacaacttagtacacaaactgcaatcaagaccttgctgtagaaagtggagaaaaaagacagttataaggaatctttccttctctcaaaattatgactgctctttatc

SEQ ID NO: 58365 - DNA, 3193 bp, Homo sapiens
agggagctggtctcagctatgtgttagcagaaaagtagtttcaatgaaaaactattttcactgatacataaatcttaaaatctttaaaaagtagaaacagtgtgctggtcttgtaatttatttgaagctaacatttcttaaaaattttttacctttatatgatgataatgtcaaccttcagaagagagtaacatcttccatttgaatacctatcttgtttataaattgggggggctgatttattcatttatttcaaaaaggatagtaattgtaacttatttgtttcttattaggagacttagctagtaaatgttttctattcacataagaagtctatgccttctttccctacatatcatctgttaagtttttactatagtcagtacaaatcagccaaaagagacattgccattgaaagtatttggagctgaaagcaggctaaacaatgaaatttctggcagcctaatttaaggtatgccttagtaataacttagtaacagttgaacttcaaggaaatctctgaaatctaaactttcttcttctaggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttggatcagactttgagcatttaagatggcttggattacttgataaagcagggtggagtgatgtagttctttttctaaacaagtatttccagcacaaacttttccatttgaatacattccaagcactattgctaggatcccgtattagagtttgcttttggctgtttcaacacgggcccttaattaaattttgtgaggatgactgattagtgtcttcaaatgtctcttcatctggactgcacatttaactgatgttggatcaagaccatgtgtagctactcttgtgttgagggtcagcccattatccccatccccagccctaacagcttaaaacagctttaactcccatcttgaaattagcctatggccatgttcataacataggtagtgtgtgggttcaacaaatgctttttgagagcctgtcatagccaacacactactgctcttaagtctgtttttctgcttttcctagtccctagttccttt

SEQ ID NO: 58366 - DNA, 1059 bp, Homo sapiens
gggaccaaaggatgctcgaaaatatgactactgtgctctgaaaatctagtactatagctcactattcctactataatcaactatttcaaaccttctgcactctcccgatacctctgacactcccccaccccccactctccaccgatgtcataatctttgagttcttccttgtgttaccaaatgcttaaacccacccacacctgcacccctccttcttgcctcctgttgcaattgaagagtttctcttctgactgtctaatcaagagcagctccaccacttgtgttttacatcccattttctcccaccttttcatcaaccttctctctaaattacccagttcctctcttgtgcatttcatcattccctctctgttggatccatctcatggttatttaaaggagctgatatccctgtaaaaaaaaaaaaaaaatcctctgcctctacacactctaattcctcaaaatagttctacactctctagttccatttctcacctcccgttcacccctcaacccgctccaatctgacttttgctctcattattctactggaacagctcttgcaacagtcatcagtgacattcgtgttgtttcatacagtggtcacctttcaggcctcatcttggctcttcatcatttgacactgttgaatgattgaccatttggtctttcttatttaaagaaaaaaaaaactttccttgtcttctatgatgaaacactcttcctgcttaattcctatgtctttgcccactcttgctcagtctcatttgcaggttcattttctctacctagtcattaattgttagagttcaagtcatggcattctcaagtctgtttatgctaaagtgctcttgaacaccacactgtactgctccattaaaatgtttaaatctgccaagcgtggtggctcacgcctgtaatcccagccccagcacttggggaggcttaggtgggaggatcgcttgaggccggatgtttgagactaaactgggcaatgtagtgagacgctcctgtctctacaaaaagaaatatttttaattagccaggcatggtggcaca

SEQ ID NO: 58367 - DNA, 1040 bp, Homo sapiens
ataaaaaagatctaggtatagttttgcttagaaggtggttaagaatttagaatgcagggtgagtgtgtgtgtgtgtgtcttgtgtgtgtgcacatggtgagcccagagtgacggctgcattgttcctgatctttggcccacagccacagcagatacaaggggttgccctgggcctggtcctctcctgtgcagttctactgactgtttggcactggagaatgcagaggcacatgacaggccatcttttgcccatttgtttctgtcatgattttttttccttaaagaggaaaaagaggcttgtgttgtttgtgtaatttccttctttgctttggcctacactaggctgtcagcccattctagtcgtcttctttctccaaattaatatacaacatgtcatcacctctttttaaaaataaagatccagctcttcagcttcaacgaccttaaaaagctcttttaactcaacatttctaacctcagactcaatgtttgcttctctttcccttccttcctctgacacccctctctacctcctcccacaaaagaaaactggatcagctactggacttttgttaaaggcccccaatttatttggtcacccaattcaaaaccttggcatcatttgtaattttcctctttgacttgccacctccctcctccacctttagtcaaatctttccagtgtagtattcttttgtagtatctctcacatctattcctaaggccatttttagttcaagccactcatcaccaagaaatggaggataggatagggggaggggactggagtatcacttgggatttttttgaaactacacgttttgcctcttctaccccaagattctcatgtccactggggggccaggaagttatagcttggaaaagctccatgggtgccactgacacacactgcttagcaccactcattcaagccctggctgcctggacacctgtaatcatctccagccaatctctttggcttccattgccttcacctggtgatcttaaaacactacttcaacatgacatcttctattcaa

SEQ ID NO: 58368 - DNA, 1026 bp, Homo sapiens
ggctggcaacgcttgcctctgcgccagcagagccatttcctgctgggtttctcctgctcagttgggactggtagtgtgtgagccgagttccccacaatgccttggcgtcacctcacgccctcctccttattcaaacaggttttctgtgaagtcttggctgtttccttctaattcccacctgaactctttccatcctaggggaggccaacacccttccccacctgcgcgcttgcttaacctgcacttcctatcttgcgtcccgtgaagtagagtccttcactcctcttccaggtttgccctttcccggtcttgctttaacaaccgcacgaaccttccccgaccttcactttcccgagtgtcagctcctctgttcggccacttttagctagtcctttacttttacagttataaagccgtctgcacccaccttcttctcaacttcacttcccattgattgcccctaagagtcatcagaccaggaatccgaatgcaaacaacggttaagagttagctggcctttggatgtatttataaagaaaaagcctaaaatttgaccagtgtagtatcttattcacaggatcgttagctttaaatggtatcctttagctcaaggaatagatttaaaatattctgttgtctgagccgatacacatggtctatttggaaatacgaaggagtaggtagtgttgctttgcagtcgaatgggaacttagtttgccaggcagtgattccagggactttgtaggtttgtacaggaattcaaattggtatccgtgcctaatgccttgcaggagaacttggcactctttttggctcacttttcccactaggtttagaggattttcgatgttatttcctggtgttctagtttattctttgtgtattactcatgcttaattttataattttaatgtccttgctttttatgagatagaaatgttggaacaagatgataatgctcctacatatttagataaaatttgcaacctgacggaaatccctatcatctgatgttcagatttttca

SEQ ID NO: 58369 - DNA, 1211 bp, Homo sapiens
tctcctcactgcaacttctgcctcctggttcaagcaattctcctacctcagtcttctgagtagctgggattacaggtacgagccaccacgcctggctaatttttgtatttttagtagagacggggtttcgccatgtgggccagcttggtctcgaactcctggcctcaagtgatctgcccaccttggcccccccaaagtgctgggattacaggtgtgatccaccatgcccagcccagttaattttttgaaataaaaaatagcagtagttgcggatatacttacatttgaatggtaattgattaaaacatggatgtatttaagttcttgaaagttttagttagtattgtaggggttttcttaaaataatacatacatttatatattagaacattatcaaactggcagtgcgtatgtgttctaatttcctgaaatacgatgtctacaattttttcccaccattttcaattttaatgaaatcacagaaccttaataagtcatatttagtcacagtgctgtgaatcatttgttaataaacatttccattgttactttataatagcctgctctctaaagtttcaaataaaagctgattttagatttttagttattaatgttctaggggtattgccaaaaaaagctacatgtcctatattctgtgccagtttcttaaattagaatcttggattgcatcctcagcgtgtcactgtagtggtattgctgggttgctatgatacagtgcttgttctataatttgtagcatgaatcctatatgagatcttactttagatttcaagtatgttagcagcagtaattagggatgttttcctctaaggaaaattatagttataaaattattatttgttagaaatgattcctgctacttcaaattatttatccttaaatgtagaggattaacaatgaacaacttgaaataacttggttatcacctcagaagtttagtttatcactgatttaatgaagaagggcaagaagaggaaggctttatgataatgagtatgtatattaagatttcagtgttctacttggtatttgaaatcttgaggagagaaatgaatagagactagattttctgggaagatgcatttgaaacagtacaagcaaaaccacattacaggggaaaactacaaattatcttactgtattgtattaaaaattcggtgaactgttcttaaaaccaaccctctgtggcc

SEQ ID NO: 58370 - DNA, 1260 bp, Homo sapiens
acagagcaagagtttgtctcaaaaaaataaaaattaaaaaaaaagaagggacttacgctgaaactttgtaagtaggtagtgttcccagggtgggaatgtgggaagaagggcattccagacagaggaaacattgtgtaatcttcagggaactacagagagtatggtttaaccaaaatgaagaggcatgttggaaagggttgagagatgactcttgacagtagacagctgtactttgtatacagccgagaggagtttgaactttattatttaattattggagtatcattgaaaaacatggaacttgaacacaccgattctcattttggcaagattttgaggttgtttggagggtaagtcaggagtggtaatggttatgggaccagataagaggagcaattagcatatcattgctgtagtccagatgaggcatggtgagagtctgaaatggcagcgggaatgacaagaatagatttcaaatatgttaaagacgccgaatcagtaacatttaatgattagctggatatggtggcacataatctccactactctggaggctgaggcaggaggatcacatgagcctaggagtttgagtctatcttgggcaatgtagcaagaccatatttctttaaaaaaatttttttaatgattgattgtgagtaatgagggagagagaagagtccagtataaatccctgaatgatggggttatagatgggcacatttctcactagatttttggaagaagttttacatatgtgaatagcttctacaaaattaataaatatataaaagtaacttctgagtaggttatttctaagtttttctttatttttatttatagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatggtaagcctctagaattatgttcctcagatttatgtaaatttaagatctgaggtataataatgaattgagactgattttaaataaatgtacaataattaatacatcccccaaattttagaaaatagttcataccccatccattccaatgataccatcattgcatatacaagtttgggaattgagagtcatagtggctggtggcttccatattggatagtgcaga

SEQ ID NO: 58371 - DNA, 1117 bp, Homo sapiens
atcaagttttatttcttgttatatccttaatttatgataaacacaaaatgttaggtaacattagaccagataagcatcactccttttccacagttgggcagagatacatcaagcaaaattgtatttgctcagatccccaaacttttgttagctgtagactgttactgaactcacagtagtaaaaatgtgttgttacttggtgaatgataaggcctagatctggtagtgcttttgtttgctctaaggtctattaatttaatgtagcaatctttcttttccctttttcttttctaacttctacatcaacctaactggctacctaaatgttcattgaatgactgtttttgctttgggatagaatcctccttttttatttttagggtgttaaattgatatagtattgtttaatagctaataagatacattttgggctaagtttctgctttttatacctattaggttacaataaaaaaaaactttagtcatatttgcctttctccttgaaagcaggtatgatagtgacaagctgaaccaaatatttaattctgatttgtggtagcaagtgaacatttgctattacttgtaggttgcttggcacttttatagaaggcctgctatgacttctagtttatttgctgtggttggtacacagacatttcttccctagccctgtacttacgtaatttggttcattatttctcaagtgtggataggatatgcctggttttgatttaattagttttcccactgtagttttatagaaagaccagaagtttttcttttcctttctttttaaaaattaatgatacactgcctgttttatctggaggttgttgactctgcatttaagaaactctgtagtgattaaattgaggtaggtagtagtccactgggaaggaacatcttcctagtgagtatggattacaaaataggaatatatttaattaagaaatatttaattttataggcattgtccttattttctagctcctgtaatttaacgttttgcatcaagttatgtaaagcaataaataaatctcaaagtttatcagcttaggaaaccaaatggtgaatatatagtttctaggtttgtttgtttatttatttatttattttt

SEQ ID NO: 58372 - DNA, 1050 bp, Homo sapiens
tttacacatggatctttttaagactatttgatgacttgcaatctaaaaacttaaacgattttctatgtagttttgacgatcaaaaagcattaaaaatcccaaattttaacactccaaaattgtgagcctctttagtattcaagagtaggattgaattttaaaatcagtgggaaggtaaagaaaaatccactttttgaaatatttatatttattgtaaatgtcatattttgaagtgaaataagtgagaagaaatatttcctaagcttttcctcaccttcattacttagcaagaataaagtcagtgtggtaaggaagaactctaaaaaatttttaaaagatgtcatggataatctttaagatcaaaattagaataaagctttagctcgattattttttaaaagtaatttctcaggtttcttttaaagctcctggagctttttgatagtgaagatcccagagaacgtgacttcctgaagactgttctgcaccgaatttatgggaaatttcttggattaagagcattcatcagaaaacaaattaacaacattttcctcaggtaaattaatcatttattgtatattgcaccttttcctcctacatatcttcttgtattcaagttcttttatttttatttgtttttttgagacagggtctcactctgtcatccaggctggagtgcagtggtgagaacatagctcattgtagcccccatctcccagactcaagcaatcttcctctctcagcctgccaagtagtgagactacaggtgtgcaccaccacgcctgggtaatttttttgacttttagtagagacaaggtctatgtactgtatgtacgtagtatatatatgtaacatatatatgtaacatagtatatatgtgtaacatatatatgtaacgtagtatatatgtaacatactatgtatgttgcccaggctggtcttgaactcctgaactcaagcagtcctcttatatggggcctatcatttgcttgtagtcatccctcagtatctggggaggattgattccagggcccctgctaatagcagaat

SEQ ID NO: 58373 - DNA, 1050 bp, Homo sapiens
ccatttcaaatatctgccctattatatttatgtctccctgctttaaaggcagccctaatcttggaaagctatgcagcctatatagttagaggtgtaaagaaattctgattaaaaatggctttattacatatgggtctttttctcttggatttccctataattagaggtttcttattttaaaaagtatttctttgaggaaacttatctttcttattaattattaagttgaatattccaggtgaaatgacaatctgttatcttcacatatggcgagttttggcaaaggcatatgtagttcagtaggaaacatcttcttttttaagattgatatgaattaactgtttggggcaaaactgcttataagacccaaaacatgcttgtgtgtttctaatagctgtcctttggattgatttcttcaccctcctgcctgtttctcttagttttctgaagtttgattttgattacatcttgtctttattttaaattcaggtttatatatgaaacagaacatttcaatggtgttgctgaacttcttgaaatattaggaaggtaggtcaggtttttttgttctttttaagaattaagtaagtgaatgttttatgtattaaaatcttagctggggttggagaaattatgtcatattttagagtttaaatgtagaacacatagtttctcaactgaagtcttttttttttttttgagacggagtttcgctcttgttgcccaggctggagtgcaatggcgcgttctcggctcactgcaacctctgcctcccgggttcaagagattccccagcctcagcctcctgagtagctgggattacaggtgcctgccaccacacccaacgaattttttaatttttatttttagtagcgatggggtttcaccgtgttggccaggctggtcttgaactcctgacctcaggcaatccacccccttcggcctcccacagtgctgggattacaggcgtgagccaccatgcccagcctcagctgaattcttattaccttttgccataacactttgccttccttattcactacgtattag

SEQ ID NO: 58374 - DNA, 1094 bp, Homo sapiens
aggagatgcacagactcagtacatttaggagagtgacaagaagaaattaggtgctccaggtaagtggactccaaagctttagcagagggatttaagtgaaatgtgggtaagtaatgtgttctccagtaagctgtcaaacagcacctctctttgggttctgaaataatttctgattacaaaaattttggtttatctacagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttc

SEQ ID NO: 58375 - DNA, 1070 bp, Homo sapiens
tcaagcaattctcctgcctcagcctcccgagtagctgggattacaggaacctgccaccacacctggctaattttttgtatgtttagtagtgttattatcaagagcccttcccaaattattgggactataagaaaaatacctgggttctgaaactgtcataactctatatacttcattcagactatacttttaatgtccatagctcagtttgaggagaaaaatactgactcctccctataataaagtgattctgaaagaaagctgtttttcaaaaaagctctgcacaaataagataggcaatatttaattttgtggcctaatccaacaataagtgaccttgctttgagatgaatttccctaaaactatacccagtccataagaaggtgagctcctcttgttcccatctcatagttaccatagtttcaagtgtttcctcatttctagtccaatggctgtctttcctcccaaactcagaggaggattcctgcctccagtcctctgctcttttccccatctacgatgctttcctcctgtctaggtttactcatccttcaaagtctcagagctttccctgaccactaagctaaaaccctttctggacttcagcagagctatttatcctatgaatgcccttcacagttccttatggtctggaatcaataatttaaaacaataggattgttctctcactaactcttgaaggcagagttgtaactctttaaggcagagttcttatcttggatttctgacttccacaacctggtaagaatactttttttttttttttttttttgagatggagtctcactgtcgccaggctggagtgcagtggcgcgatctcagttcactgcaacctccgcctcccgggttcaatctattctcctgcctcagcctcccgagtagctgagactacaggcacatgccaccacggccggctaattttttgtatttttagtagagacggggtttcaccatgttggccaggatggtctcgatcttatgacctcgtgatccgcctgcctcagcctcccaaataaaatacttctaagctcaatttagcagggtgacc

SEQ ID NO: 58376 - DNA, 1032 bp, Homo sapiens
gtcctttcttatctggccccacagcagctctgaggaaggagactgtgttcacttaccttacaattaagttcaaccccatctaccctggattttctgatagctcccactgtgatccgaaaccaaagggtgaaaactctagtgaacctgtacattaaagaaattttagcatcttttattactgtctaaattggaagtcttttgttggcattatgagctcttttgaacaaaactaaaaaatgtgttttaaaatcacattttagagtttagagtgctctcacataggtatgcccctatactgtagtgacgtaggcattttgttcagctttgtgggtggcaaagctgaggctcagcttcgatgatggatctgagcctctgggtggagctggtttctgcctttgttacctgtctgctctccgttacaccacacagcgtctttagtaattgacaaccagatctcaccaagcacacctactaagtatttacagggaatgctcagctgtgtggatctatgcagctgtgctttgtccctgtaaacttgaagggttgaaacaagcgttgaaaattcagagaaatacttgatctgaaaaccaagtactttgaaatttggaatttttattgcttttaattgtgagtcttacatggtagtttgaatatggtttatttttaatattttattttttttggagacagagtcttgctctgtcccccaggctagagtgcagtggcactatttcggctcactgcaacctctgcctcccagattcaagcgattctcctgcctcagcctcctgagtagctgggattgcaggcgcccaccactacacctggctaatttttgtattttcagtagagacagggcttaaccatgttgaccaggctggtctcaaactcctgacctcaggtgatctgcctggctaggcctcacaaagtgttgggattacagacgtgagccaacatgcctggcctgaatatggtttaattgtgagtacagatacctagtgacaaatttcagtgacaatccaaaacacctat

SEQ ID NO: 58377 - DNA, 1052 bp, Homo sapiens
aataagggcacaaagagagagttgtttttatggaaatgaagttgaatgcagctactgcccccaagtctgagtgttggttcatctcctccatcaatttcttgaagtccacaagctataaactaacagagaagttatctcctccctatccaccaagtttcctacccaaaccagcatatagcagtggaggaagaatatgatgagagcagtagagctcccatttggaaaaggaagaaggggaagggcccgcagctctgctctgcagcagtggtggaaccctgcagggtgggaccggtgagacgccttcttggcatgaagtaagctccttggtttgaacctgttgctgccctcagaaagagactcctgtgtgctctggcctcgtcccctgggagcttctgccttggtggtaatgctctgtggccatatctgaagtggacattagaaaatacgccctccctggtggctgcacagcttgtgccactcacttcctgcttgtgtgagcagctttagggctaaacaattgcaaacttggagggcggcttcttacctgcctcctgccactgcctatgtttgcagtgagatttcagaaatgtgtaggcttctggctgttcgcatctaatcaagttcatgtgaaagtgaccccagtcgagggtctcatcctgttgtatttgtaaaatcttcggaattttgctgattttctggtgctttctttcatgctctcaatttaatggtagttattttttaccaaatgctctgctctggcacaataaggtttgccacctttccagcctgcgggatccttatctatttccttactgcccgccattttcccactgcccaaatgtttggctgttccctcattttgattttttttgcaaccataaaacactccagccgggcgtggtggctcatgcctgtaatccagcactttgggaggccgaggcaggtggatcacgaggtcaggagatcgagaccatcctggctaacatggtgaaaccccgtctctactaaaaataaaaataaaaaaatcaggcgtgtgtagtggcacgtgcctg

SEQ ID NO: 58378 - DNA, 1042 bp, Homo sapiens
cagtagggaccagaaaggccagaaaactagagactgaaaccatccagattaggggtttccagattcagagtgctgggctcagtaaaatttcaaaaaattggctggggtgggattggcatagagataattagaaaaacttccttccatgttttactcttacttttgccacgtaaggatatttaaaccaacaattgctgccatatactgacaacattctttattaaaagacagagtgtgtcaactttaagaaaaacctggtaggcgagacaaaaatatcagagtcaaggcagttcacaagaagtggccagtgatcactttaaaccatctcacatgtatgcatgagtatttactcattatttcaaaaaatagtttcttctcattttgctggagaccactaaaaatggactggcctagttctgtggactgctgtttgggagctgctctacagactgctaactaatccatctgggggctaggtaaatgtgaaatccaaaatcaagcagatgaccttcattgaggggtgactctaattccaggccctgtgcccagtgctttgcttgcctgaggagggatgagctccccgtcgtgtgcaagtagaggagcctactcctgcctttgtctgatgctgatcaccacgacaaccaccacgacccaggaaagctcactggtgagttgctcttttcaaaaacatgaccactatgtgaaattttaaaactccaatataacaaagccataagcagccttttggaggctgccgcagcagaatctaaccacactgggatttgatgttcttctttcacaaagggacagaaagttaccaggtttttgggcacaagcttctgtgccgtgtgacaaagcactcctttgaccattgtgctgggcctggtctgagaccgcaacaaccaaccagttaggacaaaccaaaaatagccccatcttctaaatcaagacaggcggagaatgaccaccctgagtcacccaagttcaattgttacacattttatttttggatagctttagtgggcaccaaaagtgtttcatt

SEQ ID NO: 58379 - DNA, 1092 bp, Homo sapiens
ctctgttctctggttgccttgttggttgatcccttgaggcggtcgatacctattggtgatggagcaaaatgagcagtcggtgggtgttcagcagcttggcatgggctgggccactcaccagctttatgacctcaggcaagtcatttttacctccctggaccaatgtactcattatgaaatgagaatctgacctagatgattctaatattgagagggtgtgatttccattagatagagtccatgattccttcctttttaaaattggctgggcatgggacagggccagtggcttcgagtgtttacccagccaggggaggaggaaggacatagccaagatgcctcagaagctttccaagggagaaatggtttatatgtgagaattggttctctttcaaatatgtaatgcagaaatgctggcatcagcaaatagtggggtgaaacctacctggtctgtgaagaacttggggtcaatgagagtacaaaagaggctctgactgacctgaatgtcttgaaggttccagttaattcctcactaacagggctttattgaattgataacaacagaatgagtttttcctgaaatggagaagatggagtcacagtagtaatgactacccggtgtgtatgtaaatctcatatgtccttctcaacagccctttggggaaggcagttttgatctcaaattacagaggaagagaatgagaggcccagaaagcctaagtgatttgttggtggatgctcagcttatgagtggcactgataggcttagaaacattgtctctggcccttgatgcccagctttgcacctcttcaagaggtctgggaggaagaccaagatatgaagagttagtgaaaggccagtactggcttcctagtaacataagatggttagcaagcaatgcttagtggaaagaggatgaaaattaaaagtgaaaattcaatgtagctgtagctactaggaaataaaaatctgggagctgaatttccagttaaaggaatacatgagtaaactttcactttcttgaaaatgatgaaactgccaatgatacaacatgatttctgattggaaataatcaagcagaaacaaaatgc

SEQ ID NO: 58380 - DNA, 1072 bp, Homo sapiens
ggactgtgctaatgaccacagatccccggttgagaggaatgcccagaccacactcatcctacactcatccctatactcattgtcccttgggaaccaactgcagggaggaggggaaatggccaccactggagggagtacacagcaggccaagacttatgggggactcttccaaattggggccatggaactgtcactatttctactctttattttccttttgtcatccttttgggttcaccgagctatagaataacagagggagatgaatttagcaaatacatcactgaagcttctccctcggaagttgggcccaagcaatgggaatgagaaaggtaaccttggaccgtgggggccatttgatttgatgaccccatccccacttcatttatcagttggccaatgaggcatggcgagtcaggcattgggccaggctctgggtaaagcaatggtggagactcaatgcttgcattggaggagctgtcagtcatttaccagacacagactgggtcctagagagctgaaattactagctcaagtcactgctgtttagtgccagagccagccccagggttccctgcccccacacccagcctaagtctatccctataccacaggcctgaacaactcccccacaatacagtgcctcacttttctttaagaccttttgctttgccaaccttaaccttaagaatccacctccccatcccctgccaaagactggggtgaagaaacgcacctggctacagttacctttctcattcccattgcttgggcccaacttcgggggagaagcttcagagatgtatttgctaaattcaaggattccccactttttgcttttacttccactcactgatagtttcagcttgacgtcaagcctctttgaaaaagaggcttttttttttaagtgaaagaaactttattttgagtaatatacaaaaaaaaaaaaagagagagagagagaaagaaaaagaagctgaaaatgagattactcatgatttttaaaatggcctcactgatttttaaaaaatgttcttcctctttcaggactgtttgtggccacatttgcaca

SEQ ID NO: 58381 - DNA, 1066 bp, Homo sapiens
taatcctggcattttaagaggctgaggcaggaggattgcttcagccaagagtttgagaccagcctaggcaacgtagggagaccttgtctctacaaaaatattttaaaattgagctgagcacggtggctcaccctgtagtcccaactactcaggaggctgaggtgagagaattgcttgagcccaggaggtcaaggctgcaatagaccttgatcaccattgtattccaacctgggtgacagggcaagaccctgtctcaaaaaaataaacaaataaataaaaataaaaataaataaataaatagaaagaaaaaagaaaatgacaaaaaaagtttcacaaatgtcttcatgcttataataatatattaatgcatcatatatcacaaatacaaagtctggagttttccccttaggtttataataaactatacaactcctatttaatgtatttacttttataagccttctctgtttaggactatatgctatgcaagtacatacatgaaggtttttgccatgagaactatagttctcatctcaaattagtggcttgccttttaacccatacttatatacatttcatttccattataagacacttaatacccttctagtggtacattctaatcaacatattttgaaaatctttatttttagataaagctttttatgtatttaaataaataaaacctgttaacaatttaacaattgaagcacaatatagtaactgtgttgttttgtttaaactagttcacagctgtgggaaaatgtttgattttaagactataaccaaggtgagactggacagttgtaagcagtgaaatactagaatacagtgaatgaataaataagattttttttttaatcagtggccgttcattattttgcttttaggaacctggaagaaatggtcttctttaagtttcaaatgttctggtaaatgtaggcgtttcttagcttccttaatatcaccttgaattgccgaaataagtgactctaaagaagcaaagttctttcgggtctgaggtagccaaggatggccacattgaagatctcgccacgcaagtcgt

SEQ ID NO: 58382 - DNA, 1371 bp, Homo sapiens
caccaccgcccctctgtcagcaggaaacagttacagaagactgaccttcatccactttccaccaaagatttggggtcttggactcttaaggcaggggtaaatgttacagtaggtagctagtcaggtatgagcagggcaggagagggctccctaccacacacacaccagaaatgttgggcaaccatcaggtgatggccaggcggttgttaacagtttgtttaaagtaataattagtcacagctggtgccagggaaaggtaggctcctaatagatagaaaacacctgaaactgatcagcagcttcccaataagatcctggaagtatgccaacaaataaaaccccaagtcaagatgttaagctgtgcacttggtttctcgagtcgcctgcttggccctcttccaagttgcattttccttctttcctttcctttttttccttactggcctaaagcttttaaaataaacttccactcctgctctgaaaaaaaaaattacttagtcaaaatttatttcaaggcctgaaaacattcagactaatcaaaatggcactactgtaacttttttttttccttcttttttttttttttgagacagagtctcgctctgttgcccaggctggagtacagtggcttgatctcggctcactgcaacctctgcctcctgggttcaagtgattctcctgcctcagcctcctgagtagctgggattataggcgcacgccaccacgcctggctaattttttgtatttttagtagagacggggtttcactgtgttagccaggatggtctcgatgtcctgacctcgtgatccacctgcgtcggcctcccaaaatgctgggattacaggcgtgggccatcgcgcccggccttgtaacttcttataatagttaatataaaactttgaaaaatgtagatacagttaactaacctctacgcaccataccatccatcttaaaagcaatggctatttaacaaaatgtaaggtggctataaagtataaaagaacattcacacacttaaagagaacataattaacagcaagctagtcagacaaacaaacacaaatattttcacattttctatgtttgtttttaactttgcttcatgaagccacttataattgaggcttctttcaagtacaggatttctaatatgaaaaatagtattttctacatagctctataaagaaatgaaaagccacaagctgcattgtttgccataaattcatacaccaaagagtaaaacacaatccaactaaatttatacatgtttccctcttctccaacaactgcttcagatgtttttctatgtactttcaaaatatttttattaaagtcagttcaaattcatttatgcagattaggaaaaaatg

SEQ ID NO: 58383 - DNA, 1049 bp, Homo sapiens
ccagaggcaactgctgataacatagatcttagagagattgtcctagatctttttttggtttgcgtctaggcaagattatacctgaggtttggtttttgtttttcttttaacgaaggactctgcactgctttcagcgttccaggacttaacaacacggatgatcggcagttctttgcgtttatttttggtcctacatgttgttcttcaaacccatttcctcttgttctttccccaacagaggcagagaagtgttggcctcgagctctgcctatgattttcctgcagaactaaactaccacaccttaacctgctctcctcaggggtgaatcaattcagtgtctttcctcttggcaggtgagtctcattctccaattgttttgccactttggggcatcccctgagccttctgagaggttgagcgcaaggcatatttcttctaacaactagctcactttattgacattcacctacctgaaagcaggaagctggatcagataactttggggacttcctttcagttttgactttatgtgcgccctctcgggacctggcttaggattctgctcatggtaaatatttggtaagccttactggttgtatgactcatgagtgtggttcctaataagagtcacagaaaacagtaaaagcagttccaggaatttgctgcttactcagtagtggtggatgcagcagggaaaataatgcaggcttcctgcccatttcccagccacttctccgtatatgcacctggtcacaaagggatggtcacaaagaccataagacagaccccagagaccccaggcaacgtgttccctggcagggagtgtgtcctgcggatggtgttcctcaaggagcacaggcttcttaggggcggctttcactcaacttggaagggaggtctaggtagaggggttcactcaagtggactccttctcatttcctcgtttctttctaaggaagccacttttaagtgtgatggcattgagactgtgtattgctgcaccccagtgccagtgaacctatgaaatacagccgtgctcactctgtgc

SEQ ID NO: 58384 - DNA, 1097 bp, Homo sapiens
aatcgtgtttcctggttcctgttttctactctttcttgatttattctcttgtctttgatgtatcacatcctctaccacccacctcctcccagctcacctagccccaaatcctctattaaggcaactttcttacatcacctgtgaagatttccctctcccttcggttcccttgttagattgatctcaccctcctttgtgcctccatggcaccctctatcatagccttggtccatcatgactactgaacacctactgtacacgttaggcactctgttcaacattagggattctgagattaaaagaatgtgtttcctgttcccaagggagttctggaagctaaatgagaatgccagggttctcactggggttagtactgccctctagtggaccctttgaaaaagtgaaagaaagtttttggttgccatattaatgggaaagtgtagctggcactttgtagtcaggggccaggcatactagatgtctcatatgtccagcacaactttaggatatctcactagacattcatttgttaaaatatgtttataattattcagcctaggacctaattccattttacacacaaacccaaactactcttagcactttttacattgtcattgcttgtgcaaccgatagaaaacagctgttgttcagcaatgtgagtttagagacaaatttctttttaaggtagcatgagatattttaagaattctttatattggtcattgatggcgcttagtctctaagaatcctagtgagaggcttcacaaatcagtgaatatggttatcagtgctgttaattaaaaaataaagtgtaggctgggcatagtggctcacacctgtaatcccatcactttgggaggctaaggcaggaagactgcttgagtccaggagtttgaggctgcagtgagctatgatcgtgccactgcactccggcctgggtgacagagtgagatgcttgagcccaggagtttgaggctgcactgagcagtgatcacatcactgtactccagcctgggtgacagatcgagaccctgtctcaaaaaaaaaaaaaaaaaaaaaaacacaataaaacgcaaaatcccttaagtgatgga

SEQ ID NO: 58385 - DNA, 1015 bp, Homo sapiens
gtgtacacgcagagctctctattcatttagctattgtatatagtattctagtttatgaatattccactatccattcctttacagggggactaacttagattgttcctttttttcttgacatcttgttctaggttcctttttttttttgaggcaggctgaagccacccaggctgaactgcagtggtatgatcatggctcattgccacctcaatctcttgggctcaagtgatcttccagcctcaacctcctgagtagctgggacttcaggcatgtgtcaccatgcctggctagttaaaaaatttttttttgtagcgatggagtcccactatgttacccaggctggtctggaactcctgggctcaagtgcttctcctgccttggcctccaaaagtgctaggattacaggcatgagctactgcaccagcctaggttgtttttgtttttgtttttttttttttagtcttttcagagagtcagcttttagttttgttgccttctctaatttttttgtttgtttgttttctggttccttgatttctaatctttattatgatcctcctgtttttgtgaggttcccgttatttttagcttcttgaattgagcacttaattcatttgtttgtcttattttttaataaattcatttaaggctacacatttatctctaagtcctgatttagctacataccacaagcattgacatgtagaactttcatagttcagctctattttttagtttccaaatactatatagaagtttttgttgttgttggttttttttgttgttgttgttgttgttttgttttgttttgttttaccgttttccttttattgccttccattgtgttgagtgaattttctttttcctcttatttttctctttctcagtttggaaactgtatactgtgtttctgttccatttgtgtttcctataaattttatttaattttaatttttattttattgagacatagtctcgctctgtcacccaggctgtagtacagtggtgcaattac

SEQ ID NO: 58386 - DNA, 1040 bp, Homo sapiens
atacaaaatttagctgagtgtggtggcggtcacctgtaatcccagctactctggaggctgaagcaggagaatcacttgaacccgggtggcagaggtggcaatgagccgagatcgcaccattgcactacagctgggagacaagagtgaaacttcatctcaaaaaaaagaaaaaaaatgggggcctcagcataatgatgataaaaccatgagaggaagtgaaatcactcaaggcaagtgcagagagaggagcagatgttcttgaagtctgaaagaggaaggggagctagtcaaggagactgacaagtagccaccaatgagagagtggtattgcagaagtgaagggtggaaagcatttcaagaaggaaggagtaagcaagtgagggattccgaatgctgctgaggagtagagtaagatgaggacagagaaataccctgtatatttgacaatagaggcttctgttttagtgctgggaacagtagccagactttactgatagtaagagtaaacaggaagtgggtcagtgtaggctctttgttttccaccactccattagttgctatcattgttattttttgtgatgccacaactacattgacatatacagtccaagattagctgcttattcatctaaaataatggtgatttcttatgcttgttttaggatttggatgatgtgttggagaaagccaagaaggtaagtcaatatttgtaattgctcttttggttttttattttaactatcatttcaagccaaaacagcttgaaatttagatatactaccttgatgtttcagtagtttatagtaagtagcattttttatttttattattttatttatttatttatttatttattgagacagagtctcgctctgtcgcccaggctggagtgcagtcgtgtgatcttagctcactgcaacctctgcctccaaggttcaagtgattctcctgcctcagcctcctgagtagctgggactataggcacacgtcactgcacccagataatttttgtatttttagtagagacagggtttcaccat

SEQ ID NO: 58387 - DNA, 1121 bp, Homo sapiens
ataaatatgtttacatctactaaaataaaatgacaaagaccacacacacaaataaatttgtacatattaaataagtaatatgaattatattctactattaatttctacttatcattcttgacttgctgaaagcttccagatctattttattaggagtttgaatagtctcactgtaaatctgttttgctttttcataggtaatacatattccaagaggcatggttttttcttcatctgatcttcctccaactgtgtaatttctgtgactcaggctttctaagtgttagacatttcctgggtgatttctcctacttctccagtccctctgagatctcagagacatacagtagtttggatgtgtgatatggaaaaagctttgcctggaactgtttaacctactcagcttgttgtcaaatagcttttctgacatctagggtcatatacccatcatttttcatgacaatgttaattcttcttccagtctactagaatatatttcaagtctactagaatatatttcaagtctactagaatatatttcaaggccttaacttaccctccttcatctttgttctctctctctcatagttgtaaaatctactcctgttcctctatcatctgctttaccttccttttcttaattctctcttgttctgattatcctcaggagaaatgctttgcaatttatatatcctgaaactaaaatttgcaatgtagtctaaaaggtatctagaagcaattttccatatatttattttccctgcctaagaagggaaccctacagggcaaattctcctcagtggaaaaggtaatatcattgaaactaatggtacacagctacttcaatatttaacaagcatatatgagatactcattgtttatattgctgggcatctagaacaagtagtcaaagcagggctataaagacaaatgaaatcagtgaaaacagtgcaaaggaagtatgggattatcattataaactcaccaaccagacgaattctaaggggagaacacaacaatgcaatcgcaaagctcacatgcagagatgactccctggtggtttgcctctctttttcttagtgatttcagaatgtccaaatgcctcctaaatgtcaggaaat

SEQ ID NO: 58388 - DNA, 1029 bp, Homo sapiens
ttactaaatttcccagaagcctaccaaggctgccctgtggatttcctgagccacctggtagagctgaggataatgagtttcatgtggggccccctctactcctctctggttctcaagggcacgggcaaggccagagtccatccaccccagtggaattcagagagtggggaattgggaatcacgagcattggcctgggtctttcagatgccagagaatcccccagtataaggtaaagggttattttgggggacagcttctgtgatggttaatttgatgtgtcaacttggtgaggctacattactcagctagttggttaaacattattctagatgtttctgtgaaggtatattgtaaattagattaacgtttaaatcagtggactgtgagtgaagcatgttaccctctgtaaagtggattggcttcctccaatcagtcgaaggccttagaaatagaaaaagactgaccttcccaagcaagaaggaattccgccagcagactgcctttgggctttgcagggagccagggcagaaaaggaggaaagtgtctgtgatttagtgctactgaggaaacccatgcattgacagatatgaaacactcctgggagggggtagagagcatgtggactttctgccatttcaggtaaggtcagagtcccaatggatatattgtcttgtgacttttgagtttctggttttagcctgagactgttgtagggtgtatagaggaggataaagtagaaaatgcctaaggtggtgttagaaatgcaaaatgcttgttccccagtgcagcaaagaaatagcactccaacataaatttaattttctcagcaaggcaatttttactttctgcagaaagtgtgcccttcacagatggaacaatggtgagagcatacctggacaggggaagggaaggagttattcctgatgcaggtagctcctactgctgtgtcgttcccctattggcttaggttggacagcacagtctaagctaattccgattggctgttttaaaaagagcaggagtacgag

SEQ ID NO: 58389 - DNA, 1101 bp, Homo sapiens
ttatcgatgagaaagctgtaaaggtgagagacaggagtttacttcctcaaagtcatacagtgagctgaggcagagccaggattcaaacatttatttgtcttataataacctaatatatgtaatatatgcctgaatcacacagggacaaataacgaaattttaaaaatgttaaaatacggttttaaaatgtaaaagtagccctaaacagcaatagatttgcaacgtattcatcacaggaggaaaagtttgaatgtggtgctcgagaatattttggctactttataagactaacaccagaagtggagaataactgcttcaaataatcagttgttttattggtgcaaatttttggttgggagaagacaatagaaagctattatttttctgtttcaaaggagaaagaagaagccatatttcatcctttgaaagtagcagttaggtgtaaacaaggccatagatccatggctttttgtttctctttcttcaagtagacttaagttcgactttcctacaacatgtagctggtaaatacaggcttgatttttgccaaaagatagtttgacttcctgaaactaacagataactcttgtattcaaaaaataaatgtaatggatttaaagactggtaagaagtattttcttttcttttcatttttgagacacagtttcactctgtcgcccaggctggagtgcggtggtgcgaccttggctcacagcaacctccgcctcctgggttcaagtgattctcctgcctcagcctcctagctgggattaaggtgcccaccacccctggctaatttttgtgtttttagtagagacaagtttttgccatgttggccaggctggtctccaactcttgacctcaggtgagttgcccgcctcaggcctcccaaagtgttgggattagaggcgtgagcctctgcgcccagccagaagtcagaaatattttcatttttgcatttcagttcagatttgggccatttagatttattttgccatggtaaataaaaaagtaagagacttaagattcattaaatacccatgactaccttgtaagcatagtttttattttctgaaactttgttttataactatgtgagtt

SEQ ID NO: 58390 - DNA, 1116 bp, Homo sapiens
tcagttttttccagtatcaagtatgtcttctctggaaagccttctctaatttcctttggctgacatagactttttttgctcccacttccccaccataccttgcaattatcacacactgttatacttgtttacatgtcaaagtttccctagattggagagtcctttaagaaaaagaattacacttttcatttttgtatcattggttgctagcattcccgtatttgttcaataatgaatgacttattaattgttaacaactttagagaggtactattattttttaggctgttgggatgctattaaatatcatgacactacagtgcattaaatttgacaataccaagaaagactttgagctgctttttaaaaaaatcttcacataacagtttatagtaacttgatgcccctctgtttcagcattaatcaagtctgatctgcgaagacacaacataaatataggaattacaaatgttgatgttaaagctgtaagtaatatttttatgattatactgttgagaagtatgtatagaataaatgtgaaaccatatttttttatttagctatttttctcccgagtcaactgttgatctgttataataggatatgccagatgctatacatttttaatcttctgattgtttttatagataccagctgacagtcccacagaccaagaaccaaaaacggttatgttgtccaagcagtcagaatcagcaatttgaagagaaaggcaaagttactgtcctgtagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaatactttttaaagtgataatatggggtgttcagtccccataagatataatagttcat

SEQ ID NO: 58391 - DNA, 1042 bp, Homo sapiens
ctcatgatctgcccacctcggcctcccaaagtaccgggattacaagtgtgagccactgcgcccagctggtcttcccttttttacacagtggccacatcatattgtacttttcatagtaactagaaggttacgcgaaaactgcttccaagccaggaatccccagcccaaatgtggacagtcagctttttggccctaaatataaagaacttaacatttctctcacattgcatcttaatggttggttctctatccccagtcctatcatggtatctcccctggtcctgacattccccaagccctgacccctgcctaggccttaacatgggaagagcctcaaaagctcccttttccaggggccactcctctcggattagagggttgtttctgtgctcagcatggcagactctttcctctggggtcaagtccttttctccatcaaccaaatcaatatcttactgaggaatttgtacagaagaagggtggtagggtggcggcggtggtaaaagcttggcaggcttcagggggattaaccatttttggccattgaatgtagactaagaagcaaaagaagtagatgggggaggttttcaagggcctgcatggaggactaaatgacacttcatttgactacaggacattcccttagcagccatggtaacttctgcctgaaggtccagatatccccatcttgcagggattcccctgctttgagatcctccttctaaatttgtgactgcaggcctctcccctggaggttgttgagtctgaagttagcagttgacgaggtcaaaggcaggatttttcagaaagactttaaggaaacagcaagagtcagttggaggataatagcagatgggaagcgaggctcagagagagtggccagcccagaagaaaacagtgggcattctaggaaaattctaggacaatcctcctgtttcttaacagcttggaactggactctccttggggcagaaaaccaggatggattcagcaagaaacagcagtcggtttcttgcagacctcacttcttgtgccttattct

SEQ ID NO: 58392 - DNA, 1054 bp, Homo sapiens
gctggaggaatgagagtggcagagaaaggatatgcgtcaatgcagacctgaactaagacagtgccagtgaaggtggagggaagggatggaggcatacatcatcaccaccactaggggactgcttagatgggaggagttattggagaaaggcagtgactccacatttctggcttgcatgataatgccacaagggaagaacttcaaggagaggatcggatttagggaaagatgagctcagatttggacatgtgaaatttgaggtgccttgtgggatgtcggaatgaggtatttgcaatgtggagctcacaggggaatctgcactggaaatgcgaatttaggagctgtgattaggaggttgtgcttactgttcaataagtgaaaggagaaaaagatcaaagatgaaatcagtattttttggtctagtttggcacaaagagcccatgaaagagacttaagaaggaaagagaggtagaaagaaaaccaggagagaaaggggatggagaggtcagtggaaggacatgtggctcagaattagactggggacaggaggattggtctagtctgttttctgggtctcctggacatctttgtgggaaggagaatctctgtgcctctctgcagtctgtggaacacttgcagccctgatctgaaaccagattgaccacaggtgccttggctgacatttgaaaaatggaaacttgaaccttactgaggcccctccccaaccctcttgtcatcctcctccctgtttcccacaaaggagatgaaacatgtgcctggggaacccagcaggaagctgggaatgggggtcggggcagcagatggctcagggccccaactctttagtggcaggagtcagccacagctgttcagcgaagcctcctgcaagtttaatgggggcagatgattggctggggatttgctggtggaagagatcaacgaaggggaacacaagcccaggcccttcatggggtagacaagctaacttcagactctttgttgaggggtgtctgagtgcctctggatttaggtcattgaaatgaccacctccctt

SEQ ID NO: 58393 - DNA, 1040 bp, Homo sapiens
ttttgcatgtatgtaattactgaagaaaatgacaagtttttctctttgtctcatatttacttggtttggatatacagcatatagtagatagtcaaacataacaagcgaatcctttataaaaggattagtctggaaaagttagatgtgggcctgctcagaggcagggggatggactcactgaaccctgagacactttcccttcctttgcatccaggcttcaaattttcaaggcctcctttctcttccttgactcagattgtctaagctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaaggtgggtgctgggaagacaaggaagccatgcaggagagctcttttcccattcctttctctctgtctcttgctccaggcctcatttttctaggatggccaaaaatttcttgaggttaaagtctctctttgcacatactactgcaaagaaagccatctaaaatcaatttagatgcgacagttaaaacaatgtctcgtcctgcaattccttctatgaaatcagatctaaagtgttagtcattttatattgaagctctagtttgttctgttttgtcgatgtaatagggtgaccagttgtactagtttgcctggaactgcgggttttcccaggacatgagattttcagtattaaaacctggaaaaccttatatgctggccttatatagactatactcat

SEQ ID NO: 58394 - DNA, 1036 bp, Homo sapiens
atgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgt

SEQ ID NO: 58395 - DNA, 1018 bp, Homo sapiens
aattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggagatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaaggattgtttttcttctaaatatgtaagatgtggccgggctcagtggctcaagcctgtaatcccggcactatgggaggccaaggcgggtggatcacctgaggtcaggagttcgagaccagcctgaccaacatggtgaaaccctgtctctactaaaaatacaaaaaattagccgggcatggtggcgggcgcctgtaatcccaggtatttgggaggctgaagcagaagaatcgcttgaacttgggaggcggaggttgcagtgagctgagatcccgccaatgtactccagcctgggcaacagtgcaagactcagtctcaaaaaaaaaaaaagtaagatggtgtgatttttttttttggtcctcttattatatatttattctactgaacctatttatcgttctttcacccttctttcac

SEQ ID NO: 58396 - DNA, 2142 bp, Homo sapiens
ggactaaattatactaatttattctccattcaccttataaactgctacagggctgtggcccggtgtctctggctttatgcaactacagaatggttgctggatgagtttcttatgtagttgtcaaccacaaattacccttaacattcttaagtatttcatttatattttcttctaaagattgtttacagagctggaaatagaaaaaatatctcaaactgctgtgtgtttgataattataattaggttataattcaataaagcttagatattctaaaaactgtgtcatagtttttagtcttctggaggggcctcaagttctatatttgtttggagaaaagacttgtatgattaatttacaataacccgttgacaattttactaaatatgtgtgtgcttctttaatgtaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcgtgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaa

SEQ ID NO: 58397 - DNA, 1052 bp, Homo sapiens
tttcaactcataagctatttaaaatcttttcacttaagatacctgttgaaattttgtttaggtatctggccaggaacagtcttcacggggacaaagaattttatctattccaatttggcccccaaacctaggtatctcacagaactgtgtgtatgaggtacagcaggtaccaaaagtagaaaagacaggtaagtgtttgtaatacattttggcagtctgctgggtaatcatgttccctttgaagacataaaactaagtttttaaaaagaaaaaatctcagggatgaatattcatatatataaatatgtagttattcattttttttcttaagacctctaaatttacctttttaaagttgaacttccagaattatctgtgcatgatttacttgcatgttgctttggaattgtttgcatttttctatttttcctaattctggaggccatcgaaatatatagattccagaatgaaacatgtaactaggcatctttctaacctagataagtcttaaatattgtttctagagtaagatgacgatattaaggcaaactagaacaataacattaatatattttcctctattcttacagacagtgatctgacacaaacacagctgaagcaaacagaggtcctagtgacagctgaaaagtgagttctggaaagcaaaaggagacatttgctaactttagttgaataaaaaactcatttctcaaaaatcacttggataaaaaaatgaaggtgatagtattccgtgctggtgaagggtgctggcccttaagtcagataggcctgagttccagtcctgactctgctgtgttttagccgaatgattttgagcaagaaacttaacatctctgaggttcagtttctttgtctatagtttggattgttgtgaggattagatgagacaaagcatataaagcacaatgtctgaaacatacctaggcacctaggtagtgttaggaagggaaacagcttgtctgtggacctggaccagctcaaatactctttgaaattcacatacttaaacaaaggtcaagatcacataaaaa

SEQ ID NO: 58398 - DNA, 2426 bp, Homo sapiens
ggtggaattccaggcattgtattccagtgaagtgaaaacctttgcaggatagagggagatattctaggggctgaaattttttatataatttaatcatacttagaagtccatttccaaatctgttttcccatgttcttcccatttttttgttttctcttttgaactcataaattctccaaaaattccgtgtttctcttcatggtttccatggcagtaagagcatgctctttaatgataggatgtaggagacaagatcaaaggtgaatacacacacacacatcacacacacggttatttctaagtcagggactgcctatgattgcaaagtcttgtgtttttttattcttttcatcacttttgcagaatgcatgatgtgtttgcagaatatgaacacacgcctggttgttgcatgctaggtttgttggttagccatcatttactagcattctgtagctatgtcatatttaacttttcctttgttgtacatttaaaagatttcttttgttattttgtttgcatgttccacttcagtgttttaaacactaaaacttcttccatatattgccattatatacacttctttcatgtataaactagaattctgaactaagggttgcttctggaacttggttaatcatttgacgatcttatcccactaatagggaataaaatacagtgtaaaatcatcttattgaaaagccaactttgacatacaaatttgttgttatagttataaaactgccaatcacatctgtggcagagccacttcttaactgtagagaagtgagaaaccacaacctctgtatagtcttagctttgttaacacatactctcagcctccagaatgacttgcaagattcttttaaacctgttttaaacctgttggtcagtatattgtgttaccgcatttgtaaccaatttgataacagttctaattattcagtgctatattgccacttcctagggaaaaacattctattcattgcttatgggaatttttaagaggctgaaaaatacatatatgtgggaaactgtatggtctgcttttgattaattccttatatttgtgcaatatattttaacaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtaagtgcaaaatattattgaaattcttcacataagaaaaagttggggccgggcacactggctcatgcttgtaatcccagcactttgggaggctgaggcaggtggatcacctgaggtcggtagtttgagaccagcctgaccaacatggagaaaccccgtctctactaaaacatacaaaattagccgggcgtggtggctcatgcctgtaatcccagctactcaggaggctgaggcaggagaatcacttgaacctgggaggtcgatgttgcagtgagctgagattgcaccattgcaatccagcctgggcaacaagagcaaaactctgcctcaaaaaaaaaaaaaaagaaagaaagaaaaagttgggttaaatgtttcatttgtgcatttatgaactaaatggttttatccattttgtttgtggggtaagaaaggaatatgtttaagaataatgatggaataagtcttaataaggtataactttcagagaggcatttgttagtggttgctggtatgaataatcatctaacttttcaaagagggtccaaaaagtttttaagtatgggtcagttttgagacagaaactggcaacatattaagtattcagtaaatattaactttgatttgaaatttcagtaattcatgcaaaaatgtcacctacctgatagcattcaaagaaatctgcctcttaagacctgaaagatagtaccaatgaacatgtaaaacccggaaaaatatcctgacatgtaagctaagaatatttccttttggaaataataattttgagtactaagggagctccatgtgattgagggccagagttttgagattgatcaaaattcggaaacattaatttggtagatctataacaagaaaaacaggtaagtcttttatttcaattcttatcaggtgtggaattttagaagcctgcttttagatattttaagataaaagcaccaggaaattcatgattgcatctctgtgttctaattcaagctatttttttcttccaaggtactttgtttgcaagaagttcaagaagatcattatggagcagagatcaggccaagtttggaatcactgggta

SEQ ID NO: 58399 - DNA, 1365 bp, Homo sapiens
gctagaattagtgctcttcaggttccctctggttttgttatcagaaagtagtctacaggcttcagctgggtcccaatcaactttgctaagctaatattcaaataaatgtgtaacttattgctacacagttacaaaggacctagtcagaaaaaaacacttgtagaaattcttaactgtccaaaagtgaaaatctgtttgtgtatagtacttaaccacagcatagggagataaacaagaaatatttgaatgaatgaaaggtgtatttagaggcattaaaattaggtttctaagaacaatcctaagatctataaatatagggcagtatgatgataccagattgcttttcactcataaaaatttgtccatcaggtcagcacactcctcttgtttagcctcttagaaatctgggatgctttcagatggagctgtggcatagctacataagcattgatttaggaaccactccctgctttcttttctgccccaccactaattatatgaacttggacagcttacttaacctctttgctccttgattttttcgtgtaaaataatgcctacttgaaagtctgttgaatgaaatgagatactgtatgtcaaagtgcctaacacactgttggcttcatagtaggtactcagaaaattatggtgttgttttcccttaatggatggggaattacatttacctactgataaagcttgattacaacctgactttctatatgtccattcttcctaggtgttgtgaataaggaaaatgctcttcgttaagccatatttgtgacttccgatatttcactaatacttttcaatcaagaaaacagcattgctaacttgcctatcactttaaagtggtatttgaaggatttgtgtgatacaattatgactttgtaattaggcaccctaaaaacctgatcaggcctattgcttactttctttgattcatctgtcttctctgctgtgatcaccttgttcctcctgatatggaaggtatataagcttttgtagtgtgaatttatgttgtgaagcatatgaaggccagagactatccactcttatcagtggttttcaaattgtcttccatggaaccctcatatttgaacacatttctgtaagtttattaaaagcaaatgtggtcagtataaaatatgtgttcaccccatcatcccagccccagtcccagcatgccagggattggtgttccatggcatgaaaagtaacacagaagggttctacaagttgtagaagtttgaaagccactgtagtaaccagataaactaatggtcctggttgtttaaaaaatggaattgcaaaaagagttgtttataaactttaatgaccaggacaataaaaatcttaatgcat

SEQ ID NO: 58400 - DNA, 1133 bp, Homo sapiens
gagactgctttggtgttatgaatgtatcttcagcatgtaggactgtgcctgacatataaataagttgagcaaaataaaagtatgagttaagatttaaaaggtagagtagttataggtgatgatgtcatcaaaagtcaatcccaaagccaaaattaaaatgtttgattatacctagtatggagcaatagatatacaacaggaagagtataaattcatacagtttctttggagggcaatttgaaataaaccttttctattctgtttttaattaatttttctacacatctattctcatgtctacatgggagatatatatgaatgactattagatgttttggtcttagattcttctttatattcttaaaaattattgaagacttcaaaggactgttgtttatgtaggttttagctattaatatttaccatactagaaattttagaaattgtattaaataaaaataaaaaatacactacatgttaacataaaaggatgtttttatgaaaaatgattcttccaaagcaaaaaagaaatagcaagaagagtggtgttggtttatgtttttacaaatctctaatgtctggcttaagaggagatagctggattcttatagctgtttctgtattcagcctgttgagatatgttattttggttgaagtacatgagtaaaattcagggtcacaaagataatgcagttgaaaaagggaggagtgtttttttttttgagacggagtctcgctctgttgtccaggctggagtgtagtggcgtgatctcggcttactgcaagctctgcctcctggattcatgccattctcctgcctcagcctcccgagtagctgggactacaggtgccagccaccacgcccagctaatttttttttgtatttttagtagagacggagtttcaccatgttagccaggatgatctcgatctcctgacctcgtgatctgcctgcctcagcctcccaaagtgctgggattacaggggtgagccaccgcgcccggcctgggaggagtgttttaatacctttttcagataattaaaggtattctttgatacaccaaaacttgatgtgtggtaatttcataaaggctagttgcattgtggaatcagaaccctgtaaatgaaccttt

SEQ ID NO: 58401 - DNA, 1056 bp, Homo sapiens
ctctgggtgacagagtgagaccctgtctcaaaaaaaaaaaaaaagattatctgtgataatgtttcattgtaagacatttatttatttattttgacatggcttttaaaagtttttgttattcactcacacagtcaataaaagcttgctagcatgctctgtattttagtcagtatgatagaacttgaagattcaaagaaccatgatattctattaagtgcttactatgtgcctcgcatgaaactgggaaccttaagtacattatccatttcctacattttaaaaatgaggaaataatctgcctaagattttatagctagtgaatgatagaggtagtatttgaattcaggtccttttagttatcgtgaaatagacacttcaccataagcatgagacacactgggcagagggtattttagtggttcagtttcacttgccagtcatataggcacttgccttgcctatataactaggaatctctttgtgcctcagttttctgttaatactctgcaaaggcacttaaaatgtttatgtggtgatgctacttttctgattttgtatttttttattgcaatcagtatgatatatggcatatgataaatgtcaactggtaatctaatctaagtactacaaaatgatcatattttgaaaatgtcttatcagcattcaaattttatgtatcatttaaaaattctatggaaagcaccttttgatcaccttgtaaagcagaactcactggtgccatatgtgtgttcttttttctcacaagcatgctgttatgtatgctgacagcatcacacgttgaatttagcataaaagctttttgcttcaagctgagatttttgaccccactaataatacagatgttctcataatttcctctcttcagcccctttataaatcaaaaagagtagaaaagggaaaattatatgagtaattacagtattagattactatagaaaaccatttcacttctttaaaattctcttttcatctttagtttcgaatcaccagcttcttaaatgtcaactttcttaaattgacaggctctaaattatg

SEQ ID NO: 58402 - DNA, 1016 bp, Homo sapiens
tctgttgctttttgggaatagaatttgttcttttggggcattctaagaagttgaaaaaaagttgaaaatgaggatatatattgacagggtgccaaagcagcatctaaagctgattagaaatttgagcttagtggccagtaacatgtttttaccctaacttactttatttgatatgaagtaggcaatttgaatttaaaataggggttggcaaaactatgttctatgggctgaatctggcctgccacctgtttttgtatggcctgaaaactaagaatggtttttgcatttttaaatagttaaaaaaattaaaagaatatgattttgtggttttgtgatgggaaaattataaggaattcacacttcaatgtctgtaaataaagttttactggaacacagccatgcttattcatttatatattgtctatggctgcttttgcactacaatggcagtgttgagtggtgacagagaccacatatggcctgcaaagcctaaaatatttactttctggccctttatagaaaaagcttgctgatccctgatctagaattgtatagtctaatccacttttaattttgatttagtatataatcctgaggatatcattttctttttaatttttttttcctgagaaacttggcagataatgttcagtggtgaatgcagatctcagttatttccaaactagtttttatataactctgttgtcagtcttatttaatggtatagatcactggctctcaaatgtaatcttcagatctctgggtgtttctgagatattttcagggagttcataaagcaaaactgttttgataataatgccaggacattctttgtcttttcaccatattgacatttgccctgatgatgcaaaagccatggtaggtgaaactgctgtgcttgggcatgaatcaaggcagtgtcaccaaaccgtaacagtactcattgcacatacttataaaaccaatgctaatttttcctaagtagtagaaactgttacattttgttaaatcttaac

SEQ ID NO: 58403 - DNA, 1087 bp, Homo sapiens
ggcaacatggcaagatgctgttctcaaaaacaaaaacaaaacaaaaaaaagagagctgagattcaagtgctttttcctttattaaaatgctattatttatagcaactatgtgtacaggcaacagctttctgtaaatagcttacaggatcttgtggtaaaggctctttttggcaaccaaactagataaagatttgtcttcaattttagtttgatgattaaggcaagaagttgtcttccagagttacagagagacagtaaaatgaatggactaagcctaaacaaattgctagacactgacttccatcagtaaattacagccttccaaattgacttggataatatgaaaaatgaataattagcatgatttgtattcgtttggctgattctcaatttaatatctgtttactattgtgatcatatttctaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggtatggttttatgtatattatgttttggcatgctcttttgttggtatgtgggaaaaaaaagtacatacatatatcttctgtatagtcttatggaaataatactgaaaatgagaaattactgaagcttaaaagacctatatatggatatatactttaagttccttgagatgttagacattatcggaggtacttaaccctctacttttaatcaattaatccacaaaaacaggatttaaaaaaaagtcagcatgtcttgaagtctcttgtatgaataataatctttcttttctgatttgaa

SEQ ID NO: 58404 - DNA, 1057 bp, Homo sapiens
ttaagttatttgcatttaatcttagaacatttcataatgttaccacttgatggcaccagaaaaataaaaatctgtgcttcaaaatgagaattatagatgcatgtcagaaaataacaaataatgtgtcatttggttagttactttgctgattatggtggtgaattatttctccactagaacttgataccaaacctactagactgctatcttaaggaacattaccatttaaccatgtatctcctatttaatgcatgtttgtctttttgaaagcacaatatccattcctgctctggattggtttctgttattaatatgccacaattccagaagttaataactgactaaattgattttagtcttttattgtttattcataatgtgatcaatttttattcagacaaactatgggaaccacaatcatagaattctaatttttaaccagtatataaaagaacctttgtttcagtcctcctggttacacatttgaccctgtgtcaaatgtaagatcaggacagtgcttccagtccatggattctgtactagcatactagtcaccacctaacagacatatggacattgtccttcaatttctggggaaactgggggctctagttatgagcttgatttgacctttattttcagaagagatgtttccttgggtaaagtttgttctggggtaacaaaactgttagtgaaatatctctatagccagtaaaacgtatgaatcatttaaattgaactcttcataacatttgttcttgtgacctttattggcatggattggcatgccttataataaaataagtatttctggatatctgataatacagagaaaataatctttcagagctaagtaatgctttatacaaagattcttgtgggttggcaaattttgttattttgttactaaactattcatcctaaagaagtttatctgggttgttagtaggtctgataaagatggcttgatgtttttcttatttaactggtatttgcacagctgagaccacatgcaaaacacaatagcaacagctctctttgcccatccggcagagaa

SEQ ID NO: 58405 - DNA, 1036 bp, Homo sapiens
cgccatgttggctaggctggtcttgaactcctgacctcaggtgatccacccacttttgcctcgcaaagtgcttgtgattacaggcatgagtcaccacgcctggccagtattctaaaagttttagggatttaaaattaccagtattctattcattcttataacattaaatttgaatggtttacctatacttattcatgtaatcctcctacttttgcatccctgttagtttcctataggcatatctatgaagcaataatttcttaggtaaataagtatgttgagcctcctgtatagttttaactagaagaatagaaccatgaagtatatcagtcagaatttcttcaagtataacttctaatgagaataaaacagaagagatctaatataggaaagctgattacatttgattatacagtaattcattaagcatcttttaagactgtatatagaatcaaactagatatactttggagttatacaaaagatgatgacacagcctgctcttgcaaatcctgtagcatagttgaggacctgtatatgtacatagttgagcaaacaaagttacactggtaagagccatcctaatgggaaattctatcagaaaggataaaaaggagtgccttctgaatctgatttgacatgtaggattttttcggttcttaggcaaggaggctagaggagagtaggcacagtatttttcttttatggtaaacatttgctttttaaattttccttttgtatgttattttgttaagcctggccctttttggccaagagcatccttgattattttctcatgtataatttaagttaaaagtcttccagaggattgtgattagcttggtgcatttattatttcacttctttaaccatctttgggtctgaatttcaaccaacacaatgagaggatttgtgtaaatgatttctaaggcccctttagctcaaatttggtgcaaagcagatattatttctctctggaatcagtgtgcaaacatttctttctagcctggttgattaagacaataaaggaaccctt

SEQ ID NO: 58406 - DNA, 1074 bp, Homo sapiens
tatttaaagcacggtttcctaacatttttagagatagcattgtatggacacttttataataggacaacctttaagtaattttgaaataaaaggactagtttccttttacctcctagggcttgggttttataatcttaggattagaaagggctttaaggttatctgacccagtgcattacagatcttgtggtctatctacagtgccccattaaatggctcttcagcttcagggccttttatttatcaatttaacaaataccttttgaatgctgccctggggcaggcactgtgttaggtgctggacatattacagtatatcagacatggttcttctttttagtctagttggaaagatataagtaaatacataagttgtaaagcagcacagaagaggccataaaaaagcatgaaaaaagacagagccacttaatgtcacaaagtcatttcattttacacagttcaaagtcttagaaagtccttttttctcttgagccaaatactgcttctttaggtctaaataccgcccttctccagtgatcatctttcagttatttcaagatagttaagttatatttctgattggtattgtttgtatgttaatttcttttatcttgcttaaaattggcctaaattacaatttgttaaatatttttggatcttccttgtacaaaattttttctcttggggttcatatagtgcttctagggccaggtgtggtggctcacacctgtaaccccagcactttgggaggccaaggtgggcggatcacgaggtcaggagtttgagaccagcgtggccagcatggtgaaaccctgtctctaccgaaaatacaaaaattagccgggcatgctgctgtgcgcctgtaatcccagctactcggcaggctgaggtaggagaatcacaactctgggaggcggaggttgcagtgagctgaggtcacaacactgcaatccagcctgggcatcagagtgagactcactatatgtatatatatatagcttctgtggaataaatatgccaccccaaaatacactgctttggcatattttgagatggctattcagaaaagctaca

SEQ ID NO: 58407 - DNA, 1024 bp, Homo sapiens
gcctcagcctcccaagtaactggggttacaggcatgtgccacctcacccagctgatttttgtatttttatagaaagagggtttcaccatgttggtcaggctggtctcgaactcctggcctcagcaatctgcccgcctcagtctcccaaagtgctgggattgcagatgtgagtcactgtgcccagccttctgttgccattttaaaactaagagttaaaagatgcttttgtataattttctagaaaatatcttttatacttattttcttctaactacatttaaaatacattttaaaaagcagaaagcaaaaatgaagtctaagcaaatttcccgtgaatacatttcttttacaataaatgtatgccagttattcagtgttagaattgaatatagttagattcttgagattctgtttttaaaagacaccacagtattttgtttttatatgaagtattatggtaaatgtgatcattaccttaaatatatggcatcaggtttttaaagtggtattttgtggattttgttaaatctgtctcaaagtctattttctcatgttatgtttgaagtatgggtatgatagtacccagaaaaacaggcctttcaaaacaaaatactctacttttatgactccataaaaaatacaatctttattattatccatagactgaataaaacatcttacattttatgtttcattttattcaccataatgcctattttcaataaaattacaggtgattttaaatatgactagacttttttttttaatagaaagatcacataatggcttaagtatattccattaggagtagtatttctcttgtctttttgttcagccattggagtcccctgtgaccttgggtactttttccataggcgaactgatgcttcatgacgttctgtgttttctggtagcttgcctgttgcctgcctctgggttcgtcatcccccttatgctgacttaggcaatatttcttcagtctcttatcttggggctttgatgcatatgttctgaaggtggccac

SEQ ID NO: 58408 - DNA, 1070 bp, Homo sapiens
tgatttctgtagtacaaatcctcctcccatggccaatttcagtctgtggctgcttttgttctataatgacaaagttgaaaagctgtaacagagactgcataggcctgcggagcctaaaatatttacagtctggccctttaaagaaaaagtttgccaatctttgctacagtagtttttccaaaataataaagctttaatagggtaggataatttcatacttctgttaatttattttatccatcaagatgaggggtgggaatgagtagtttaggggggcaatgtgtgagaggttatgaagggtcttgaggtcattttatgggcttaagctttttctctcagtgagataagaagagtgccatgttctaacttatgttttaaaaagaaaaccctggccgctgttttgaggatagacaacagggcagcaaagatggaagcagggagatcagttggaacactgtagttacaagttaggtaagagttgatctttgcttgaatcagagtaataactgtggaagtggtaaggtgagttcagattctggatacattttgaagacagagctgacaggatttgccggtggtggaaaggggtgttaaggtgaatccagggtgaagagataccaaaaggatgccttaggctagagcctgagttattgagatcacattatagcaagttgctacataggagattttaggaagaaaattgagacttgaacaattttttttgaaccacttcctgttgatcatatatgttccaagaggaaaaactctgtttaaaatagtatttcctttacttctaagaaatacattttaaaatactttaggaaacagtaatgtttctaaaatacggcatttttagaaaaggaaaccataataaaacctattttggataagattattttgatcctataatttgctgacttaaaaaaatttattcagaaatgaacaattttggggaggggattaaatttcagccctgccctactcttaaagtttagtttaaagctaagagttaatgtttcattgtattgttaataaattattactcgtgtcttttatgtaggttttacttg

SEQ ID NO: 58409 - DNA, 1022 bp, Homo sapiens
agctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggc

SEQ ID NO: 58410 - DNA, 1038 bp, Homo sapiens
ctgcctttctgatagtataaaggtatacattgtgcttaattttaaggtttgtaagaatttgcctttgttcttatgttgtcttatttaccagagatctttttttgatcctgaaagttaatatatttttgttccttatggtttttttcccccaaagagaactttggaatccttaaggtcagatatttaaagtgaaaattttttattattttgagaaaaaatcctgtggcattagaaaactatatttatctttcaccttcttccctagtgtatttactactgattatcattttaatgtgttgtatggatcttgtggccttaaaattggcctatcattctgctatttggataaagcattatgttacttatgtgataaattcttccagcatctaactattggtttattttgagtattacataaacactttatttacaatgatggctgctttttaattaaattttctatgacttcttaataacagttccacagttgctataactttgagagtaaaaagaaatgagtcttttcatttaaaaaagcctagttaagaaaaatagtttaggagttctaaattacaatagaatttctctataagtgaaattctcttctaagaagattctgaacatactgtatttcctgctgtatcttggggagagaagatagcaacaacagaatatattgccagaaggaggttatggacttgtctctgggaatttttggaatggggatgggtaactatattgttagtaaaggtaaagtgaagaatgagatgatctatgtggtgctcctttagtggaaaaaccagggaactgagtcagatggcctcaccagtctgacggtgtgtcttaacacatatctgtaaatgtggaatatcagatttccttattaagcattttaaaagtgatgtcttttaaagaaaagtaaattctgaatttgggatattgaaggccccacaattgcttaaaatgcaagatggttcatgtttttaaaactttatggaaacgttttcgattaaagcttgagtttaacttgcagtttct

SEQ ID NO: 58411 - DNA, 1055 bp, Homo sapiens
tatatatatacctgattaagcaaggaatttgaatgttatctaatggtcagtgagaattttgagcagggaaatgatgtcattcatcgcttgttttagactggaaggaaatgtacaaaaggttatattttatgatagaactatgataaatttcccttttactttgctaacatttctaataacacacaccctttataaagtctaagagtacacttccaaaggtgatagtggctccctgtgaaatgggaatgggggtgagggttatgtatttgaatctgggaggggtagcatatgtactttgaaagagagcacccagggatatgtccttcatgagtatcattattttagagaatccttgagtatcaaatcatagagttcctagagcccctcagctctaaccctcatgttatagatgacatcaagtgaattccttgactcaacccaggactcctgattcctagttcattgttctttctcatgcattaaagttgtggaaaaaactatgcagatgaacagaagggaggattggtttacgtagtttttcttccctgctccagagtaacttttccaacaagcctgaatgttttcatatcatcttgctgtactttaaaaatttaaacatttgtgtcaattacatattcatgtaggtaataaaaaaatctcactggccgggtgcggtggctcatgcctgtaatcccagcaccttgggaggccaaggcgggtggatcgcctgagctcaggagttcgagaacatacagggcaacatggtaaaaccccgtgtctactaaaaatacaaaaaaaattaactgggtgtggtggcacgcacctgtagtcccagctacttgggaggctgaggcaggataattgcttcagccccagaggtgaaagttgcagtgagccaagattgtgccactgcactccagcttgggctacagagtgagactccgtctcaaaaaatactcaccaccccagaggcaaatcagtaaaacatcttgtcatgttttcttaccagtcttttttctaaatgtgtacttttaaaattagaattgtattgtttt

SEQ ID NO: 58412 - DNA, 1067 bp, Homo sapiens
gcattggttaaaaggctaggcacctgagtaccacttacatgttttactttccaagttccaacctaactacttataaacttgaaagtagttatgaattgtgggttacctatagtcaaatagtagggtttttttttttttcagtcaattggaaatgaaagggcaggtattggcaaggcttcgggactaatttaatgccattaggaaagcacaagataatgtaagggctaaaagcctcaaaaaaaaaaaaaaaaaaggtgaaatgaggagttgttgctgattggtgcaggaacctgaaagatgacacctgaaaactcaaattacatttcaggaacttgtgctggcgagagatagggataacacagataaaagtgtaatttgtagatattctaaaatcccttatcttagccaatagtttcagccgtggcttaaaacaatatatctatctgtactttagcaaaatgggtggatttgcatttcacatgctcctcctttggttgaaaacaactgattacataggaaagggaagatgatactataaactaggtcttcgttctcctacaatgtgacattggacaaggcatttcgtctctctggtttctaacctgcaagtaaaaggatgattaatattggtttagataatttttaaagttcctttagaacctgaagggtctttatttctacaacaaaaaaatcacccatgaggtagaattggctatacattctcaaatgtaaaaaattaagcaaaatgctgatctagtaggttcacataacttttaagtaaagcatcttgaaggtgtccctctatcaactgaagaacaaatgtctgagtttaatatatgactgcatcaaaaaaaaaaatatatgcaaccgcagtaggtgaccaaagggataagtaactttcaggaattttgaaagcccagtagtatttagtatatgctctctcagcattaaaaaggtcaccttgctaatacatgttaattttgaaagtttaattgacctttggaattttaatatcaaccttttttggtgtggttagaggttggagcaatcactgaagaaactgaagc

SEQ ID NO: 58413 - DNA, 1074 bp, Homo sapiens
atgttttaaacatattgtctgaaaccaggagagaattcttatttaagaaaattaacgtagatattaaagttaacattatctttttctcagtaccataaatttttcctatctgttctagcttaaggacagaaattatactctcagatgaatgacttttgaatatgatgtttgagttagtagactttaataaagtattgtgcagattgcctcctgggaagaaaatgaaggaaatgaaggaaatgaacagttacacttttgtaaatagtcatctacctacgtgtgtagataatactgacctaagattgctggggagtttacaaatcacctttacatacatttaaactgtaaagtgctatatatgtatgtaaagtattatgactaacaaattctaaactctgtagggtttttaaaacattaaaacattttaaaggtatcaaatctctttttagttttgcgtataatttaagcttttctataatattctgagccattaattttataactaaggacgacgggacagtagcataagcttatgatgtgatcatggtgattgtcttcatttcagttaaaagttctataggctcacagccctcatcctaaactgcttaggcggcactgtgttgattactacacttccagttaaaatggttgttgagctctctgtacttgctgtccataaatcctatgatagaacaaaatatgatgttatttgggataagaagtgtacctgattgattgtttcagactctggttgaatgccatccagcaggaataaatactcacactactttgaacatgccagaatgtgtctctgaagaggctcgctcactcattcaacaggtaatttaactgacctattggccaggtttatcaaccatgcagattagcagagcccacaactccaaaaccttaaaaagagattagtttggagcaagaaaaacccatttaacgtaaaacaaagacacgttcagaattaatactgtatattttcaggctttgctatcatcaaagtattgatggggtcagagagtatagttaaaacttcttggtattaatttttttcccaaaaattta

SEQ ID NO: 58414 - DNA, 1047 bp, Homo sapiens
gagagcctgtctctacaaaaaatacaaaaattagcttgggcacggtggcacgaacctatagtcccagctacttgggaggctgaggtgggagaattccttgagcccgggaggtcaaggctgcagtgaaccacgatcacaccactgtactccatcctgggcaacagactgtgacctagacttaaaaaaaaaaaaaatcttcctaaagtttgggtatttggttaggaatccacaagacagatgtttgattaaccccaccaagagacagatgtcaaaggggactgtagaagaattggagcctgtttcagtgccaatataatgactgaagtgtgttgttgcccttattatgtgggatatacatataaaattgatccaatggaaaacaagaagaaaaggagaggtaatgtttgcaagacatttgagataatttgtagaacacttgagtctctcaggattgttataggaagaaaatgtgttagatatttgaagggtctgtctttagcaaaaggattctaaatgactaagaaaacttctttaaaattgaactcttcccccgaccgtatgcttctactgctctctcaattcttctttctctcttcatcccctcttcatccacccctccctcccattatgggcttctctggtctctgaacaaaagatatggcacctgccttcaaggatcttataaaacacaggggaaagaaagaagcataaataataagtagggcagaatgtggcaagtgttataaagtacaactggagtatggtgagcatacaaaggagagatctgaggagctgcaggaagccttcctgtataggagcaggaccttgaagtgtagataggatttttaaacataagatttttttttcctttttttatattttgtttggagagaaggaaagttctcggggggacaaaaagactgttgtgtataaaggcatggagatgggaaaatggaaagctatgcgtattctgttttggctggttcgtagataacgtgaatttaaaaggtaggttggggccaggttaaatgccatgctgagacattt

SEQ ID NO: 58415 - DNA, 1031 bp, Homo sapiens
gccagggtggccaaacaatgaggaaatttgtcagtgaagccctcatgccattgggttttctcacacattccatgcaggcctcaacacagactatcagcatttataatatgcattaacttctatataatgtacgtctcctctctttcagagcagaattggctatgtttttttttttattcttttatttttttatttttttgagacacagagtgttgcactgttgcctaagctggagtacagtggcatgatttcagctcaccacaacctccacctctcgggctccagcgattctcctgcctcagcctcccaagtagctgggattacaggtgtgcatcactatgcccagccagaattggcagttttagatgatataactaccttccctactaagcctacttggtagtgtttgcaaaagcaacaccacccttttctttaaatattccccaaatgatagtaatatagatcatgaaagtcttttcccttgagattgttttgtatgtgtgagagtttgtggttgggaggtattgagtcctcatacaagccatttggatatgtattcttcatatttcttatggctattgcacctaagttctgttttcttaaggctacattaacattttaaattagaatatggtgctaaaagtgactttcagtaaaaggtaatgtattccctgagaacaagtaaatacttgggcagggagggatggtttgagtagaggtgaaaacagagaaatgatgggaagctgaccatatgtagaagaagctgaaaggtcatggtttcaaggccactgtgtttcctttcatttagagcatccacttttaaagatttatcattttcagtgacctgaaggcgtacaagataatctgtgtagatacctgaaactgcctttcaacaaggccagtcctaggtattgacagcatcctaggttgtcccaccctaaacattacctcaagtcccattgggtaggagtctagtggacttccaaaagcccccgagttcattctgcaatctgcctgtctttgcaatctat

SEQ ID NO: 58416 - DNA, 2077 bp, Homo sapiens
acacaccaacacataattatatcctcaactcttatgagagtttcagagcttaaaggcacattagaaatcaccaattcagtcttgtctttcacttaatggatgagaaaactaaagcccagagagaaagtggagttacctttatccattcacaccagtagtgaagggagtgaaatctggccttattcacttctgcctatttctcactggttaggtgctcagtaaatttactaaggcaggaggcatggcattggggttaagtttatatcaggccttccagtactctgagtagagaccatgatttgctttctttgaacctcagtttcttcatctttgaaatggagattcctgggctggattaagctgacctgcggtcctgcagggaccttttgagtacaggtctcaagtccagcatactcaatctctcagacctgtgtgcctcattctacaataagacgtagcaaaagaagggacaaaggctaaatattgtagtaatcttgcccagactccctgccagaactgtcttccgcttggggggacctggaaaggaactagacacggaatcatgccgtgggcagcttaagggctgtatgtgatgtggctctttgaattggtgagccaagagctaaagggtcatggcaccactttgcaacgtttgagtgaagtgagcattgggttttcccaaagttaaaaaggctgctgtgactggtcccttgatcttctgagccttgctgtggctcggagtctgcagcagcgtgggtgtctgcagtggcaggagcaaagcaggtcaggcagcacagaaggagcctccatcagggatcctggcaattcctggaagccatcgcctaagaccatggatgccaggcacatagtaggtgcttactttatatgggtagttgccagccctggcccccagtgaatgaaagatcaaatccctctggatttagaagggatgagaagaactgagagatgcttctctttagctttaagtctcctaattgtatctactacgcatacccccaaccttagaacattaatggatggtcagatgcaagttcacaaagcattcagcctggattattctgccatatgtgacagtttgctgcctcttttgttgttaaatttttctgattgacatttattagtgttactcactgttgccttgggtccctcaccagggctgcaacttgcaatggggtgttattacaacttgcaaaccacttctctgtttgatttccctgaccttatgtcaatacccgtagtttatttcctctctctccccaaagaattatttgaagtcaattaaaataatacaaaagaaataatatccatgatacttatgcaattagaaatatccttgtaccctacttcatgatttctattaaatctgaatcatttactattagtggttaggtcatctgatagattcagcatcagttcctctgtcagcaatttgtatatgacttaggacaaatcagtctgtccagatgtatgaggggaacgtgtattttcctccatagggcctcaaagtataggagtagaattctggaaatgttcatacttacaggtcaaaatctgctgcctgccccagctccacacacccaaaagaaagctaccccttatcctttcttttgccagaagtttaacataaacaatactgcttaagataaatgaatgacccaagaatttccatgtcatactaattgtatcaggatctaactttttttgaagaaaagaaaagtgatttctttaggtaggaataagtatatgctataaattgagaaataatggaaaatgtcttaagtctcaacagaatgggattcttacggtcagggcaattcagacaaaggtttgctttggggaatttttaatttgtatcacatttctcagtctggtgggtgccattggagaacatgcgtatcttgcctgaactgctagaaggcagctcctaataatattatataaagtttttccacttggaagctgtccctatcagacttctcagatacactttatacacacatacacacataaatgcacacatacacattttggccatttatcaccattttttggtgtg

SEQ ID NO: 58417 - DNA, 1055 bp, Homo sapiens
gctgggcgcggtggctcatgcctgtaatcccagcagtttgggaagccgaggcgggcggattacctgaggtcaggagtttgagaccagcctgaccaacatggtgaaacctcatctctactaaaaattcaaaaattagctgggcatagtggcgggcgcctgtaatcccagctacttgggaggctgaggcaggagaatcgcttgaacccgggaggtggaggttgtggcgagttgagagtgcgccactgtactccagcctgggagacagagttagactatgtctcaaaaaaaaaaaaaaaaaaaaaagatggcctgttgacccatagccacaaccagcagttctcaaccttgggttccccagaattaatgatggggtctgggattagttttcagtatttttcaaaacctaatggaaataatataatatacctacacaggtaaaccttcttcaaaaaagagccttttctcactccaaagtcttaggcactttaatattcttttaataagaaaaaacaaatatttatagagagaaatggaagaaaacagaattttccacattgcaaggatatcagggttccttctgccttttactttcagcacaattgtttcaacagcagcaaggagccatcctttaagacttcaaatgtgccagtaactcacgttatttttcatatgcggggaacataatttctgttatagcttataggggctcagtgaccaagctgcacgtttggaaccgatttcagatgaaagagacagaataacagcaggatatcctgaagtgaaattcaaaccctggtgagttaaaaccaccatctaacacctttccctcccgaagcaattgcacagaatcctctcaatcaaaaaaaattcgaagaacctgtataaaatggcatttctttaaatcatattgctctttgcagcccataaagcatttccagatacattcttattttgatccttccaaggatggctggtatacacagggccttattccattttacatagaaagaaactgagtgttagagaagttaagtggtttctctgaatttcacacc

SEQ ID NO: 58418 - DNA, 1522 bp, Homo sapiens
gtagcatctcccaccgttacctatttcctgacacacctctctgtggaaagaagtttgcaagcttcctccctggctctgctgtctttgcttttcctcccctgggcatttctgcacagtgcacatcacgcagcgcttgctgacgagtcacttcaccgtgattttttagtgcatttcccgagagagcaagggtctgtccatcttgtttcttctatattccaaaatgcaaagtcagagttcagtcccttcagatataccctaggggatagggggagtattttaggccagagaatacatcagctaaattagcgggttcctttttgaactattgaggtctgcaaacttggaatatttatttatgcctcaaccccaagacgcgtttttctcccacattcttcagtctgcttcttggaatccaagtgctgtcatgaaagctgcaaggcagtctgtttagttccaacagcagaatttttggaagacttccttaattctgtaggaggagtgtggtgactaccacttgctgacgagaagccgcggaggattctgcagcgtgacaatatgtatatccgtattataagatgtcagcccccaccgcgcacgcccccgcccccgtcagctctgctgggctgcagaggaggggggacgaggtggcacagggtggctctgcggcagtgtagccgcttcgtgctgtcggtatctccacaagtccagaagctggcttcaccggggtgggcaagagttcgacagcaggttttaccgattgcgctctgacttagacaatgtaattgttccccacttgggaaaaaagtaaagagttttgtagtatgtggcttaattcagtggcttttcagcttttgaaaaagctttggttcatctcacacaatacacacgcgagcacctaacagttgggaagcaacaatgtccctgtcctttatgggaagcaggaaaaataatataacaatgaataagttgaatcgaccccattatgaagaggcagaagaatagctaaatagtacactgacaaaatgggtatgtatagcaatcagatcccataatacagtattcaagaatctatttcttggtgggggcacggcggctcatgcctataataccagcactttgggaggctgaggcaggtggatggcttgagcccaggagttggggatcagcctgggcaacatggtgaaaccccttctctacaaaaaatacaaaaattagccaggcatggtggcacatgccctatagtcccagttacttgggagctgatgtgggagaacggcctacgcccgggaagtcgaagctgtagtgagccagaatcatgccactgcactccagcctgggtgacagagtgagaccctatctcaaaaaaaaaaaaaaaaaaaaaaaagcatctatctccacttgctaggttgcacttttaaacttagctttctggacaacattcgaatagtcctagcatactaaattccatctttgcatttcttgcaatttctaaataatgagagttgtcactcacatgggattt

SEQ ID NO: 58419 - DNA, 1053 bp, Homo sapiens
tgagaacaaagccagagcggaactgtgaggcaacaaagccaaatcaatggctgatactcaaattgctccctctgcaatttgacagcttgcacagatgatggaaagatgtatgtgttgtttagaataatgaggggctgcagaaagccatgaggtgcttgaggaaaaaacacaaagtagatcttctcatcccaacaagcttgacccaggcctgagtgaaggtcatacaatcctgcctatcttaaaggatgtttttatctctagcttttgtgagcatcctcgtgttttccaaaaggaaacatattttacttgaccttaactagggggactcactgcatcctctcctctcacactttattccagtgtatgtgctattttttaataatgtttttttcaatcttcccagaaagaagattggcccatgcacaagctggaatgttctcccatggttgtttttggggaaaactggaatccctcggagactgtaagactaacagcaaggattctggccaaacaggtgaggaaatgggacaatgttcaagtgcattttattttgtttttcttttaaaggtcagaaagatgagtaactgacctttggtaaccatctctcgttaaacatccttagactacatttcctatcatatccatatggacaggggtggggaaaatactccaggcataatctagttagttgtgtgccctgtgcaattaggatgttgcttaccctagaccaggagcatagccacagctctgaaattctgagctgttttcatgacaggtttacatggaaatacgtgacatgaaaagcctgacctcaaataattagagcttcctagggaaccagattggtctgagcagctttgagattttcctctctttccattctgacataaagagtgtactctgttcccctttcctgtgtaatattctgctctttcttggctcctttcttgcctgtgcataggcaggcaaagaattggatggaacagccttgactatgacatgtgcaaagaagagaaagagtggaaaagtagaaatagaggcaagggagagggg

SEQ ID NO: 58420 - DNA, 1032 bp, Homo sapiens
gagaagttggtggcagggcctctggactataaatcttttaaagctgaaattttggctgggcatagtggctcatacctgtaatcttagcactttgggaggccaaggcagaaggattgtttgaatccaggagttcgagaccagccttggcaacaaagtgagacccattctctataataaattttaaaaattaaaaaaatttcccaggtgtggtggtatacacctgtggtcccagctattctggaggctgaggcaggagaattactggaacccggaacttcaaggctgcagtgagctgtgattgtgccaccatactccatccagcctgagcaacaaagtaaatgagactctgtctctaaaaatgaaaaaaaaaaacaaactgaaatttcatccacttctcctgtatacctaccagccctcctccacccttaaaatttttctattttttaatctaagccaaatgtgatggaaatgattagcatgtatctgtccccagaccaagttaggatcctgggctgtgtaaacagaagtagaacatttcaaaactctgaggtcatccttcagctatgttcagcttgggtcaggtgcttgccgaaatgctacctcgccagccagccgagagtaacaaaggccattcatgggttgcctgtagagtgagaccaaaacatcagaattgtttccctgcaggaggttaactttcggatccttaataacagttatttttaaatttatgcagagtatttgggctgaataagtcagagggaataggatgactgggtgtgaggtatcagagtcagtaagtcatcagatgggatctccgcacatcttgggaggattgggtggccaagctggtgttttattattttgttcccctgaattattgatgatatttatagtgatatgttaagaattcagaagaggctggtagactttcctgaatgaaaagctttcccaagcgagatgacttataaatcttataaaaatgcatcccgtgaatggaagatttctgctccaaaaaagaactattgaaatatt

SEQ ID NO: 58421 - DNA, 1047 bp, Homo sapiens
agcagggggagcccaaaggaagccagctcttaaaatctgctcttggaaacagaatttgttaaattggggataaactcaaaccttccttttctcctagagtgtgtgaggaagtgcactggcctcatgcgcagttctctgtgtgagatctgtagggagagaggagcagacagacagcatcccagccctgtggttctcccagcagggccttgctctgctagacccatctttatctgcgtgagcccctcccggaagcccagctctggtcttctgtggggccgtgggtcccagggctgcctcctacccaggaatacagctagaacatgtctttttggactgactttcaggagacacagggtggaacagcctagcctttaaataaacacctcttacacacatgtaaacacacacactggctcacccaccagctgcctctgggccctgttcttagggaaatggctgtttcccaggcagaccccatcagtcagtcttcaggtacagccggagagaacacttgctgtatctaaagcccctgctggacaatggggaaagaacatccagaagacacaggaagtgttctgacttcagagcacttaactgttttgctaaaccaacccatatcatagtgtgacagaaagctggggtcttaagacacattggggtgggtgggggttgggtgggtggctgtatgtctgagtacctaaggtgataggcctaattgctgccttcataaatgggacatttacttcacaagctgttttcccagggtcttcctctgggtatgtctgaaatataaaaatctggactgggattgaagattgtgtttacaaatgcttttgaataggatttctcctgcagttgttacgtagcttttcagaaacacacaaactacaaataatgaacaacatctgcaatgattcggcagggtggcagcatccacgctctccacccaaaccctggtgggatttggagaggccgctggtgggcagaggttggccctaagcatggcagcctccggcttactgcacccagcctgtggggcggctcagt

SEQ ID NO: 58422 - DNA, 1096 bp, Homo sapiens
tgcctgtaatcccagcactttgagaggccaaggcgggcggatcacgaggtcaggagatcgagaccatcctggctaacacagtgaaaccccgtgtctactaaaaatacaaaaaattagccaggcatggtggtgggcgcctgtggtcccagctactcgggaagctgaggcaggagaatggcgtgaacccgggatgcggagcttgcagtgagcggagatcgcaccactgcactccagcctgggcgacagagcgagactccgtctcaaaataaataaataaattaaaataaaaacaggtcctggtggagaacataggctctaatggccagtttgcatcctgtgccttaaagcagagagatccaacttaaagttaccctgggtggaggtgtgaggagattggcttctaggctctcattgtttgtcttgctttttcctaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttctccatgggactggggtcgggcagcctctttattctgcagttgctcttgtggggctgtgcctgtggaggaagaaaatgggaagaaagagaaaaaggtacacgaaggaaagaaaactatcat

SEQ ID NO: 58423 - DNA, 1047 bp, Homo sapiens
gatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatagaagcccactgacctccaccacagcccaaatggagggctgtgatagccagatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgcctttacaaatgtgagatctttattctaacctttttttgtaaaagatatctattgatttccatatgcaataaacctttttttcagagaaaagttacatcttctcttttctgtactgtatatgtttgcattagttgaaagtgcctgggaaaacctgcatgctttgttttctaaagcccatttattgctacccagtttttagtcctgcataaccttatcatactgaagatttagtttgaaattcccaaggttgtcactgttagaagaaacctgaaaggggtgatcactaggcaagtggagtgaagaatacatagaaatgggtctttctc

SEQ ID NO: 58424 - DNA, 1033 bp, Homo sapiens
ctccaatggcctacagccttatggttggcacactagttggccctatagggtggaaataaagctgtaagatgttaaactgcatttgatacttctcttgaacgctgagcaaggaagcaaaatagttcttgtctttacttaagcttctaagacattttggggcaaaggaccttacagatggcgtctgttgaaagtaacagcaacgtgccagggagaaatgtgggggaaatctcatcaaattctgccacctcaaatgtgttgtccagaagtcagtgttattcagggggccctgtgaaacttgaccaccagcttgcgccatcaacactcagcctttatccagcctgctctcagcttttgtgtttctgttagaaactcagataggtaagtatttttattcagtagactacctttcttatcttttcagcttaatatagctgcatcttctttctcaaagccaaactaagatattctctattaaaatgtccatgagcctagcattgagtgtctggcatccatcaatttcatagactggaaaatgattgttgtttggtacagtaaagaagaggatgtgcatcagttcctaccgtttgcagctttgtttttagccttcccattttaaaaataaattcaaggacattgagttacaaggcaggagggctggagctactgggcagcctgaatatgacaagcatttgtgtggaaagtcattgctccttctgccacactttgggccatcaggatcattctttcccagaagtgccataaacttgctcaaaagtttctataaatgggaagagggagaggaaggatttttgcatcagtcctgaagttgctatccaaaagttctctgtttcacaaataattttctgaactctggaatgcctctcctactccctgcctccctttctgtaatgtcagagtgatggaaaccaccaagtggcatgctagggaaagcctgcagcagtgttggagtctatttcaccctagctcatagttttaaactgtcttcactgttgaggtagagcttgatgaatgt

SEQ ID NO: 58425 - DNA, 1050 bp, Homo sapiens
cccctgaataacactgacttctggacaacacatttgaggtggcagaatttgatgagatttcccccacatttctccctggcacgttgctgttactttcaacagacgccatctgtaaggtcctttgccccaaaatgtcttagaagcttaagtaaagacaagaactattttgcttccttgctcagcgttcaagagaagtatcaaatgcagtttaacatcttacagctttatttccaccctatagggccaactagtgtgccaaccataaggctgtaggccattggagaatttgtgtggtttctacagaagacccaaatttctccatttggaaaccatgctggatgagctgttgctctgctcatgaaaagaaatcactaaataagagcatgatgagtgtctcaaaaccattggcaatataataaaacacagcagcagaataattgttggtaaaacatgggaatgctcaattccctaaaagggctaccctaagagcccaacagtaattatgtggtgcttccggaaatgtcttactctaggagctccacagagttatttctgacactgagtaagaacacaggtctgactcaatcccatcccttgaatctgtgctccctggcacacatcctagaatgccctgtaccctccatccccccaacccccgcacctcaagggattgacagatcttccccaaacgaaaatcagtaacgaaatagttgtcctttaccaaagggggcaatcaaggaccctctgagaataccagaatccatggatgttcaagtcttttatataaaatagcacagtatttgcatataacctatgcacatctcttgcatactttaaatcatctctagattatttacaatacctaactcaatgcctacacatcacttcatttgtgtgaattcaatgtagtattcagcatgtggcaaattcaacttttgctttttggaactttgtgggtttcccctcttccccaaatatttttcaatctgtacttggttgaatatagggatgtggaacccacagataggggtggtcaactgtactcatctt

SEQ ID NO: 58426 - DNA, 1140 bp, Homo sapiens
gaataacttttgtgaattattataatgcagtttccctagtaatatagtacttttcatttgaaccacatcttgactgatctgtattgtaatatatgtcagcaggtaaggttgcctgctggatcattttgaggacagaggcatgagggagcacatctcttgtgaagttgcagccagatttgtaaccaaccctgaaattcatcagcttaattcatttatcagcttgattcattcatcattcattgcttatatccaaagcaaagacggtaagaaaatgaattcatcctgaaatataaagaaaagggtctgaaggaacaaacacgattctcttatattttggggctcatgagccttgatagacagtttcctctcgtcttcatttccacccctcatcctcagtagtctcctctcccccacgccccaccccaacttcccccccaagcttgagttaaagacagaatagctaaagacagtgctgcctttacaatgcagtaattgccatctttggggccgaaagacaagctctgtgttgtgcttttcttgaccaccccttatcctgggctctggagcttgtgtttccctgctggcgactgtaccttgggtatttgttgctacctctcctgtttgctcagtaggaccctgtctggtggcattgaggctctggaccagaccatctgtgcagttaaggctctaccctgattgagagaggatagcagacctagaaagagaaaggagttgggcagggcctttgaggattgtgtttttcaggcagggccttgatgatcattgttttttatttaaataagatgtgtgtgctggacagagacctaaaagttgaggtcactaagtcattggaaaggccatcaaggaaacagatggggaagctgatttatgggagctgtaaggcatttagctacataacaggggtcctggccaggaaacacatcaaatgtgacccccgctgtgctgatatcatcttcaggctttggtctgcaagatcagaattaatcccactcgggaccccatagtccaaacttggggccacttgatgaacgatggtagaattgtcattggcagagccctgtgcttctttccttttcttcataaaatccactcgctggtcagttatcttcactttgaagc

SEQ ID NO: 58427 - DNA, 1094 bp, Homo sapiens
gacacacccttaggtattccaaggatcagagattaattatagaattaacgtcctcagcattagcccctcaggacggaaacttaggaagattttcctctacagtttatgtgtgtggatctctcaatcaacaacaaactgttttacaagttttgctccgttccgtctgtgcagaaggtccgtcactgtgattggattagatggttcatataaccctgtttctcttttccttgtcctgtcatctttacctttctaaagtgtatcgcatgtaccctattttgtttttgttttgttttgttttgccctatggcagggtgtatttgtagggagtcttttttcttatttattggtctatctagctaaggagttaattaagaataaaagctcaggagtcctgtaggaactggcttccaggggcccagtgggaatagtgggaaggctgtgtttgaatttgccctactgatggtgattgtctgcattccttggctggggagttacagatttgaggagattaaaacacattccaacattctactagtattataaacaatgagcacatgccttttcttgccgcaagaatctagagaagcagaagatggcaggcctggaggcacagaagaggccgctgatgttggcagcattgaatgggctctcggtggctcgagtctcagggcgggaagagaatcgagttgatgccacccgggttcccatggacgagagggtaagtggcaggcttgtcaatgtgactcattctctgtagtcttaggatcccaaaacaccctccttgcccgaatatgccagcattgagatttgtgtgatgcattctttcttcaatctgagattaggaagatcaggtataactgtgttgcattaaatcagtccctttcagcatctcatgtttctccattccggtcttcctgctttgtccggttggcagatcattggttgactaaaaccatcagcccctaacatgctgtatgacttggtcaagtcactcaatttctttgggcccacttcctgttttgtaaaatgcacaagttaaacacttgcagtagctctgaatttctgtgatttttgtgagcaattgccacttctta

SEQ ID NO: 58428 - DNA, 1088 bp, Homo sapiens
aggcaggacaacttgaagcaaaggcaggaagacttgaagtagggagggggcttccacgtcacaggtaggtgagaggcaaatggttgcattcttttgtttctgattagcctctccaaaggaggcaatcagatatgcatttatctcagtgagcagaggggtgactttgaatagaatgggaggcaggtttgcccaagcagtgcccagcttgacttttccttttagcttagtgatttggggcccaagatattttcctttcacagtgcttttctcactttctcccagtaacctcctctgagatactcctttggtttgtctgatgagtcggctgccaccaggataggcatcctgttgtcagtgtcactcacacaggcttcattctgattgtaggtgacattgtggagacacatggaagggcgtcatgcagtcctcccacccgcaattagaataattcataaccctgtgggatggctccgtcaagacctcttcctggggagtgaatttatacatcatagaataaggaaaaaagtctctcaaggcttgaaaagaaaccaaggattcaatggctcttcatctgtgtcagtcaaatgaatctgcaaattggttgcccttcattgtgaatcaaaatcctaaaccctgcaaaactcatctgcttctatgaggaatgcctgtgttcttcccttaacttcaaagacacacttaattttaggaaaggcccttcgtggcttgcttgaagtgagcataaagagagctttttcatactcggttagtttcaaggacctgaggaagcacagcaggaggctaaaaaccagccctgcccaatccaatttcaatttagaggtgagggcagagaggatggaaatcaaaaagccacaaaccaggaccaggtgtaaacatcaaaacctttccctaagtggtctgctcagttccggagtccatgttcccccatagctcagtggcatgcagtgatgtcccaccatttgtgttgggaggcaccgtctctgttactgtgggccctctgggtgaagcctggagggtgatgcctgcggatcatcttaggtgaccccagccaggctttgctgttagtgagt

SEQ ID NO: 58429 - DNA, 1033 bp, Homo sapiens
gggcactgtggctcacgcctgtaatcccagcactttgggaggccgaggtgggcagatcacaaggtcaggagttcaagaccagcctgaccaacatggtgaaaccccatcagtactaaaaatacaaaaattagccgtgtgtggtggcgtgcacctgtaatcccagttactcaggagggaggcaggagaatcacttgaacccacaaggcggaggttgctgtgagccgagatggcaccactgcactccagcctggatgacagagcaagaccccgtctcagaaaaacaaaaaaaaatctccattgctgcttgccatgaacattttcactcctttaaaaaaaacctattaactagaactaatcaaagccagattgacttctcttcattcaccatggctgcaccataaggtagccaagcctaattttaggaactccgaaacagttgtaacttaaaatttgctttgatggattccattaggccaccttcatttccaggtcttcctaacccatcactgggattcaacctgaaaagaacaatcaaggcccaaagttttaaggaagccaagttcctggggtcagaaattgaatctgtagcaaccttgttacttttggaaaaccttaagaacattctcaacctcacagttctggccagccccactagagtagtgctaagagatttttatacagatatgactttttgcaaacctagaaggaaattgtgcaaggtgtacctttgcctctagcaaagaaaacctttggcttggaatggaagaaatgggtaggtgctgttgggagagagctttcccagcatggaataaagcaatttattggtagaaaatgatttttcaatacttcttccagaccacttaaaagcaacattagcatcaagaacctatcagtctaagcatttaatttagctatttcccctgccaacttgatacttaatgatgtccacatggtcccataacctcattttggttgtattcatcctcttctcttgttactcgtattaaacaaatagcctgtagccaaaatcttg

SEQ ID NO: 58430 - DNA, 1025 bp, Homo sapiens
ataagccactcacaggttttgcttagtttccttagaaactgcttccagaccttttcatttatcttgaaaccactacaagatgagaattcacatctactgtagtgtcatgttaattataccactagatgaagtcatgtggcggggctccgagtatatctaggatttcagcagttgatttgaaggaatgaggccagaggaaaccaaatatctcttatctctagagaccttcactaaggagcatgtagctatgagtccacgtagatgtaatctgatagaactgtaggttgtgaagcaagctgggtgcagcactattagagagtattgccccagcagaggtacctaaaaacatttagtactggtataagggaatgatgactggaggaaaggctggaaaccccaggtaaagagctcatccatccttgacatagagagtaaacatgctaagtcaggtacttatttgtgtctatattgcctcatttttaaagtaggagcaaaaatagctgccataaagagttggtgtaagaatcggactctatacagctaagagacaatattattgctttttattcttctagcagacatttattgagtgctctgggccaggtactcgattcagtgcttggaacacagaaacgaagaaggcagaatccctgcaccgggtatggggcctgtggtctgcttggtctcatcagagatctcatcacagaagtaaaaattataatgcaatgtggtgaccggtaggggactgcagcaggctcttctcctcacgtgtgggtagggggatatgatgaagggattcctagagaaggtgactcccagagctgagtctcaaaattattatccaaacagaggatggtagaagtattaatgagcagacgcatcatatgagtgaaaaagcggtggcagggaattacaggttggggcaccaggtgaagggtaaaagatggttagaaattggttccaagtaggatgggaagcagtagcttatctttcctcatctggtgcttattttggtgtatctcctt

SEQ ID NO: 58431 - DNA, 1528 bp, Homo sapiens
ccagaatggcttggccttctttttgctatgcagccttagttggcaagtccaatttattatagataaacaaatgctttttcttaaccaagacgttttgaagtttgccatggtcctcagcagaatagttcaataagacagtccatctaagtgagtaccaagcatcagccaatccggcaccttggaggtatcaaggctgatatccagccttataacaggacaagtagccaatgtcatgtgtaacattaatgaagactctagtcagtagttttcttattctctttttctcttcattgagccaatacagggataatcgtttgtgaggtagaatgaaacgtttcttgtatacaatcatgctttatttctccagctttatagggccctcccctgtgggttcctagcccctttggtgttttatggaagctatgcctcggaaactgctatagcacatcacatcctttgcagcacatccacctcctgaagtgggtgtggttgggggggtcatggatcatagtcatttatagagctgagcccatcatccaaactcattttccactctctgttgaccaactttacaaaaaatggagatttatcagaaacctaaagcaactggcacatttcagcaatttgggagatgcctgcaatttcagcacaaacatttcactccagactagctccactggctgttttataagtgttcagttccccctctgttgcacgtttgcaatttgccttaatgagaactgcccatgtgcatcaagtagaatcgagcagggtggccgcagctttcagaaagggctaaatggctcttttttagatttgtttaattttcttttgcttctctaatagctgcccttcatagggttgtaatccattttccttgccataatgccttatgaagccatctgcatcccacttacatttctgcagcccatatatagtcatattttgggtcattgaaaaatcagagtaaacttttctctgcttctagaaaactgacttctcaatctctggaagttggaggttttgttgtggcaatttgcttgtgttgttttttaatgtggactgcgagaaacaggggcagttgaggtcatgttgaaatctgctgtggttggttctgatgtgctttctagtatgttctttctttagtgggaccaacagggttataataccttcctctgagttggaagataggcgcttctgacttattgccaagctcgggtaactgagctggactgcctctttttcttctctttccccccacatatgtgtgcatatctaaggtgaccacctatagaccgcatgattcctggtgactcaaggatgagggtgggagcaacagtaccagtggggggtggtaatgtggtcagctctgcaataagtgaaaaagcagacaagaaaatatgcagggaaagactgtgagtaggactggagtctcttttgattggtacaggttcttattgacaaaaagcatgtcatgatatatcctaggaaaaatacttgaatttagcatgaacttttccgtgagtgg

SEQ ID NO: 58432 - DNA, 1012 bp, Homo sapiens
gagacaaactctagaatctctacctctatcaatttctcaagaatgcattgcttcggtctgcttattttggattattcctcttgattccatctcaccatcctaagcagtgcttccctggccagtgtttagcaagcctatttctgtgatgtaaatcctcccactgtggtgttacggaagggtagttgggaaaagatgtgtgtaatcagttcttctgagcccatagtagtcagcacatcacaggttccaggggcctggggttcagctggtagagatgctgactagtcagctacgcaactgttgccttacagagctctctggagatgttttagccgtcatggcttcctctgcccccgtgaccatcaagtaacatcagaatgagcctactctgccttcagtggttttgaattcgtttcctggtatacagaaaggcctggcacagtcccttcctaggctcaacttttgaagggatgatggcctggaaactcattggcctataccccaatcattagaaatatgtaagcacacgcaaagcattttttataaacgtacatctgagaggcaggcggatagggaagaatgaatgaaaagagctattccctggcaccacagaacttacgcggcaacccaaaatatgcctggaaataacctgttataatggagagccgtgttataacagtagaaatcataactcagttctaaaaattacaacctttaattctacagcagtaaaggagatattgaggaaatgtgactaatcaggaacatctgaggaagggagctttaagatttgcaagcaaaatagcaaatgcccacaccctcatgtgaccttaagcactttctattcttataggatttggccctggaagaggctgttctggaggagctgacccagaaggtagcccaagaacacaaagcccacaggtaaggcaggcagagggtaaggggctgcctgcacaacagatgtttacagcccatggggcaggaggcatccatctccctatcagcaactctg

SEQ ID NO: 58433 - DNA, 1050 bp, Homo sapiens
aaggcccatcctttccgaatggaaatgtaaaagcagtgtgtgttagaagaggtgtcggcctggggcttgacctcttgggcaaggaggtctggaaggggaagctgagtcacattgaagaatggtctgcatgccaggcccaggtgttgaccttgctgagtaggccgggggtagtcttagaagggtgtaaactttttccttggttccactggagctttcaaagagaatgcattcctttggtgggggagggaagataggatgaatggctgtgtttgatcttatgaagtaattgaatttgttaaatggcatttcttcagcagagaaaagaacaaagtcaagtacacaaggcgctccacaggtgtgtggctgtgtacaggcatgcattctgccatttttcattcccacagggccatgctcgcactctccctggcagggcacatacctcagggaggccccaggtgcagatggaggcggttaagttgagaacaatagcagagggggtacctttgggcttctttttaaaagtaggaaacggagatttaatggaacactttttgatcttcactttattttatattctgttgccacatgcccttcattagcttttcaaaattaatggggtttttactcaatacctggatgcacatacatagctaactttctaagccttgtgatatctttgttactccacaacatgaaactaaaaatgttgagcttatttcctatcacggacttgagtcatttcaatggatggctaaacaggaaaccgcaaattaatcagttatgtgaaaagtaagagctgccataattccccgtctgctctaaagtctctcgtgaactctagaattagcaggatgtgcagagctatagaatttttagcatacatttatgtctgtgctttccagttttaaaatatattgatttttcagattttaatgatttgagatgggatgtttttcacagttttgaggtgtacatttttaggggtagtgttttcatccatgtaaagttaagttggagatgaatctttatataagtggtattttagaatca

SEQ ID NO: 58434 - DNA, 1063 bp, Homo sapiens
gttcaagagcagaaagcaaggatcaggtcgtggcatgtctttctcttttgcaacaccttgctatcattggctttttttcactagttaaggcctgtgtgtgtctttgtatgcatttaaacaaatattatcctttttaggaaataattgcaatcctttggctcattgaaactgaaggaatcttattaagaagttgggtgtctctggcaaaatagggtatttattgatcaatgaatgttgaaaacttctagacttgaacgtttgccaagaaaatcttgtctgtgtttgggtatatgcacatgcttttcttctcatgcatgtacatgtattagcttatagtatgaaaaagcctagaagaaaaactttcccttttaagggtatctttgctagagttttagttgtagcttttccttttgtttgtttgtgttttccccctccctatggggttatttcagttttgcatagttgcaggagtattcgctttgtagtttgttagacagtgcagacttttaattgactgtcaacttgaacagtcattaaatgtaaaagcttttagatagtgcatgggtcaggtaccaaacgcattattagactttaatagtcataaactgaaattcttctcaagagttttgaggatagagggatggagggagggaggcattcaggtttatctggttgcatgcctgcatacatagtatttatctggtcctggcagacagagaacagcatgggccaccctgtcctttatctggatttacagctgtgaacacccgctggaatggatggaatgtgttggttccttcctatgggtatctctgtcaatctaagattttaaattattcccctttgctctcctgtaccccaggactctaggactacttgtctcttttccctcttttttttgtcttttatagtagagaaacgtttccatttgcagaatataacatcagccagaaaccaatgctgtctggcactttggtacatgctgcacttgggagaactgggttccagtacattctagcaagattcctctgatattgctagttatgaagaaagttttctagtg

SEQ ID NO: 58435 - DNA, 1027 bp, Homo sapiens
gaagtgataattttattattacatctttaaatcacatggttaatgtgttagtatttggtctatttggaacttttctcaaaagcaaacaaaaataatgtgctattgagctattttgaaaataagttcttaagcagaggtattgatttttatcctttgtgaattccttgattttcaaagatacattcattcatttgttcattcattcattgattccaaattgttctttattagtgttacattgcaggactgagaaagattaaacaattgaactcatgaaataataaagatttgtaatagagcatgagtcaaaatgttaaaatagtctactttttctaaagcttgagtagaatacgatgatgccacattgtagtgtttacctttaacaaaggtgtgaaaagaagggggaaaaacaacagaagctatatgaagaggtgttttgtcatgttgaagcatgcaggctgtgccttatgaatttttaagagacatccgcttcccataaaggattctcaagattgtaggggtatcattacaatgggtgggattgagaatggtgtgtcaatttcaaaaatggattttaaaaaaaatcttgacgttggaagaggtgcaaagaatagatgttttataattgtttgctctaccttttttcctgaatatcagcattgggacattcagttggagtggagtgggtggagaggaaggaagtgacagatgtgctacatccacacgttaaagaaacttacagtgtctgagcagcagcagaatctagaaagcacaagaatccaaaacctcaaaacttccccagcctgaggatattatagttctgtgtggttctgtggaaaaatgtagttgcgttccatcaccggatataatgtaacagtagtagtcatggtagcagctaacatttatgtgcaagatgctatgctaagtatctcagattattatctttttcagtcttcactagaactctataaagtgggcaccctgaaaaagaactgtttgttttttaaataacagaagttttttctct

SEQ ID NO: 58436 - DNA, 2082 bp, Homo sapiens
gatactgcatctggatactccatgtatgttacagtagtgtgtggttgtggtttcttttgattagtcccaaagttatatgtcaaagctggatcttatatatgggctggggaacccagggtgggatgcagcatgctggagtctcgtttcttgtgtggccttgggatgcttgtggtgagcatgaactgatgctattttacccttttatctagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaaggtaggtgcattttccccctgtgtgccatataagggtgttgactaactgtgaagcttccaatgaagtagatgagctggtagatttaggggtgtgtgggtgtgggtgcgggtgtgtggtgggggagagggtaaaatagttgggggttgtttactcattgctttgcagctttagagttttggttgaatccatgtagctaaccccagcagttttctgtaatgctggtaaggtagtagggatcctgagccaggcagaatttcatctctagcagcgtggaaatattcatcggagactgtgggtaaaataggcatgcaagaatttaataaaaaattaatgacctggccaggcgtggtgtctcatacctgtaatatcaacactttgggaagctgaggtgggaggagagcttgaggccaagagtttgagaccagcctgggcagcatagcaagaccctgtctctacaaaaagaaaaaaatataaaaactagctagacatggtgttttgtgcttttagttccagctcctcgggacactgaggttggaagatcacttgagcccagaagttcaaggctgcagtgagccgtgatcatgccactgtactccagcctgggcaacagactgagaccctgtctcaaaaacaaaaacaaaaacaacaaaaacaaaaacaaaaacctaattctgttttgtccacccttttcctaaaaatatccccaaacaaaatgtggtatcagacttcgaatttgaagattggaaaggtaactaaaagtgggagtaaagttaaggaggaaaatgttgcgagagcaggagttttgatgattgtccctactaaataagaggagacaagaagccatcagtagaagaggagaacaaggtattgcagctactcagtgtctgctttagcttggagaaaccgtgtgctgcctttgaaatgatgttttcccctctcatctgtaaagtgagggatttgtgtaagttcataaagcatattcagtgaatggaataagtgcatttttttgatgttggtatagttcatttattggtaagagttttccattaaaatacctgggaagtctcctcatcaaatggatatttctggtaggaaaaggaatcacataaaccctttactttttgccttttacccggaccttgtcattctgaatgcttgggaagcaatgcgggaacatgctttgaagaaggaagagtattctacctgacttttgtgtagtttttagattttaaatttctgatataaggatgctcttgaaatttttaagtgtattttaaggcaatattctgcttgcttgctttttctttttctttttcttttttttttttaatttgagacggagtcttgctctgtcacccaggctggagtgcagtggcacgatcttggcttactgcagcctccacctcccaggttcaagcgattctcgtgcctcagcctcccgagtggctgggattataggcgcctgccaccacggctggctaatttttgtatttatggtagagacggggtttcaccatgttggccaggctggtctcgaactcctgacctcaaatgatctgcccgccttggccttccaaagtgctaggatgacaggggtgagccactgcgcccggcctctgcttgctttctttaatttggcttttatttatttatttatttatttatttattttgagatagagtcttgctctgtcacttacactg

SEQ ID NO: 58437 - DNA, 1132 bp, Homo sapiens
tgatgaaaaagatttatgaggtttacctgctttgatttactgatgatgatgatggtggtggcgatggtggtggtggtggtggtaacaggagtagtagtcgtgcagccgcagcagcaatagaaggtaccacttatgatgtagttacttaccatgtgccatgcaggtgattgacaggcattatctcatttacacctctcagagcctgtgggcaaaagttgtaaccatcatctccattttgcagaggagaaaactctgagagtctagaaggctcaatgacttgtgtaaagttactgagacagtgagtgcaaaagatgggagatggactgacctccaagtctgttttctttctattcagccacatttcatttcctctatgtcatcactcaggttggaacaactaatggactcagtggagctaggaaatgaataatagggtcagaattcatccaagtaagtttgtctaagttgatagaaatataaccttggctctggttggcattttgttgctcaagaaatgcatagatttctgatgtgaacttgtcctttggaacatcatgggagaaagctaatcaaatcattacccccatctcaaagtaaatccatttaaaatatctttaaagcatctgggtctgcagctttatataggcaagggcacgtctggttttctagtaaagtcagagtcatagcttcatgagagattttggtggggttgtggcagggattgatctgtataatgttgagggggcagccagctggagtgggaacatcagcataagaatgcctttggaaattgaacattgtaatgaaaacattcttttgaaggcagatttccaggtgtgctgtaaaccattctaggctataattgagatataaaagaatcttcaaaagcagtgatctattttttggtgattgttgtgctaatcctgaaatcctagcatgaattaatataaaagatgggattgggtgcataaaagtacctgttttaatcatttagcatgttgttcaaaactaaactggtttaggcttcaagtctaagggcgaaaatctcactttcatctaacaaatcccaccataatctgccaagaacagccaccaggggctcctgcagcagctgtgaggaggcgatccttcc

SEQ ID NO: 58438 - DNA, 1007 bp, Homo sapiens
gtctgaggactggctcttctgtcttcttttctcatcattgcagtaaacttattgcagaactcatggcaccagagctgtgtgttctagttttcttaagaaaactggagcaataaaatgggattcatacctcacccagaggaggtatcatgaggattaaatgagtctggcttacttttggtgcctgagatataaacagaacagatatttcaggcatttactcaggtaatatgatgggatcctcttggtgtcatggagaaggtggtttctatttgcaatcatccaccatgctttcttcaaccatgtggcaatgtttagcagctaagctcagctttcaaaattgagctagagtttaaattggcaagttaaccacaaaccagcctggtggggtctcagctgggcttgacaggattagtagttccttggataatacacaggaagttgattggtgcacatgctagttgaaatgagagcctaggctctgattccatttcctgtgaggcactgtgtagacgtgggagaataaacatgtgctgtattggactttcaaggcagggtctttctactccagagtaggaaaatagctagaggaagaacgggaggagtagggtgggaatggaaaaggttactttgggcatagcttcaaaaatcagggtggggatggacttttcttcctgctagagaactgaatttgacagttctaaagttaggatgttctggctgtgagtagatacaaactctgtcctccagattacctgcctcccccaattctgccctgcactggacaccccgtttcttccatagttatgtaattatttcactggataattacctggtgagtcaccctgaaatattctgtgtcctctggaaggtgctgtacaacagcagtgataaatttatgccatgaattaggtttttctattagaagtggtttactttgttatttagagctctggctcaagattattgccttactatcatttctcttgtacctcatcatcctcctcaac

SEQ ID NO: 58439 - DNA, 1705 bp, Homo sapiens
gctagaataaccttggctctacttttaacttaacaagtggaagaaggataaatgatataacaaaggcacctgagatacccttcagttcattggtaaaccctatttgaggtagagaactgctgtgaggaaatccagcgctctggagaatggtgactttcataactctcggctctctcctaaggctaagcctaagagccttggtttttaaaagagtgtaaaaaagcttttaaaaaccaaactataatcatttcaaagagtaagtccttatcctctaatttatcccctttttcttttgcaaatttatattttgatctttactaaaagctgttttacccaaagctatcactacagtagaaattttccacattttgctattttcataatgactagagattataaagataagaaacttaacatgcatttcctattatcacataaaagttaacttacatgaagaatatttctgtggtttgatttcatgctaatcttttggcaattaataatttatgtgggatttggggggtactcaattaaatgcaacacctcatgccctggcagataatagtggaattctgctgtattttatagcttgtttaatcacgtcagtatatatgtgtatttgcaaaggattaaaataatcaatgctgattaagaatcgactgaagagtagactgctgggggagatttctcatctttaagttttgtgttgctttttgtctttgtaaaaatgacagtgtgaaacattattagcttaatgtcaatcctagaatgtaatggcaccggcatctccattttctaggtatagagattgtgggtgaactattcgccagtcttaacttgtacgtcttcatctttctgtgtattctaggtgagtcgtacagtctcagaagagtggtttttcttggctatgggacttgcttcttgggtctgtgttactctgcattttcttttcatgtacttttataaagagattggctaggaaaatgaagagggtgcagttgttaattatagatgtgtcagttatagaaatctcagacctacccagagtagaggttgattacacacaagttcttttctaccgttatccaactgatgtacagtggcttattttccaaagccattggaatgtaattgcatgaagtgctatttcagagtctgcttatagtcatcttttgaagtattttccatgcctcagtgaaactgttcgtgcttgtataatatgtaattcatatattttatgtggaagcacaccatttcttaatttacagctgaaatattgggtaagataggcaacctattacaacttaatgcaagatattttaaacttttgcttctggatgagtaactcttcaaaatgcttgagataagatcatggctttaatccttggtaattgccaagactgcatctaaacctcttacaaatagcattagtctgtgccattgtcacaaaactggaaaaacaaaaccctcaaaaaatatttcccttttaatagctaaggtgggggattataccatctctttacaaataaatgaacaaacaaataaaaaccaccccaaactactttttaatagattttatttctttagagcagttttagtttcacagcaagattgagcaaaaggtacggagagttcccataatgtcccctgccctcaaaactacttttaagggcccttattctctagaatctttccataataccaa

SEQ ID NO: 58440 - DNA, 1060 bp, Homo sapiens
gcaaaagcagggctgaccacttagaaagtcatgctatcactctttagaagggactttcagagcagtatgttgtttttgacagccaagcccttcttttttcagtcatacagacgtttaggacaagagacttttgtgagcaatccacacttcagcatctgtgtcttgagagctgtctgacatattgagcagtggggaaggtggtatggttgagtggttgccaatactgaatgactgcaagcccctgaggctgagacattcctgagggcaaggaaaagctgtgggtaattgtcctaggtccctgggctcttggagagtccaagtgacagcattgcccaggacctcgatgacagaagaggggtggcaatcactgttggaagtgattgcatgtggcctctctccacctgcttacaaaggaatgggggcccaggagggtcttcctctcccctttcctgctctgaaagtcccttctaaagacgtcttccacaggctggctgtttttctcagggaaactgtttcacctgaaatgcatctgtctcctgctgttcttggtgtttatactttggtttcagtgatcaggtattccttttaggtatatttttctgtgcaggagactgtcttggacaatggatatatgtattagtagcttggtaactgccacagtagaataaatatgtgaaatgttctcatcttgttgatgggtagctggctctctttttctcgttggtatcacattaggatacacacatttaaacacacatttgcatgtatgcatgggcataaaggaaaaacaaatactgattggggaagagacttgtctaagttcttatagaaaactagtatttttacttttaagtacttccagtcactcaaattagagcaactaattattcctcatatgcatcgggggacagtgtagcatgtggttacaagtataggcactggactcttggtcttgggttcagcttactcttctgtcatttattagctgggtgacaatggaaaagttactgagtcttttgaggcgtaagtttcctacctataaaatggcaataataatgct

SEQ ID NO: 58441 - DNA, 1024 bp, Homo sapiens
gagataataattttgccaaacttacattctttcctctttgtgtttttgtatatcataaaaattccaatcatctatacatgttgtttaaagtttactttttatttcactagttatgcattgcaaatgatatcccatagaatatgtagtagagattgtttttgctgggataaatgcgtaccaagccagccacattctttcctaggtgtttacagtgagacacacccaaatgtaaagtgcctggctcagggttagaaatgtggcttgtgcccacagagcaaatatttttctctgtttgaggctctctggttaatgcaggaattgaatcttggcctcttgtgttctgtgctttaataagttgaggggaattcatgagtagtaaacatctaagggctgtctatttgaattttggcttccccccactgtttttctttgggttgggggtgggtgggtcatttcatattcttttctgtacctatcaagaaatcagattggcttaccttagaggtaaacatgatactctgccaacataaagtgatttagaaatgttaatatattttaccaagccagagtttctagcatatgtattttaagccgtcataaaacatatacctgtcatgttaaggaatgtgcccacggcaagtatcaaagacctgctgtgggaggctgaggagtgtgttttgctatgttgcagggttataacctgacaacctccatgaggcatgagtactggcagggagtggtttataaatattgaagctattttatttattactttaagaattcctacaagtagtagctattcctatttgtacatccaagtgtcttggggctcagggggtaatcctgtgtcggcagatggatgaagagtgtaaatcctagtggatctgcctgagttagggaatcaagttaacaaaacaatcagatgagcaagagatagtctgttgggcttaatggagaacagaacatttggacagaaaagttttctggacatttctggcttctttgaaagacaagtttaatgagc

SEQ ID NO: 58442 - DNA, 1016 bp, Homo sapiens
ctctaatcctattgttatagattagtgtcaagcagattgtttacctggaataatttaggtgtagcctttcctaaaggtaagagatgccttaaatgagtgcctgaaagttctttccagaagcatggctctgtggctgtgcaaattctgggtgaaaatgtcatgagcttttaatgtaggtaaatgatgtgtgtgttagaggtgaaaaaaatgtgtttctagctctgaggaagtttagtgtcaaagtgtgctgatatttttaacataagctagattagtgtattaaaataagcaccaatggctgtgggaattcagacagaaaagattacctgtgatattaaggatcagagaagtccatagaaagaggcagcatcatttaaattcagcagtgactaggtatgagcatgtttactatcggcattgaggattgccttctttttaacttttgattatgaaaacttttaggtatatagaaaacctaaaagaacagtagagtgagtatctgtatactcacagattcaacaactgttaacattttgtatatttattttaactttgaatttatagatgtgcttatgtgtgtatggtgtatgtgttggtttttcttttcttttcttttttttgtttttgagagtttttgctctgttgctcaggctggagtgcaatagtgccatctcagctcactgcaacctctgcctcctgggttcaggtgattctcctgcctcagcctcccgagtagctgggattacaggcacacaccaccatgcctggctaatttttgtatttttggtagagactaggtttcaccatgttggccaggctggtctcaaactcttgacctcaggtgatccactggccttggcctcccaaagtgctaggattacgggcgtgagccaccgcacccagccgtatgtgttggttttgcaaaaaaaccattggaaagcaagttacaggcatcatgacttctttacccctgctatatccactggcatctcttaacacaattccatctattctcc

SEQ ID NO: 58443 - DNA, 1086 bp, Homo sapiens
catttgcactgcacaaaactaatttcctttctgccttcctttaaaggaaaataagagtagacatttttagtattcttttatttcccatcccctcccacctcatcccttcttttagcctttccttaggaaaatgacctagtactatcaaaactgagctgtgccctatgcaggtttatacacagcacagactagttgcatcagtttttcctttcttacaccctcaccaagattacatagctctgtgagatgtccttgggagttgtaatagtatggaatgctggagaaattccaaagactgttggtaaatataggatgcaattgaatagcagttagcttcttttggtgatttcagaacttatctttaagaaaaaaaataaagagttaagtatacatagcatagcatgggaactaaaaagaaagtgcggtgaccatgtttaggatttggatttgaacttctgtctttcatttgcctgtgcaggtaattcaataaaagactaaacacagactgtgctggtaattcaataaagaggaatacgctgcatttggttgatatttgtgaaagatctctcctctgcttatccatcatatttaaagatttacttgctctgccaaatgaccttttctaaattgtgagaaagctgtctttctttgctttgtgtttttaactttgaaattttttttaattaaaaatgagagaacaaaatactggaaatccacagttaataggtaaagatcgaaacttacactttagagcttaggaagctgattgactactcagaagtgaattttagaagtgcctgaaggttttctgtatgttctcttgcaatgtagcctattctatataaaagacctttaagatgtgatgtttacagagcaaatatctcaacgaattgctttcagcaagcatgggcacactacaacactttttatcatctcagtagttccattgtatttgttgcaaggaacgtgtctggatctgcaatctctgtctgtgagaatacccccagtataagacagatcaggggctagaaaaggaaaacttgggtggtgggaatgttcttttggaaacccaagttcaattttttc

SEQ ID NO: 58444 - DNA, 1117 bp, Homo sapiens
catatgtaatagataactagaatattttaatttctattcttttttttttttttttttttgagcgggagtttcgcgcttgtttcccaggctggagtgcaatggtgccatcttggctcacagcaaccttggcctcccaggttcgagcaattctcctgcctcagcctcccaagtagctgggactacaggcgcatgccaccacgcccagctaaattttttttgtatttttagtagagatggggtttcaccatgttggccatggtggtctcgaactcctgacctcagatgatctgcccaccttggcctcccaaagtgctggggattataggcgtgagccactgcgcccggcagtttttattcttgtgctgcatttgtttgaccctgcagttgcttctgtttcaaatgttgcatttatgtgaaataaagtgagattggatataatctttacacaaaaaaatcttacttgaagttcttattttctctttgagccattatgtacccttgtcatctccttttctccttttttacttgacacgttttgtagattatcctgagccctagaacagtgtgtggatggttgcaaattttcatctgctgcttgtttctttctcgcccttgcctctgtgtgggctcttctcttcccagccgcccagcatatctgctgctctattcatatccttacctatcacttcatacgacttggtaggcagagagggtgccttttcttgttctttggggaatattgagatcaatattatgtgctgtgggaataatggtttttgagaaaatgatatataaatataagggagtacagtcatttgatgtttgggccaagtaatgtttctgtagttaacacttggtggggggcaacagtattacatttttcaaaagctatccttagatctgcttccgaggttgaggtgctgtgacatggcactgtagctattgagagataggattgttgatatttttgatggttgatcatacccagggccatgcctaagattcacagttcacctatttgttacagactggattttgggaggctttctgcttcttagacttcctgtcacatgaagacattgagactttgaggtatcccttttgggatcaatattct

SEQ ID NO: 58445 - DNA, 1068 bp, Homo sapiens
tgtgtgacaaatagcagaaggaattaaggaatgctgcacttgtgatccatacaaaacaccaacattttaggttgcacataattaaagaaatatctgaaacactttttaaaacactgtagtagccaatacatagaggcatgccgtagatgggcacccgaatgcagtttagaaaagaaaaaaaaaaaatcacatagaaactactcaatttctttaaaatcactgagcaagaaaagcaacgttgaactttcatactgattttacacaacttctatatagtaccttgacttaaatccaagagcaaaagttaagactctcctcctctatttttggtaaacaactgcatggtaaacttagatgactcttccccctggattttacctgggagtggcctttttacatttttatttaaaagaggacaggtttggcacttttatactgatgtcaccaatgttaatatttcttgggatctcaggaagattcatattctttacagctgatacagcacaggctggagctcccactaagccaccctcagatttttccagcttactttgtgcatcaatttgtgtaacaatctcattcatgtttgtctccaataccattccccccatactatttctgcaagaatactgtgaaccttgtctacatggaaaatcaaatccagttcacagacattttcaaaacatttgtctaatgtttccacaaatacttgaatgacatctaaaatgccaagttcactttctgaagaatctacacagaagacaaaatataacgttgtgtaatgtctataaatcagtttgttgtcagatcctccaattaataatcccccttctaggaaattacaaacattttcatctctcttagataccaaatggaaagtctccctgatgatttgctgttgtgtatcttcactgtaggggcggtagaacttggagagccgcggcttcccgtggttgttgaagattaggatcgccttgatcatggctgtgccaggccgaccgggtgggcactggtggccagggcgggagcgggcgcacaagcctcgcctagtaatcttgcctgcgaccc

SEQ ID NO: 58446 - DNA, 1067 bp, Homo sapiens
gcccacctcagcctcccaacatgctgggattacaggcatgagccaccgcacccagctggatgtaatagtctttgatgcaccttctttaattctagtctggctgatctctcataaggtgttccctgcctcctcctccttccttcactttaattcctgtctttcactttaattcctgtctttccttctccttttctttctctagtcatatgtgaactacccatgaattagtgactttaggattgtgctttgaaaaataggcatattttacttgaatttgttttagtataggaattgggttaaaagaagtggatgcaatgcagttcatttctgcacttacctgtgaaaatataaaagcatacagatttttttccagtatttattattttgtggtagaatgaaaaaaaaaatagatgctttggggatctgatcaaagcgcataaattaatgtgaatagctgaaggttgatgcatctgggtgacggggtcaacttttccagatttacggagatgtaccagagttaaagcatgggatatgccatgtaaacatctgagaactttggcatgttttgatttatttttttcactgcagtattgagtttggcctatgttcactactagggggaatgggagagggttcagggaggttgtttttgtttttcaaacagaaggggaacaatgcttagcaaatgcccctgggtgtgtgcctccagcaaacacatacattgggtcaagaccctgatttctagcctcccattgcctctcatctcagtttttttccgttttgttctgggccctgggtagtctagcaactttgttcctattgtcccaaccctaagtactccgaagaatctatttctctaatgtggtaagtagttttatacaacactgtcagcaggcggtgagctgtaagttatatttccattgggagagacttactttgctgtatcccactagaatctaaggaaaaatcacaataaaggctcatactttaagatattctggaagatgggagaccatgtagcctaatggagacagtatgagctccatcactagctagtgtatctcagg

SEQ ID NO: 58447 - DNA, 2419 bp, Homo sapiens
cagagggctcttttctatatcttagctagagcaggtatctgagaagtcctttttgccattaactaaggggccgtcaagtactttgtgaaaacagcatactcgtgtatgcatttatatgagaaatatttttataaagcgattaacatgccatgtgggccatggatctctcactgattcatgtgttttcaagaaaacatgtttttattttttaaattgcattgagcttcctttaaaaaaactgttatttctccaaagataaatttcattttctacttaggaaaacagatgactctttttccctcaaatgccttctgtgaaatgacatgtggagctgttaggcattgtgaatctgttttatttaccccagtgttacagaaagacggaaggcaattttagcttctttaaagagacactggcctggggtaaataacaatttagtccaggtgggtagaaaagaatgcttatgacattcttttcatcagctccatgtgtaacctccaagcaggaggtcaggcagtaaaacatttgagtgaactggtgaaatgttttgtatttatttacaaggcacttaaacacaagactgatcccaataaactcaacaagtcagagtgatggaggaaagtatatggtgcatgcagaacagtaaaagcggggactggaggggggcctgtagattgcatttagcctgctcctctcttcctaccgtggagagatgaccatcagtgcagtggttatgggtgagtttcatgaggaaggtaatgagcccctttctgttcccacctgctgctgaactacttgacattttcttttagattccaggcatcctgaagtatttaaattctgttttgctgaaaattcttcattctttttgtgtaactttcttgaatcaaaacttctgttccaccattcttagtgttgtatctgttatgctggagttgatgacttgattccattgcttaccacagtctaatttaaaacaaaagcattctaaaaccttctcagtttcgtcatttttattgttactatatatttattggtttagatgtagtttgtagagaatcaaaagaaaagaggacagtttctttggataagacgttcataaccttttctcctcaagaaagcctgccacatagtaagctctggggtcagtaagtcattgccggcttagctgttgttcattttctcattgcatctctaccaaatgatgggcagacagactgattcatacctgactgttctgcatatattctgcatatatatatatatatatttttttttttttttttttgagacagggtttttttctgtcactcaggctggagtgcagtggcatgatcatagcttactgtggcctcgaaccccgcgggctcaagggatcctcccacctcaccctcccaagtagctggtactataggcgctagccaccatgcccagctaattttttattttttgtagagacagaactttctttgttgcccaggtggttttgaactcctgggctaaagccgtccgccccccttggcctcccaaagtgctaggatgacaagcgtgagccacgacacccagcctgcttgcttatattttgaataaaagatttcatggggcgggagggttaaaactctttgtgaatattaataatccagattaatttgaaagaactttcatgtaatatgctactcaaaaaacagtatatgcaagcgattatctctatcacctagcagaaggctaggcaggattggtttaacaagtaaataagaataatttagtgttagcctgctatacaaataagagtgctttagtatctgaaactgtccctggaatgtatcaatgtatattaggaagttacttcagtatattatggaccagcaggcattattgagaactcactgtgttgcaagtttggggcagtaactctgaaaataaataaggtgcttctagttggagatgggggtgggggaacagactcaatcagatcatttttggagtggtgagggctttgatacaggaatgcaatgctgtataaaggtgcttccctcttgattgttgagttttgttttgttttgttttttgagacagtcttgctctgtcacccaggctggagtgcggtgtcatgatctcagctcactgcaacctccatctcccaggttcaagcaattctcctccctcagcctcccaagtagctgggattacaggtgcccaccaccatgcctggctgatttttgtatttttagtggaggtggggtttcaccatgttggccaggctggtcttgaactcctgacctcaggtgatctgcttgccttggactcccaaagtgctaggattacaggcatgagctgctgtgcctggcctgtttcgttttgttctttttaattaaaggcaatgatcaaattatctaggaaattagtttaaagccaacat

SEQ ID NO: 58448 - DNA, 1040 bp, Homo sapiens
atagcacattaatctcccataaccttaggtgcctcactaagtatgattaagtcttaggagtgagaataattttcattattttggtctgtagtcagcttctgatcaccaccacaatttcaaaagatctcgatttagtgtttccctgcttctgaataggccgagtgactgccttctttctcctcagtcttatcttgccagcattttaaatgtaattgatatcacctgcaattttatgccgtcctaaacaaggagttgcccacattaagtcttttaaaacaccatggcatttattttcacaattggttgtcttttgtttataagtaaagcttttactgcttgcggtctttacttttgccctctggtggtcttcattttcacttttcttgtcctttatttaaaacggccttgaattggttaactgcacttctcagcaacctcctccacttaccaccatttggtgtaggctcaatgaatgttaactgttttttacgctggtttaaactgaatataattaggacagcgaatttgtttcagaacctgatggaaaacaggtattgcatatatatttagtggttacgttctgcgggcttggatgtttgtatcctgcttgttccttttctgaacacagatagttatttgagttgaattagctatttgttgactggccattttgcaagttactgtttttgaaaacaagatattaatttaatcaaagcttactttggtagtgattgtacctacttccaaacttgccgtaggtttccatattccattgaagctacttttgatccttaagatgctacatgactggtatgaaatctctcatagttgtggggaaaagatgatataagaagcttcaggctggacatagtggctcacacctgtaatctcagcactttgggaggctgagggggacagatcacttgaggccaggagttcaagatcagcctggccgacatggcgaaactgtctctactaaaaatacaaaaactagccgggtgtgacggtgcacacctctaattccagctactagggaggct

SEQ ID NO: 58449 - DNA, 1049 bp, Homo sapiens
ctttgccttacaagttttgcgttcacagggaaaaattactcacagttgaaaattagccacagttcctaatgcatattttcgtatgaaatgtgtactttatttctacttaatttccttgtgtctttggaaattcacctctgggggttaatttgttcacactacattcctcaagtaattggggcattagccaaggcagtagattgtcaacctccagtgagcatcacctgcagggcttcttaaacaaaggttgccgttccccatgcctacctcggtttctggattcagcacgtttaaggtaggcctgagaatttccatttccaaagagctcctgggtgatgctcttggtcctgaccaactgcattttgagaagcactgagctaagaagtcttgcttggttcacccacccctgttcctcaggcttggtatggtggtcactttttcactgcaccagtttgaatgattccattcctggttgctttagagctgcagagaggcttggttaatggcctcgtatccctagccaggttcatgtaaagcactaattagatgtttccatgttgctggatctccttggctatcgtctccagtccagacctctctgcttgctaccaaacagttgggtttatctggtgcttagatccatctgagtgtctgctatacatgccacatcctacctgtcccaacttgaactctccagtttcttgtcacaaaatgtgctgcttccaaattacctatctcagtgacattgctatctattgagttagctgctcaagccaggcatttggagttttcttcaacctgtcattcttagcaccctcaatccctttctcaaaccccagtaacaaatcccatcagtcattaggtcccttcgagtttgagtctgtaaaagtattttccatttgctcctttccctccatccttactggcctcttgagattgttccaagagcattgctgtggtttgaatgtcccctccaaaactcatggtaaaatttgattgccattgtaaacagtgttaaaaggtgggacctttacgaggtgattaggagg

SEQ ID NO: 58450 - DNA, 1560 bp, Homo sapiens
gctaggttggaattctagcgctgccattttttagctgtgtgatgttggatggacgtcatagcccttctgagcctcagtttcttcatctgcaaaatggatctggtaacatttggcctctcaggatatgtatggagaattcagtgtcatgctgtataacagtacctcacacagaataggtcaaggatggctatttatatgttcaaggacttgtatgtggccatgaatgtgctctttgtgtgtgatttttttcagcagcctgaattcacatgtgtgtcaacatacacataaagctttgtttttgacttttttttttttttcagtctattggctcaaaataaacatgttggctggcagctgccatgtggctcctcctacaagaggaaattgagaggtgggggaccaggcagtagagaagtttgaggagggaaagccactgagagattagaagggcagagaacaagatccttttccttgtatacttcttactgtaatgatggtccagtgttttatataaggatccttgtatttctaatgttgaaatctagttgattaaagaatgttaggataactctgtctgcctttaactagagtacaaaagctagctgctgtatctttgcagccttgatttccctttttgaagcccaaatataaacagtaaactgcaacacttctagtgtaatgccagccactggttatttgaactttaatgttgtctttcatctgagaagcctagagtatttgacaaacgttaaatcatagatcttcgtatcaacctcaaagcggaagggaatgttagaaggaatgaacaatgttagaacaatgttagaaaaaagggcaggtatgcagcgtgtgttcttgaaacaggatggcaaagaattggttaaatcttttctgcaggattgcgtgcagggctggagatcatatgaaggtatcctacccctttggggaatcggggagagagcccaggaaaatgcaggcctgacctggacttttgtaataggaggggagaggaaatgtatcttgcccagaccagcagtgcctttgccatatattgcatgcatgctgattatgaaaataaataatcttataattatttataattctgaattaaaggatatgatgcaatgcttgtggatgaaggacacagagtagctgtgtaaaaggtaatagtgactaagtgcctttttgtgtgataagggtagttctggctctaggttgggttataaatgacatattaacattgttttactttcctttcctttttcctgttggttctgtgtttcttgacttttcttcccccctcaagcttttgtttgattttcttcaggatccttgcaattggaaaaaacatttcatagccattcttagatcaaccttacatgtaaaatttgatatgtagttgatttagcttagtttccttaggggctaaattaggcccaggtcaagagtttcatcttgagcctcgtcaattagtttgaccccgaggactactgcatatccagagagccgtaaccctagctggccatcccgtaaatgctttatgttggtcaatagggagga

SEQ ID NO: 58451 - DNA, 1048 bp, Homo sapiens
cgcccgcggcgcccccggcgcgcgccctcccgggccgcattcctccccgcccccggccgcgcgcccagcgctccctccgcctcccggcccccagggccgcggagcccggctctggggtgggggagccgtggccgccggcgcctgctccgtcccctcccactcgcacggccccttcctccctcctctcccggccgctcgcatttcctgccgctctggctctcccggcccctcaaagttctttccaactttttctcggcggagtgagcgcagcgggcgcagactcgggggcaggttgctgtgcttctccgggctcagccgcctgctctcctggctcaggtcctcggggagccctagacagacatcaagtggccactggcgctccttcccctcccagctgagccatcctccccggcctcctcgggcgggacagccccgtgcttaggtttttctccttttctcccccggtgcgcctctgctcggactctcgcgccgggatcgcggcggaaacctccctcccctttcgcctcctgcggctccttcccttcgcccctcctccgccagtcactggaatcaattccgtggggaatcggctccgccgccgcgaaggacagcctttccgcgcgggactccggggcgccacgggggccatgtaagcaggtaagccccgtccaagccgggagttgggcccgaggttggaggccgccttggcgctccgggcgccctgcagatgacttgggcagacgctggcaacgccaacttgcgattggcgccccgggacgcctggcagggcagcctggggcgcggggtggccgggccgcaggggtgttatctcgcggtgggagctgcccgcggtgaggcgcaaagctggtcccgggagcgagctggaaggtgagcgcagtctggggagtttgtggttaaacccacaccctggtcccctctctccattcccttctgcgttttgggaacgagagagggcctcggaagggcaactagagatacctagaccttgggggctagaggatgaaagacgaacgacgtcgcggtcgct

SEQ ID NO: 58452 - DNA, 1087 bp, Homo sapiens
ggtatttccaagccgccttcccagtcccgtaaccaaccttattgaaattcaggccctggtcctttgttttattgagtagatgtaagcttgagttttgatctggttggcgacgtggggtgcctatggttagttacgcgagcatttctctttcccctctcttcttcctcccgtccacatttttttttttctttttttaaatagagataggcctccctatattgcctaggctggtctggaacccctgggctcaagggatcctcccgccttggcctctgtaagtgccaggattacaagcatgagccactacgcccggtcctcccttccacatttatttgaacgcgcctgtgtgcccggctcggctgtgtaatgaggacccagaaataaaaggcatgggtcgtgtccttgagcctgacctagaggagaaggcagggttatcattctcagacccagccttggtacagtgcacggggactctggctttttggaggaggtggggaattctgacaacgggaaagcagtggtggaggtggggcaggaggaggtcacacaagagcttccttggggactaagggactgggtagttcgggcatgaagagtgccctccacgtatttaagagataaagatacagcattttctggaaaggacaatagtcctgcaagtcctccatgcaggaaccttcatccagggcttttcttcactccccacctcgattccctgttcctcaaaagtaaacttctgggtttatttttttgttcttttgccccaatggcccaatacaggtggctgatagctgatcccttaatgggccaaaatctgctctaatcacagttagcttggtctacatctatattgttctctatcttagactttggaatggaaaagcattcagcttgccagtcttctttatgtttattcccctcattttctaatcatctttctaaattgctcctttttatattctgttggctatagcatcttgatgtaatgatttcagttgctggctgaattgtttagggcaattacagttgtgtgtctctgggtacagttctttgactcctgacaaactagattggaatggaggatatt

SEQ ID NO: 58453 - DNA, 1214 bp, Homo sapiens
tgcagttaaatggttgtggctttcttagactgggctttttaccttggtattcctcaaccttttcaggtctagaaaatgaaaactaaacagtactttttaaaaattacctctctattagccaactaaatagtgatacagtcattgcttctaaaaggattttgcttgtgggagaattttctggtttctaacaataactggttttagcagccaaacttgaaaatgaattgttaagggagatttataggatttatttcctattttttaatttttgaaaggatagtaaagactccctttctaggatgggtgtgtctggccaaagatgatatactacatggcttcaaagaagtttcctatctattggcttcaaagtgtgatcatctaaaatttctgtgttcatatggcttattgcagctgtatctcaggaatttagtagtcaatgttagactcaggtttaccaataatacttggtaaattcacaaaataagggagttattgtcttctgaacaattctcattaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtaatattttgggatggtatttatagggatgatatttgtatgtattaatcagatgcgtttgtcttttcctttaacaatataattattatactttgcaattttttttcctggtagaataagtaatgattcggtctctgtaccgtaacttgaaagagtggaagattaaaaacaaacaaacagtgatttggttttatcattgcatagctcagtacgatataaatttatcaaatgtttgctgcattactcatgtattcattcagtatatgtttattaagctgtaccatgattcagacactattggtcactgagtaatacaataataaatagtactatcatactatcaaattgatagtatgataatactagttacatagcattatttgatagtatgatagtacttgttaaaataaaactatcgacagctgttaccgaaaagatggaaattagttgaagcatactgatggctcgtgttttctctgggtggaaaagctgctgtagag

SEQ ID NO: 58454 - DNA, 1632 bp, Homo sapiens
ggagaagaatgagaaccaagcataggaggaagccccttataaaaccatcagatcttgtgagaacgcactatcacgagaatagcatgggaaaactgcccccatgattcaatcacctctcaccgggtccccaccaccccaccacacatggggattatgggaactacaattcaagatgagatttgggtgggaacacagccaaaccatatcactgtcatagtggttattatagatcttccttatagcctttataacattgtacttactggtttatgtttctgtttcttttactagactgagttcctttgaagacacaggactgggtttatgtctggcacataagttagaccttatgaaatgcctgttggataaatgaaatggttaagaattcttagtggatgggtttctttgtaagtttattactctctgggaatgtaaggcattgatattctgtagcctttgctctaactgatttgtctgcctcttgggtccttttctaacaggtgtaaatctgagcttgaaagaagccaacaagctgcgcagtctgcagatgtctctctgaatccatgcaatacaccacaaaaaatttttacaactccactaacaccaagtcaatattatagtggtaatgcattttcttccttggtatagacagctttttgtttagcttgagattttaattctgcaaaataaatgaattaattcaactttgaattaaacttttaatgtatatgtttaaaaactgcagccacttgttacatatccatttgcatatctgttgaattatgttgagctactggattgagcttttaagctttttactttatccttctgtggcatattttcaaagaaattcaatttcagaatatttaaaacacttatgtttttatgtgttttgatatttgagtaatttgatcaatagtttgatctatttccctaaccaaaatgttgtttctactaagatactcatttctagactatcaaaatcgttgttgatctgtgaattccttcatggaatcaatgactgaaagaaaactgtatttgattgtctgtttctaggttccaagtatgaagatctaaaagaaaaatataataaagaggttgaagaacgaaaaagattagaggcagaggttaaagccttgcaggctaaagtaagttaattatgggccctataatagagtatgcagttatagaatactttgatatagaatagaacaaggttagagaaaaatctgttttacatagagctggcctttttgtgtgtgtgtgtgctgagaaaaggttttgggctcagtggaggtgattattttttagttttaaaaatagggtggaatgaataaaatagagtggggaggttagtttatccctaaatattaaatgttcatataatgtacacttaattatttccctattaagacctagcgatcagggctattcttggagacagtggggccagagaattagtcgtgatgctccctgcctggctttatcacctggaggcagttgcttcctatatagtccttttgatctattgaattttacctctaccatttttgttcacgtgttatttgctgaaaacagtttccagtttggcacttactggtggctttccactaaacataaggacttgatgag

SEQ ID NO: 58455 - DNA, 1105 bp, Homo sapiens
tgttaattttggcagtatgggaggttcacactgtcttgatgtttactggaggtaaaactaccagagaatataggagggtgaacttttcactgcttagcactgatttgcattgatatgggcaaaaaacaaatatagtttgctgttgtgtaaaactaaatggtaattttaacaaagggtgtcatatgtgatgtacttttcacagtctcaataagaagatagcgttcctgattttagaaaagcattccccccaccaagtttctttgttaaaatgtaagaaaatctgtttctcctgctttctatagagtatttgaatgcaaatgacaatagaaactaactattgaaattaaatccaattaaagtagcttctgtatttagtgtaaatatttgtttcgtcaaagatttcagaaaagaataaaacaaatgataagttatgaacattttgggaaagatatatatgaattggagtgtgatttttgtttgtggttcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaaggtacttgacttttcgtgaattactggagaaatcttcatcttttcatacaattatttagaaagagtattttatacataagtttatgaaatgtcagtaatgttctttgttaatatatattaggtactcttgatgcaactgaactagaaagctgttttaagttgggcagatccgggatcaagcctggtgccgtactttcccagctgagtgacgttgggcaagtcactgatctcttttatgttgcagggggtaatagagaataaagaaaatgtatatatagcatctagcatgatgtgtgccacattaaaataggcacttaatggcactttaaaggagttttaggacatttgataggatttaattaatctgctcttgggatcgtatatatagttggtccattgtacccatgagttctg

SEQ ID NO: 58456 - DNA, 1205 bp, Homo sapiens
aacagactatcatatgagggtaatgggcaccctctgatgattttacagcttttaaattacataggctaacaccattgcattttaacctctcatttccatgcaacaaaatgttagatgaatcgttagacatgccgatcttttttttcatggcacaaattaggaagtatttatttaagtgggctaatgctttacatccttgctaatagttcctaaacataaattgtgtgctaaaacaattatagcagtttttctaaaacacaaaatatttgttcatttatgtgagtaatatttattttgtcttgaacatttttattcattattagtatactgcattggaacaaaaactgaaaaaattgacggaagatttgagttgtcagcgacaaaatgcagaaagtgccagatgttctctggaacagaaaattaaggaaaaagaaaaggagtttcaagaggtaaggtaaatggattcatgaggtgtttgtctgaaaggctttttatgggcttttcatagtttgatcacttggaaaggggagttgttatcacaatttgggaaattctcttagaggagaaatgctttgtgagctaaaggtcatcttattttctttcacatcttcacttttgcgctttttttaaatctttcagtttttgattagagaagggaattagtattcagaattcatccatgttttctgatttgtttgagatttgatattcagtaggaaaggatcacttttcttcttttggacattttctctgctgtggaggaaattgtattacattttccagtaggcttttaaaatttttttttctttcactctatttcctttataactccagtatttttttttttgagacagagtctcgcagtgttacccaggctggagtgcaatggcacaatcttggctccctgcaacctccacctcccaggttccagcaattctcctgcctcagcctcccgaggagctgggattacaggcatgcaccaccacacctggctaatttttgtatttttagtagagatggggttttgccatgttggctaggctggtctcgaactcctgacctcaggtgattcacccaccttggcctcccaaagtgctgggattacaggcatgagccaccatgcctggccaactccagttgtttttaaacctgtgggttggtaaataaattaggagggtagttgatgtggtggggaaagtggttgg

SEQ ID NO: 58457 - DNA, 1040 bp, Homo sapiens
atgacttgtattaagaatatgtagtccttccttaaagattgttttagacccccagggaggtggaaagatgggaaaggaaggaagggattttttaaatggaaagaaacaaaattggaagtatcatctaaatcccttttctaactgttggcatttgtgtctttcaatattaaaaacacgtggaaagtcatagatttaaataaacaaaagtagtgacagataaagagtttctagattaaaaattcttataaaaacatcaagcaattgtcaattatatgactctggcttcaaaagtggacactgaccttaatgttcagcctgtgcatgccctggttgacggtgtctttggagactttgttttgtccacaaagtggtggatgagggttcctgaatggcatggatgccctgatgggattttatgcatacatacttcaatttggcttctctctgaatttatttagtggcctggattttattttaaagggcttaattaagaaccattcagtgacagttaatagactgaaacaatttgaagagagccataaatcaacattgtaattttaagaagaggaacaacacaagaatggtagaaatttcttctccatcaaaccccacaggaaagaatgtttttctgtttattctttaaatgttctatgatcactttttaggctgtaaagattaagaaaactttgtccataaagaacagttatttgttcaggtgaggaaagtctaaatgtatttatccccaccgctttgcagagtgtatcatgatggtaaaatcagaacatctgtcagtagcagacaggtgattgttaaatcagctaaccccaaaggggcaatactgctggagatagggggctgcagctccagccacaaagtggaagaaaacttcaaatcagatgatagtttcatcagcaaacgttttcaaatggaagtgtttgtttcagcaaaacaaatgtttgccttttggccagtggggaccaaccaacagatgcttctgctaacatttccacaggcagactggcatcgaactcttccctctg

SEQ ID NO: 58458 - DNA, 1001 bp, Homo sapiens
aaatgatgcctcccttgctgctcctaaagcgaagttgatctgggtggaattgcttgctaagctctaatgctggcttgtggttatagggatttttgttgtgcttttccagcatagtacccaattttgcaaatcatgtgaggatgcaggagatgcctaggaaaatgtatctttgtatgcttaactcattgttgataatgagatacccaatcaagtcttaagtggctgtagcctcgtggaaaactaattgctgatggatggcagcttgcacatccattttcagatgttcattttctaaattctggccttttaaaattcttgggttggtcatagccatagcattataagcctgctgggtcccaggattggctgaacatttcttcgttagacacaaatatttacggagctaatgccagaatagagaaagtcatgttaatctttccattgagcttactattcatttaaatgtctccagttatggacagacatggatcgagaccaacaaacacataaacataaaattccccatctttccctggtgccctctctctcttcttttttccttccttcctattgggacgcacctagttttgcacagtgtctttccagctttcttgtcaagcctccagatgcaggtgtcatttgatttgattaaaaaattttttttttagagtaagaaaatattttttcatttgcaaaataaaaatgctaagtcgacccaggtaattacattctagttcctcttctatgttgacctcattcagctgatcttagcattgattacagagatctggctactgttaaattttgggaggaaatactactaataatgctacattgcccctgtcaaagtgctttaagatgtttgtcctttcacatctgtgatctcatttgaggggtgattattctgagtctgaagaacaaaccagtcattatacgttccataatttaatgatgctaatttaaatcaataacattgttgcaccttaatgatcgtgctttgc

SEQ ID NO: 58459 - DNA, 1080 bp, Homo sapiens
tttattgaaggtaatttttcccacagaatcattcctgtaacagcaaaccttaagatggttttgcaatgaaaagtaaacatatgtgctgagatttttttttttttttggtttattaacaaatcaaatgtttgcaaaggtatatttggccattcaggtgtgataggaacttggaggttttgtcttgaggatcttgtagataggattttccttttgagcttactctttaataggcgtatgaacaatgagaaagttcaatgaaacttcttgaaagaaaaaattatcttcagatttgggtttgatgctgttgtcttctgttcataacattatttaagtaagaatgtctgacttcattaggtactcaaacggggaaattgtgattctttccctagtgagatacacaaacagttctgctagggacctttattaaggcagaagtcataacttacttgagcattcgttttggctataaccaattaaaatgtgtgttttaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaaggtaagtaaacttagtattttagagttacctttctaagctgctattcccgtgagaggggatggatggcattaacatattagagaaactctttggattttttttcatatattccctcaaaaagatgtgcgcagttgatgtggaagagttttccctcttctagtttttagtttccagagtgagagtgggactttttttaattggaacatattgagtcccaaacgcctgatgctcagcactttgaaatcagaagggtaaatattttccacacaaagctaaattgtcagtgctgtctctcacccccgagtgctattctctgtgtctctagtgtgcttgttagttacatccagacagctcatctcctgactcattaccatttcccttataatggaaaaaccctatattaaatgcatgttttccaagctcctaatgaccattgttttttgatgacttact

SEQ ID NO: 58460 - DNA, 4080 bp, Homo sapiens
tctacttaagtctaatcctgtggatgttttagctaaaatggtggagtacttatttacttttctgagacatcagaattactctacaataaagtgggatgttcccatttcagtgctgttcttgtcccagttttctctcttggaataaatatttgaaaagatggtaaaaatatacacatatgtaaacacatacaaagaaaagaaacagtgcttaggaaaatcatcccttggtattttattcaataacatgttcttaagctgctagaaagaagatgaacaaatgtgttactctccttaagataaccatttttctcatttttatataagataattaccaagtgatccactttctaggaggtacccaggcaataatgccagtttttccagggcttgagtagttgttagtttgtttggattttgccagggggcggggggaggggttagcgtttctgtagaataaacatttattacaaacattgacgacttttatttatttttaaatagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgtaagtacctgggatttaaatgccatttctcggtttacatgactagtggacactcagtaaatgtttgtctaattgaaatgtacattaaacctaagttaaaatatttttagggttcaaggaaataaaatacaccaaaatattttcaaaacaaaccagaacttgaggaaaatgagta

SEQ ID NO: 58461 - DNA, 3513 bp, Homo sapiens
gagagaaagatgtagtgggaaattcaccactttaagagatgtgtttagcagaggccacgcatcagtttctaaaaagtaataactaaatctattctattttgattctttttgaaaaataaaatgcatgcttgttatgtattataattacaggctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaagtggctatatctgtttatgtttaaatatgtagtcatgaggcaggaaaccatattttcttctagacactgtgaattgtatttacttctagaccgtgtctgctatattggaccaaactttgtaaaggctttatgtttactgggtcttgaattgcagaaacactgagttggctctggcagtagtcactattctggctgattctttgggacatgttcatggattggaccaggtttttaatgtggcacctacataagggcaaagctttggtttatgcacagttccttgttctagttatatttccttttcttagagtacatcagaatagtggcctccccatatccagttgagactcactgctatagagagtataacagacattatctaggatcggaaaggatctgcctgccttactgtgtcttttttgccttcaggacaaagcacttttaaagatactgatagatttgtaaccaacagagcactcatggcttctagggtgtgttttggggatttcgtgctt

SEQ ID NO: 58462 - DNA, 1761 bp, Homo sapiens
ttcagatgctttcagagtgtttttttggatttgcctggtcatctgttagaatcttgtctcccaaagccatacaacagaagcttcataatctttgctgacttctgttcatccacttatggtagacagaatggactggggaaaataaggatgtaaaaaaatgaatttatttgattggatataactgacgctgcaagaacgtttaatgagttggctgaaatatgagtttgagactttggtggattttatttaagctgtcccaatgagtgtcacaggactagaatatctgccttgatatgatatacctcccgaacaagagttgtttgaactataagaacatatacagatatatctccccaacctcttaaaaaaaaaaatcaaagaaagaacacgtctaagattatctgcttcacgatgcccattgttaactagagaagcatcaagttgcacatgatgtgttgctttactttggacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaaggtatgcctaatttaaagacaaaattatttgtgttcttttgaaattccatataatggttcacatataaaaagacaaaagtatttgcttttttacattattgtgcaataatctcattgacgttcataagcaatagtctgcttttaaatggatgaggcatatgttttcctctaggatctaattacttgtgtcacattaacaaaagagctggtagattggaaaaatggctgtctaaaatctgtttggaatttgttatttgaatgctgaaaaaaattattaaattaaggactcccgtcagcgtttcctacccgttggtcatgtctgacctagctagcaggtgagctggagggtgcaccctgtgatgctggccccctgactggagccactgactacactttgttttgtttttgttttgttgttttaatcttggttttcccccaagtctggcccaaggactggtgccattctaggaactgtttgttattggttcccaactgaaacaatgtattgtaattaagtaggaatttagaaattttcatagcaacttgatatttttgtaacatccaagcacatatcatgttttctattgatttgttctcattatattatacaaaaatattattccacagcacattggaaattcttcgaaccccctctgcccccaaatatcaaaactgatgctttgccattgatggtttgaaaagcattgttctgagtaactctagcccaaaaatagttatctatctctcactggtaatttttatatgtagttaaagtgtgaaaaaaacaaaaacaaatgctgctttagttagcc

SEQ ID NO: 58463 - DNA, 2514 bp, Homo sapiens
tatataaatttcaatttttttttttttaaatcttgctctgtcccccaggctggagtgcagtggcactatcacggctcactgcagcttcaaactcctgggctcaagcgatcctcttgcctcagcctcctgagtagctggaactatagatgtgagccactaagcctgacccaatttcaaaaaatcttcactcaccagttaccttactctctcatctacttaaagtctcaaattttctgagatatctctttcctttaaaaggcaggatgtttgagaggggatttattctttccggactttattgttagatagctgcccttctgctctagtccaaattcaatatggaaacagtcagccataaagggagaatgattaaaataccctgaactggtccttggtcattttaaaattttccaccctgtggaggtagtattactcatttgggttacacttgttttaaacaacaggaatggctagttaggacaacagaggcaggtttttcacttaggaattcactggatgtgtaccatgtggtcaagcatgttgtgggctctagggatacataggtaaatagggcatagtctttgccatcagaggtgccaagggacgtctgatgactggttagaggttgtacctggtatcctcctaagttctctgttagatggggcctgttctcaaggaagaggaaatacttcaattatatataactcctagagaagaagaacttaatttaaaacttagtgacatagtgctttatttttcatgttgtggaaatgtgaatgtgattgaacctctaacagagatgtttgtgttgcaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaagaatgattcctaagtgtaaaggcattcgaatattggtactatttcttgctaattacaacagcctcttatacacgtgaaaatgtttgaacaaatgatacagatctttaaacaaatgatcttagcatctttagttgtattaaaagacacaatttggaatacgggtcataaggagtatatgggaatataagacgtccagcccagtgcctcctacattctgtgtccccattaaaccacatcatcaaggatacaagtatgtggtatttcccagctcacttgatgatgatatagttttgaaagcatgcaggcattataagccatgtcagatccaaaaacatttgaacaagttcttacatccttgaatcagggtaaaaaagtttcccagggcatgcgctagtaaaagatcatttgttcttggctttcagtccaaattgatgcacaaattccgataagcaccatcatttatatttaaaagttgtccttcgcaaggtggcctctgttgttggataatgcttcaataatattaagctacttaatattcatcagctgaaagtgatatcctgactttcctcttgtttcttcagttgcttggggttgaggtctggtgcaatatccttaccgtaaatcatcccagggcccccatgtgctcaagggcatgaccccgagcagacattgttgggatcaggccatcagctttattggctgtctccagtgattggaag

SEQ ID NO: 58464 - DNA, 1057 bp, Homo sapiens
tcaacttttactacctctaggattagtttttcctttcccaatccatgttgacaaagtgggtcataaagatccgtagatcgtttgcccagatctgccctcaatctgcgaatcagcttcctcgttttagaaaatctgaaatgtaaaagggaaaggggctgggatcgcgtggggaggaggaacgaaatggaatcccgcgtgggcaggcggctggccaggagcacattcccctagcctccctacgcgccagccccgcggcgttgggaagctcctccctgacctttccttcctcctcctcctcctcattctaggcggcagtggcgggcgaagcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccaggtgagtcggcgggtagcgggcttgcagcggggatgccttggcggcctcctcctttggtgtcgacggggaccgagagtcgcaggaacgagggcgagcgtgggaggccaagcctggaggggaacgtgggggcctccaggcggcaagaacgtcgggcggattttggagctggtgaagcatctgctctgggaagggagaggcagaagggacgcttggaattaccgaggaccaggcccatgtggcagagtagctgctgtcctagaatgccaacctttgcccctcccaacaggcaag

SEQ ID NO: 58465 - DNA, 1108 bp, Homo sapiens
cccagctactcaggaggctgaggcaggagaattgcttgaacttaggaggtggaggttgcagtgagcccagatcgtgccactgcactccagcctagatgagagagcaggatgctgtctcaaaacaaacaaacaaacaaaagttaccaattatgtattttacatttttaagcaatttgttttcctcttatgtattctgtggtgctttagtttaaaaaaaaaaaattgtcattacctttccccagctctgaaggaaattgagattagtaaaagtattatgagaatagtattcttttccacttttgacagcagtgtgcagtatttacttttctcaagtacccctgtgtgcattattaaagtacattgtagttttaatgattgaacagtataagaaagtattatttattcatgttttcgaagtattaattgaattctagactgtttcagataaaaatgtttcctcaggtgtcacttttaccaaaggtatcaatacaagtgattttattagacaagattttttctatgtattaaaatatcagtttaataataactattcagaggaagaaaaagacaccatctcaagaaaaagacaccatctcatgaaatgcacacagactacattccaattttagaaacattaaagtttaagagtggaaacaaggaaatgtagtatttaagtaattaagacttcattccctattagtgttacagatattaaagttaaaagattaatttgtaatttgaaaataaaactgttctcttttttacagatatttattgatagagatccagcagcatttgcacccattttaaattttcttcggacaaaagaactagacttaaggtaagaaatgcactctttttaaagtaaattcttactgataaatatgtgtttttaatatgttttatgaaataaaaggttttttttgtttgtttttttttttccttgagttgcagtcttgctctgttgcccaggctggagtgcaggagtgcagtggcatgatctctgctcactgcaacctccgcctttcaggttcaaacaattctcctgcctcagcctcccgagtagctgggactgtaggcacatgccaccatgcccggctgatttttt

SEQ ID NO: 58466 - DNA, 1083 bp, Homo sapiens
ttttacctgtgttataatggacttctgagcaagatttcattttaaaaaatgttcccctgtcaaataaaaaatgtttgaaagtatggggaatttcagttctaaagcagttaaattattacatagtacctaacacataatacctgtaccataattgtaaagagtggctggcagactgaattaattacccattaattcagtaacctaaagcttatttattgtaaacagtatgacaataccagaaatctgttgacagaattttgtctttgtctttgtttttttcattttcattttattttttaattgtaattaaattatttgtaataatttgctatattggaagatgtatttcggctttaatgaaattcacatttttgtttctttgtcacaatgtgatatttttaatttttgaaaggtgaacttaggaatgtatttgttttcttcttctctttataggtattcctagtcgtaaaataaacaacacagtcagatctgctgattctaggaatggtctaaattctacagaaggtgaagcccggggaaatggtacacagcctgttctctctggaacgggagaagaaactgttaggctaggtaagcaaagattacagaaatagaaaaagaaaaatacgtatgtttttagtgctgggtgatattgagtaattacttttaaagatttttgcctcatctccttttttatccagatttatcatttatatcttggaaaggtctcatttaacacttaatttttatttaaaatgttgtgtaatcttctatcttctctgaatctttagaacagggttgccaaaatttatctggtaagagccagagattaaatattttaggctttgtgggccacgtgttctctgtcagacctactcaactttgccattgtagcatgaacacataatggacaatatgtaacaagtaagcatggctgggttctaacaaaactatttttttttttttttttgagacggagtctcgctctgtcgctcaggctggagtgcagtggtgccatcttggctcactgcaagctctgcctcctgggtttacgccattctcctgcctcagcctccggagtag

SEQ ID NO: 58467 - DNA, 2889 bp, Homo sapiens
gtgctaatagtagctggccatcacaactggattgtagctgcatatgcccattttgctgtgtgttacaggtagtgtataattaataatgctttgcttttacaggtggcagtttgaaaattaattgtgattttatatttttagattgaaaagctatttttttttagtcatcaagttttttccctgcatattttacccatgtctgtatcatctgattaagatttagtgtacttttattttcacagctaatttggtaaatgtttctgatagcctttatctgttgtaaacatttagcagacaagtgtgaattgtcatgtaactgagatatcctgatgtattatttattgcttatacctagcttctgagactgtagtatataatgatgttagacaggattattaatgtgagctccctgatggtctatctctaatgattcagtgttttgtattctatagcaagggagagtacattggtcataaataccacattttgggaagtgaggtagtaaagcaggacagttattgcacaagtggtatagtttaatatctaatatgtgaaacttacaaagaagtagtttggttttactaatgcttacattctcagagcctgagaagcaatgaagaatagtgtagaccggtgatttttttttttttaattgggaaagtgataggactcttagttcaaaatcactgtactcattgagaaatgttgatgacagagaatggtgtagaagcacaaaagtggttggaatatactagcttagattattatttcatttaattgcagaaaaatcaaagatacataaactatttgtttatcactgttgagttcggttaagaaaaatagtcacaataagctgaaaaatatctaaaatgtcttctaaagtttacagatatagtttaaagaatcccagatgtattttttttttaaaaatctgaatttatgaaaggtttggcatgtctggtaagtgctgtttatatcagtaatctcaggtttatattttccttgtagtaatgattaagtgcagacttttatgttttaagagtgttttggctgggcacggtgggtcacgcctgtaatcccagcactttgggaggccgagatgggtggagttcaagatcagcccgaccaacatggtgaaaccccatctctactgaagatacaaaaattagccaggtgtggtgatgcatgcctgtaatcccagctactcgggaggctgaggcaggagaatcacttgaacccaggaggtgggggttgcagtgagctgatagctcaccattgtactccaacctgcgcaacagagcaagactctgtctcaataaataaataaacaaatttttaaaaaaagtgttttgtggatttgtaattttaattatgaaatagcatggaaattgttttttgcataatttctttggggatggttttgtatgaggcaagactaatttggtaaagtaatttttttttaggaagcattgttttgaatttatcatcttatatatttgaattgaggtgacttgtagacccttgtttacatattatgtacatatttttgtcaataaggaattccagaagaattgtgaaatgataagtgatccaagtgtaacagcataacttccgttttgttactgtacacaatactaaagattgctcttttccagaaccaccacattattacgcaaaatttaactcactgggtaataattgtatggaggatgatgctattacattttccagtctttgcgtttgcattgatcacgatctttctgtgctttcaccaagtgtctgacatttcagagcaatatactcatgtaaagtgacgaaggaagacaattgaggacatatttggatttcctcacatatagttaaatcattcaacacaatggcaataaaaagatttcaaaagaaagaaaaatatttaaactgtttaaaagtgtaatcttttttacaagttatttttcctcaagtttttgtatcagtaagttacaaaacctttaaaaaaagagtagtacagtgaagacctgtatgatgttctcctagcttcactaattttctacatggttaggttttatgtttatgtccctttttcttgctgagtttatgacagtgttacttctattaacgaagagtagttgtgtgaattgctgcccccttggggcttatattccactttagatctttaatccttgtggagtttacttttttgtatgtggtatgagatttaaggatttattttcttctcagtgggtaggtaattatgttctgacaatttattacgtaaatcattctttgtcagtgaatctgatagcccattttatcttgctttatgtgtgtgtatatacttggatctgtttttcagttctctcatttccttaagacatatgtctattctcatacaacttgaggtgaagtatgttcataataagtttcaaaatctcacagggcatgtcctctctactgtattttattgaggtcttcatgtaggaaataactagacgtaactctattcttcgcatagctgtcttaaccagagggttggttcactaggcagcagtaagatgatggagaggtgaaataacagagcatattcttgttttatattttgttttatttattattatatattttttgttttgttttgtttttgagattttgagacagagtcttgcactgtcacccaggctagagtgcagtggcgtgatctcgggtcactgcaacacctgcctcctgggttcaagcaattctcccacctcagcctcctgagtagctgggactacaggtgtgcaccaccacacctggccaatttttgtatttttagtagagacggggtttcaccatgttggccagactgttttcaaactcctgatctcaagtgattcacccgcctcagccttc

SEQ ID NO: 58468 - DNA, 1226 bp, Homo sapiens
ctcctgacctcaagtgatccacccgccctggcctcccaaagtgctgggattgcaggcatgagccatcatgcccggccgattataacatttttaagctcaagtgatcattgaaacatttagcttagaccctatttcgtagttgagataagaaccaaaaaagtggcaaacaaaggtactctgagagccaggatcccaaccctggttctcctgactcctagtgcagtactctgctaaagagagacaagtgtataaggccaatatgccgcaccaaggtgagcctagaattctctgcttaggcattgctgggtcttttgctactgatgtgtgataggtgctgcttacaacctctctcacctacacttactcttctgtttgctctgattccctgagcttgcccatattcagtctcccaatttgatggactcctattaacctttaaaaactccaactcagatggcttcttttctaagatatattttcaaccccctttccataccctttttaccccatagatactattataccctgtgcatccttctgttattattgtatcaaattataattggttgcagttttttctctactaaagtgtaagttcttagtaatgtcttgtcttctcgtgttttttaatcctaaagcctgatatagtgtcttttgaattaattaaatggagattgcagtgctggaacacatggggtttaaaaataagctctgagtaaaaggcccgaatgtttgtttttagtatcatgtgacttcttgctgcttttttctcctttttgcttatttccagaatttagacacattctagatagttaaggctgccaagtctgtgtgttcagatcactagttcttaaatatcgggtccatgagcaagctgcatataactcacctatggattttgtaacaatacagtgggttttctgatttagtgagtctggcatggatcccaggatcctttttgttttgttttgtttattttaaatctatcaatcaggttattttgatgatcagctgaggttaggaaccaagcttcaggataaggtgttatacagcagtatgagatggcttggagcagactcttccttgctttagtagttctgtaagctgcttaagagcttgtgagtttcttatttctagtccccaacacgtatagcacatagtttgtagtaatgagaatataaattagtcacctttaagatgtttttaatccaggttttgattaattc

SEQ ID NO: 58469 - DNA, 1030 bp, Homo sapiens
aagtctcactctgttgcccaggctggagtgcagtggcacaatccccgctcaccgcaacctctgcctcccaggttcgagcaattctcctgcctcagcctcccgagcagccgggattactggcatgcgccactacgcccagctaattttgtatatttagtagagacagggtttcaccgtgttagctaggctgatttcgaattcctgacctctggtgatctgcctgcctcggcaggtttcttttagcacaaatatgggaaggtattaatttgtaaactagattgattttcctggaaaaactaatttttttattcctatactttaaaaaaataaatacaaatgagactttgtttcccttgccatttcctagaaaagaagtaacctttagcaaggagaatgaaaaatagagaataccaccttttcagagaaataataaattatcaagggagcaagtactttctggaaatcagttgctttgtttactagttctgattctgtcacttgcttactgtgtaactttggacaggtcatttaatctcttgtatgagaaagggaaaagagagggacctggtcagactcggccttccagttctagtgggctgcaatctagtgatcacatgcaaaaaaagaggagacaaccaatcgaaattgagaaaggaaagtactgctgtgggaaatacaatttaaaaaaaatattttgaaggaagtatattgatggttctcctctgtagcatgtttgtgtatatgtgtgtgcacgcgtgcacctaaagaaagtttatttcctaagccctactaaaattggatattggttgcctctttaccagaagaatcaaagttttgaggaaattgaccagaaaatagaaattataattactatctaacatctgataatactctcactacatcaggttcaagatgttgttcctataactagttatgacactgctggatcattccttctgcttggatgtaacaatggatcaatatattacataggtaagtgttcagtcacttaaaatgctcctgcttaatg

SEQ ID NO: 58470 - DNA, 1051 bp, Homo sapiens
acgagctctggagcagtacgagtgattgtacaacacccagagacagttgggtcaggtcctcagctttttcagactttcacagttcaccgaagtcccgtaacaaaaatcatgctatcagagaagcatcttgtatcaggtaaaatgatttcattatactggtaaggaacttggctctgtgtgttattttcattaaaagaatgaaaacgcagtgtttatgtgagaaaaatatactaaaagaagtactagaaaagtttaatgactgaagaaattatgattgtcttttaaagatttctttgagctggtcgtggtggctcatgcctataaatcctagcagtttaggaggccaaggcaggtggattggtttagcccaggagttgaagactagcctgggcaacatggtgaaaccccacctctaccaaaaaagaggaaaacaaaaaaaagatgttttttattttacctggttttaatatacttaaatttaggagatgtgatttttttttttttttttgctctcttggcatatcttattgcaaaatatttattatgaccctgctaagaggaatttttattaaatttttcaagttttacttttaatataaattgggttgattatattatggtttaatgctaaaactgtagatttaaatgtgtattttgatattttgtcatctcaaaaataataaaaattacaattgtagagattatttgaagaaaataagcttttcttgggtttgtagttcttcataatataaaatttttaattaaatattaattggatacataaaaaattaaatactaattttcaagtttaacgaatagtactttctgattacaaagtaaaattctattgaagaaattcattgtgtatggaagatgatttctaaaaggctttgtgaaaattgcattgtgagttgggtgtgtcagtaaagcttgctttctagaggagtcttacattaactccttttgtagagcagttcttgcccaacttaaaatttttacaaacatggttttcatgtgtcagatttgtttttgtgaaggctggctagaagat

SEQ ID NO: 58471 - DNA, 1528 bp, Homo sapiens
attttaattaattttttgacatttttgttttctgatcaaggaccttttggagagcgagacgatcaacaggtgtttatccagaaagttgttcccatcaccaacaaactatttgtaagactctcatcgactggaaaaaggtaacactttattgtaaaaatatttgtattcagaagccaccttttgtcttacaaaacatatggcataatttgacatattgaccaaagagtgctactagaaacaaattgttgggacagaagtctgttatctcataatcataactcaaaattaagacagtagactttatgcttactttctgggatttaagagtttcactgatgctgtggacagttaggagggactagtgatagaataagaacacagtgaactttttttcatggccaaacataaatacttattaattttgttattataaacagtttctatctttaaaaaacctggaacttaaatattttccatcccatataaatctgtatacattattgatgtttctcaaataaaacattacagatttcctgattcagtatccccttttaaaataaaaatgatattaataacactaatttgcataatcttggcacagcttacaacatagcacacattttttttttctattttagacctatttccatctactttaacatggagagaaattgtctgtctccgtgagagtaggattcctgtctttatgcagtctcctcagtatttgtttgtgaatgctgcacttatgcttccattatatggcactggcagtattcctctgcttttgtcttcagaaatgatttctattcaaacttaaagaacatagtgaatttgctggcagacggctgaactaattctggcacttcctgttactagctatgtaaatacaactcaagttattttatttcccttatcccagtttctttataaaataaggttcaacgactttggcaggatttcataggataaaataaatttcaaaaatgaaatatctctcatagtacctaaccataatagatgtacagtagaagttaatttcctcttccttttctattgactgaaattttacttcttttaaaattattatttataacctcagattttgcttcaacattcctctgcattaaacaaatttttttgacgatgagaacacatggacacatggaagggaacaacacacaacaaggagcctgttgggggtgagcggggccggggagagagagagcatcaggaagaatagctaatggatgctgggtttaatacctaggtgatgggttgatctatgcagcaaaccactatggcacatgtgtaacagacctgcacatcccgcacatgtaccccagaacttaaaagttacagggaaaaagttttttgcatgtcaaacaaatgaaaaaagtaactttcctgttaatagtccattaggaaggttattgttttcattttatttatttatgaatgagacggagtcttgctcttttgccaggctagagtgctgtggtgtgatctcagctcactgcaacctccagac

SEQ ID NO: 58472 - DNA, 1051 bp, Homo sapiens
aactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaa

SEQ ID NO: 58473 - DNA, 1046 bp, Homo sapiens
gtaaaataaaagcaatcggactctttagagcttttgtttatggcctgtctgggccctttgttgtaaccctgtcatgcccttatgctgattaccttcttgtagaacaagaagtattgactagagaatgaatgatgtgtagtccctagcccttaggaaactctctcaaagagcaatgtctttaacatatgaattctgtttttttcctccttttacctttccctttccctttctctatttttcaccatctcttttgtttctacctcttttggtctctgtgcttgacactctctcctctttctgtctctctttgtatctcctcaatctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggttagtgtcggacctgggaatactctccccacttccaacctcacatgatgggtttttgtttttccttattcttattctcataagtcaagtatcatagttttaattctctcttgagtagaaaatggaaatagattacaattgatagtggaagatttatagaataaaatccccccagatatactccatatctattaattttcctcttactgttaagctttaatggtgcaaggataataaactttgggtagagtttacaagagcatagttattattagagcaatgtgggtctatatagcaactgta

SEQ ID NO: 58474 - DNA, 1073 bp, Homo sapiens
taaccatatcacctcagacctgtaatctcgttctttccattctttcctccatagtcccccgacacacacacacacacacacacacacacacttgaacacacacaaccacacatatatatgcacatacagccacagacacacaaacacacacggctctctttgtctaagtgccttttagcttaaaaaagatcttggcccggtgctacaagagtcatgatctttcaaaaagcactccatgaagaataacatgctgggtaatgtctcctgtagtcatttcccatgacagggattccctgcagtgcagcattatgtagcactggcagtctatgctagatggtataggcctgggacacacaaaagactaagagaataacagtgtacacgattccaggtatgttttgcaaagctctgagaaacatgtatacacatacacacaaacatgaaaacaaacacatgtatacaattatgcacaggtgttcccttaaaattgggctatgaaagtaaccccaggactgtgcttttcacacaaaggccattcataaatgcttgatgaaacaatgacagccttgtactgtttcaacaagtaggaacgtgcaaacaggatggagttcagttggctagcagtcactgtgaaccacaggccaaatgtgtcaacagtaaagaactgccactaaaaaggctggcagatccaatgctatgcatgtggtcatgtagtagatcagcatgttccatgaggtagtgcagcctaggaactgagtgtcgtttcagccattagtgttgtgttcaacatggagctgcatagccatttcaaaagctcttatgcttccttagctggtggaagtctcagaagagatgggactatttaccagctcactacagaactctcaaagatgctaagaatgggtccagcattgaggagtatgtgggcaatatgtgggagcatgaacagaagagacttcgtggtttctctcctctcttttgtcatggaggtagaaataattctcattattttccttttccttttttttttttcttttttttcgagactctgttgcctaggctggagtgcagtg

SEQ ID NO: 58475 - DNA, 1028 bp, Homo sapiens
tccatttggccaattggatggatccagaagggcatctagtcagcaggtagagctgtggccgtcacacaggtgacaggtcaagctccttttatgcctccaactcagacaggaattaaatcacgagttgcagaaagttgtgtggggctcagtaggccagatgagaggtcgggcaactaaaggcaaggtgttaagtcaccatgcacgggtgacctcagtggataaaagtggggcaaaggtggtcctctgctgggggtcatgggcttagttcttatcattttacaagaattttccttttttggctatttcttctctcatctcaggccatgtattattccagatagtaataatgtataaaagagacaatagaaaaaccaaatgaaaatgacttaccaggactatggaaattaaatggtagtgtaactatataaccatatgttagatattttccaagatcttcctaggacattggcagggcccttcctcttaaaaacaatttattaatgtaataaacattcacccagtagttttcaggacatttgactttgattatgtcctgatcctgagtttctataaagtagataggggctgtgtttggacccataagggtttggccaaagacaaggggccaggcttacagagattatgctttttttctggcaaacagctttggcaggtgggaggaagaacattagcatgctaaaatgactaaaatagagttttcaatgatctgtggacattctttgatttccccactgtctttgaaaaagagttaaatttcttgtgcatatacttttttcccaattgatttaccctagaagttagaaccaaaagccctggacagactttatttctttagtgtagaggtacagaaaatagccaaatcagttatcttttatcaaaccattactttttttttttaaagcagaaatttatttttggctacaactatttgaaatagatgtcaccctactaagcgtttatttttaatgactgacactggcaaaatcattctgcagaaacatatgcta

SEQ ID NO: 58476 - DNA, 1053 bp, Homo sapiens
ttgatctatgaaattggtttcaattagacaccgaaggtgtcattatcctagtaaaggggatttgtgatataatatagaaattctgtatttgtttcaaaattgttggaaaaatgtgggaatagaaagattttgagggaaatgccaaaagccacattaatgaagaaaaacactgttgagatacttttgaataatagataggttatgtaatggtcaaccacaagataaaatttttacacggtatttttatggctttaaattggctgcattgtaaactaagcttactactctattaagtcattatacttttcaattatttaacatttctggccaagctatcttctgtggtctttttctgtacacatcagaaatgatgcgtacagtagtagttgtttgttgttagtgcgaggactttgtgatggagcaagctttaatttaaacttttcaagacaatattatgaagaatgcacagaggaaaaagcatgttatggatataatttgagccctatgaaatggggatagctacagcattgaaatgtacctaatacaatttgagttattctcactaagaaaccttgatggtatctgccttctaggtactgtgcttttggaaatactatatatccatttaaatgcagatcttctcttttctccagggagcagttggtgaatctttcaattgaaccacgggtatgataaaaccaactgaaaatttttccatgaacaatagagtctgtcgttttgaagtaatgattatcaagtttcataatattgtgatttttaaaaattcatttaaaatatcttcataaagtcaaaataatgtaccgggacttcttgtgcaaaggaagaagttttctcttgtcactttgttgtcagtttgttaaagctgtgaaatcatacggctttgcaattcagtttttaggttggcactgccatcccagtagagtaagtaggctttaggaatcagagcaaagaattataagtaagttctatgtgttctcaccctctcatgctagtggatgagcgtgtggtgctgtaggagagtttaaagatctt

SEQ ID NO: 58477 - DNA, 1053 bp, Homo sapiens
tctgtaaatgagaaaaaaatgaaacaggatcagagagaacaaagaaggagagaaaatgtttgtgtttcctacaaccctaaagacctggcttaaggttgtcagatgttctcttccaaaaagacaagaggaatctcacctggaatgtggaggaagcaacacttctttaggagaatatgacctccttccgtaggactggccttttacattattggacaaaatatattattggacaaaatactgaccatgtgagccaaacatcttattagcaaacagacaaatcagagggtgaatcattcacattacacaaagatttttcatgttgtaaaagagcacagggtccttttaggtagcactttctgaagtgcttatttacagatcattaaatacttaacagagggaaaaagtaaaagctgaagtgcttaagtcagtatttattaaatatccaccctagattcagataacacaaatctaaaattataatgacagttaattgtccagtttttcaatttttatgttagcagacaagaagctaaaataacagcctgcccaggttaatacatcccgagtgttctaacacagttgtaattcttttctgaggtcttattctcaatcccataagacacccccttatcttataatacatgtccctttttttttacaggctaaattaagaggctttctgttacttccatataatactaattatctgctggatgttggctaatgcttaaatgtattgtaaaacactgaaaagtgctatgtttgaccaactgaattttctctgtgcaatcatctcagaatttataggagctgttacaccttataatgttttaataaagttctatcttgtggcaagagaggattttaagtgacatcattgcctaattttctctttagttctctttgttttggtgtcagagggtggggacaggcttttcctctattgctcaggctgatgtgcagcagcccaattactgctcactgcagctccaacctcctgggctcaagtgattcttccacatcagcctcttgagtagctggaactacaggtgt

SEQ ID NO: 58478 - DNA, 1128 bp, Homo sapiens
agacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgttatcaccagagtgccctctaccttactttaatgcagattttataaattttacctcatttagaacataaaataattattgaaagaaaaatgtattttttaaattcaccgtgattgaactgtaaattctattaatccagatgtacttctacctctgttttcccaaagattgatattatttttaagatcaactcaagtgtagtaaacggatttaaaattttaatcattggagtaatttattacaatattgaatcaatttacatgaaaagttaaatggctctcccagaactcagatttctggcaatgacccaacccatttagaaggtgaacaaaagaagtaaatggtactgatttgccctttctaggacccaagatgttactttaaaacctagcaaaagaggtcgtttgtattacgtgcctagtattgagctgtttctgagtcatttgcttcatagtatcagaaattctaaattgcttttagtttagaagatctttatttattatcttcattattaacaacttattatgatgatgattattatcattctatttataatggcctttgctggttgagtaaagactgagataacacatgtgaatcacctttctaatgggtttttaaaatcttgtcactttccaaaagagtttttttgtttctttttttttttttttttttttgacagagtctgcctctgtcgcccaggctggagtgcagtggcgcactctcggctcactgcagcctccccctcctgggttcaagtgattgttctgcctcagcctcccaaatagcagggattacaggcacccacgaccatacccggataatttttgtatttttagtatagacggagtttcaccatgttggc

SEQ ID NO: 58479 - DNA, 1047 bp, Homo sapiens
cacttctaatgcagttgttccatataagggactagattataaaattatgcatttagatgcatacctgatcatcttctggctgtattgaattttcaagattaggaaacacctgtgtgtagagtgcgtttgtatttgtatagaataatatttgccacttgttgagtacctactgtgtaccagaaactttattattttatctttataacaactgtatgagggagatggtgttatcatcaccttacagatcataaaatgaagatgcaaagaagtgttaggttagctacctaagatgacagaattattgaacgcaagggaaggtttcaagcctaggtctgcataacacctaaatccatgctctttccatagcaatgtacttacagcctctttgtaagaatatatatattttctttatatgcacattacatatatataaagattgtcctattgcatatgctgacttaaacgcactactatatgccttaagttttatagaagatttatctaactattactatgtagaaatgcgaatattcatgaaatatttctaatatatctcttcatacaggaacatgtagccacattttggatgaaacacatgtcatcagtcttgcaattcagatctttcataaggcaggtataggattctttaacatctgcattccagttgaatggtccctgaattttcttatctttcattgattcaaccattagcggcagaaacagtacaagaacaatcttaggaattctactaaagcaccttagtggcagcaataaggaaaagaaaatactggggtcacgtcctaacactccgaacatatgtgaaatgagaaggaaaatgcataatggttgaggagcggataatataattatttctgcaaggcgattttgacgttacaactcagtaacatcagaagaaatcatttatatggcatatgggtacaaacattgaactttagcctaaaacagttttttttatataagcttacaccagcatataccagattttatatttcaaaattgtgattttcttaatattcaggatgttgg

SEQ ID NO: 58480 - DNA, 1583 bp, Homo sapiens
aagttggtttaaaaagcaaaataaaacaaaaagacttctttttgagttctgcttttctaatatttaataggaaaattttcagaagtaatacttgggaaaccatgtttcaaatcgtaagtgacagacccgtaacaaaaatgcaccatttctttatcctttccacttcagaataggttggttttgatttgtctcccttctcttcctccccatgcaaatatcccaactaaaacacatatctagttgattggtgtttttctgatacaccttacaaaaggatcttaatattgttctttaataactttgggtctgttcctaggacgttgcattgtcattctcaaaacactgcagaagaaagaaacagaaaatgccgaccatcaccttgagtagtattccaaatgttctgctttgcaaagacaaatgactcatttagactgaagaaacaaggctgcctttgagacattcattgattttaaattaaaaaataactgctattgtttacatgaagagtgacaactaaataacagagtagaccttacttagtgtcatttgtagcaactccactgcacctgtctgaaagaaggggggtgtggggcaagcctaaatggggtgatcttatggatcaataatccagatctctcaatgctgtgtagcagacagtcaattcttgatagaattactgaaatatacagctagctgtttttcttatggctcaggtcttcaggtttggtgttgctgagtttattaactttattctccttgaacatttttctctttttctttatgtagctatgttgggggtcggggaagggagttgaatgaaaatgttatatttcatttgctctgtgaagatacccaaaatgtttggcccagcagatggaaaaaaaaaggtttagaagagggagttggttgttcctgaagtttgtttttcactatctttgtaaataggcctacataataaattttaagaagtatgaaaaaatagttataaaggcaatattgacttgggagagttatttttaagcaattagaatactccaattacatataactagtgcaaaaacaaagtaaatagaaaccaatggtattaatagtcacagtgagcatctaatatcaggcactcaagtatttcttctgattatttctaaaaatgtgtttcttaagaaacgtgccctggctaataattgttttagcttagtttgagctttaaaagtatctgaaatcaataaaaccagccttaattcttttaaaatttttattgatatttaatatttgtacaaccaagaagtttcattgtgcagtaacttgcatcattctttagttattataactgagatgaggaagtgagtgtctgaactatggcaaacctagttggtctcctccctcttcagtctcaaccgtgtccaactcgagctctctaccagcatccatgcatctggtctactttaatgactccacatcgctgttaagtccaaacatcttcatgggacaaaggtggcatgtatggccccatggtccagccgcagtgctcttttccattcgtgttatacagtcccttctgccaacactgctctgcaggcatcctg

SEQ ID NO: 58481 - DNA, 1037 bp, Homo sapiens
aacaggacagatccatctgaagcagtgagaggaactacacagtggcaggcagatcattctatctaaggggtagagcctcagactacatgtggtggaaggttaatcaacatagagtcaagagttgccaacaggtaggcagtgaacagggataggagccaggggcagctgatgcttggagaagggtaggcaggcagcattagaaagagcctccatcaccagattccatttcatggccaggaattgagcatctaggaggtcaaggcaattaccgagttctgaaagaactaagttactacaaggtttgtggtaaggtagggtaagtctagaataaagcttggatccaattactgaaacccaagtactaacttcagtgcactgagctaaaacttaaaccacctcttgctaagatcaggtttgaggcagaatgtgtagtcaaatgaccaaagccatcaagagagaagaccagagccaagaactggtcaggctgtgatccacgataccaaatgcaaagggttgctatgaatgtccaaagagatcatgcacaaaaagctgctttgaaagaaaacaccaccattaaaaacaaggatttggtggggtgcagtggcctgtaatcccagcactttgggaggcagaggtgggcggatcgcttgaggtcaggagtttgagaccagcctggccaataaggtgaaacccccgtctctagtaaaaatatgaaaattagagggcatagtggtgtgcacctgtagtcccagctacccgtgggggccgggagggtgggcgtggtgctgaggtatgagaatcacttgaactcaagaggcagaagtcacagtgagcagcgccactgcactccaaactggggtacagtgagactctgtctcaaaaaggggaggaaaaaaaaaggaaaggttttttttttttttttttttttgagacagagtctcgctctgtcgcccaggctggagtgcagtggcgcgatctcgactcactgcaagctctgccttccgggttcacgccattctcctgcctcagcctcccga

SEQ ID NO: 58482 - DNA, 1990 bp, Homo sapiens
ataggtagtaagggacagaagtttatgattcattgtgagcagcctcccaaggctcaggaaagctgcctgggactgatagtttcctccacacatgcccagtcgcaccacagctgagggatccagaaagttagcatgccctgggttatataccttagtggtgaaagaacttgctgtgctaaagagttgaagggcatcctgtttctaggggggactaggacaatgccaaagccatttcagccagttcctctctctgtacattctttctccacttatccttgagcactacaggtgagaaaacgtggagaacggttctgcaattttcaatctctttttttcttggtatttctgtatttaaatataattttatgcttctcaaaattagaaagagctttcccactgctatcacctcattttagagctacagctaaataatgtcacattgtttctcatgtcagaaacctttggttagcaccagaaagttcaatatagcttttccaaattgaaagtctgttggactgggcacggtggctcacgcctgtaatcccagcactttaggaggccgaggtgagcagatcatgaggtcaggagatcgagaccatcttggctaacacagtgaaaccccgtctctattaaaaacacaaaaaaattagcccggcgtggtggcgggcgcctgtagtcccagccactcgggaggctgaggcgggagaatggcgtgaacctgggaagcggagcttgcagtgagccgagatcaggccactgcactccagcctgggcaacagagcaagtctctgtctcaaaaaaaaaaaaaaaaaaaaaaagtctgttgaaaacatgcactaagcgatgcctaatactaagtgatacgtcatttttgaaaagatcttgctgttttaacacatttttatgcttatgattagtctttattgctgtaagaatccatgcaacaaacttgatcatttgtggcagctttattcaattgtttagattcaaagccttttcttacggatatggcaccgtttttttgaaggaggagggtttgaatttgccatgttttcttatatgatttttgtcctttactgttatgaagcacaaaagccaaattatttagtagtctgacatgtagtttgaaatcaagtaaaaacatttttattgctgacattattaaattgtacttaattttttaaagtgtcttttagaaacatctttaatttactttcacttagttgctaaacacattatatttttcactttttatctacttaatgtcaaatgatttgataatccatggattctatgtgacataatttcttaggttgtctattaatagtgagaagaaagaaactttttttcctgtcattttgcctgattagcactacaaggagtcttctaaaatgaaaaaaaaagtgacaatagatttaatcagagaaacaaaacagatctcatcacattcatgtcagccctcttccatcaagttagaaagaacattcctatttacattaatacagaacacgtttgtttttatatgatacagatcactgtattttgttgcagatgtaacagatagagttacagctgctctttatttgaccatctaaagatccaaagatgtttaaggattcagtttgctcagtcttccccatactgtcatttgttgtttggaaaggagacataatttgcaacagatacaaaactatttgtcattttgcaggtttgccaaaaataaatgaaactattaattatgacatttttgagcagctgttaataaattaggatagggtaactgttcattagagtaccgcttaatgacatgggctatatttgtttaatgctgcttttcctagaaatgtattaacaaaattaagtatatcaacaatagcaagtgatgctttattttaatggtttaagttgtctatcctaccttagtaaatttaggattttaaaacaaattctcttttgtcatatttcaaagcaaattctatcactcgacatt

SEQ ID NO: 58483 - DNA, 1352 bp, Homo sapiens
gggattttgagttctttgtttgaactgttgtaacacaagcctcaggaatagtgttcaagtatctgtcttttatcttagaattagaaaacataattaactattaactattattattaatttaatgtagaggtagagatttcatcatcttacttctagctatctgtgtcacaaatgttggtttgtatatatattttttaaaaggcactagacttagaaatgccaaagtaattaattttctttattttcagaaacaatttagtgttcatggtacgaagtgtttctaaattgaaacactttcagattaatggatttaagataactggttgctcttttctataagtagtaataatgagatatggcttcagctacatatcagataccagatctcacttcctgttcctttatttcattcatccattcattcagcaaatatttgctgagcactaaaatgctccagacacagtgcatgaaccctgaagatataggcaaattgcataacccaagcaaagggccagagatgagcaacagcatggtacataccccaaactaagaacttcactatggctaggatatataatttagaagaaagaaggttaggttggggtaggaggaagcataataaattatgaatttagagatgtaatcaaattatgaagggtcatgaaagccttgtacaagattttgagtttgatctccatagagtcatataattagattaattttagaaagctcatagtgtctgcagtgtggagagtagattagaaggaagcaggcctggaagcagggagatcatttgggagacttttccaggacagagaaaatggtggtctaaactgggatggttgcaagggggatgaaaagaagtagatatttaagagaaaatttaagaatacttatttagttcagacgttcctgaaagaatgagcctaaccatattcttgatcatctaaggaaggtctattccttctcaaggacagctaagtaaactaataattgattctaagtgatgtaattgaacagttcaaagcagttattcgtcattagaaattattgatactggtcagataatacctactgagagctagtcccattaattttcatcataattataatcatagcatttaagccatattatttctcagcatttcctatgttccagttttatagcactgaatattttaaatggtttatattacttaatactcacagtagctttacaggtagatattattgttatttccattttacaggtggagaccaaggcttagagaagttaagtactttgcctaaagttacacaggttgtaaatggtaaagctattattggaacctagtgactttttagttactggc

SEQ ID NO: 58484 - DNA, 1100 bp, Homo sapiens
aaaatgaaattatgcctctgactccaaaaacagaaacttatctctaacaataaaaatccatattataagttgcaatagctctttccttctgaaaagtacatttttaggagacctcagttaagaatcttgaggttgattttgtccttttgtctacatataatattaattgacttcccatgaaatcctatacatttctgctacctgtagttcaacactgtgggtgagaaaagggggaattaaggaacagtgagaaggaattagtgtggaactctgcatctgcagagattttggttttaaaacctctttcctaaaggtttattttccagtcattcttaaaaaaaaaattatttctactccacagggttaccaaccacaactgctctactgtacttgaaagagcactgtactgagggctcaataggtgataactattcttgttatcagcagtgctgcggtgaggattaaatgaaataatatgccacgcttagttcctagacctctctaaactgcgtctatgtcctagggggagaactgaatttggaaaccacattcaacccttatgaattgtgaggacaggcaatctgcctgtgtctctgagcctagccattctttacagttgatcagttttaaactcttctgtgctccctactcccagatttttctaccactgttagtctctccatgaagcccgtgtggaaccttggctccagtgtaaatacacataaataaatacccattctctttcagagcatttttttcttcctctgcctttgcataaacttgactctgactttcaaggatgctacttcctgtgtttccttgtttgctcatttttcactaaaaagttattaagcaacttttattttccatgtattatgctggattctggcaacaccaaaaagaaagaaagaaaagaaaaagaaaaccaacccttccattatgcccccaaaacatgatagtacttgaaggaaatgaaggggaagtatatggttaaaaatacaagatatggaatcagacagactgaattcaaattctgattccagtacttgctagctgtgtgagcttgaatggtgacaggactatttcataaaatcgttgta

SEQ ID NO: 58485 - DNA, 1270 bp, Homo sapiens
ttcctttctttttccaatcacttatgagatacttgcttttaaatagagataaatatgatttattaatcgattgtgcaattgatatattttacttttatttcagtttgaagtagaggatatttacctgaggaattgtatgtaaatcaaacttattttaaatgcacatgggtaactcattataatcctatgatgaattcctttataaagcaaatactcaccccttattttatcttttgtgtaaatatcgagtttgcttaaagcaagatttgcctggattaaaggttattttcattgggaatacttttacactttgaaatttagcatctattgctttatagtgaaagtgtctttaactctagactgagataaataagaaatacagatcgattcctcctctgatttattgtgattcccatgggtgagtcatttagcttacgtgtcttaagtttatttatagaataaatataatacagtaacagtcctttcttatatatttttacaaggtgcttaggtgtaaaatacagaaatattattaaactaggtatgaaacatttcaaaatgatgataatgatgacatactttatattgtacactgtattttattttttcagataattttcatatgcaccactgtttttagtatttttactacctctctcaagtagtcatagcaggtattagaccccattttataaataatttgacttttctaaagttacacactacacatcgctcaaccaaaagtcaattaaaaagacaaatgtattaagcctctattaattgttggttaacatgctaaacctgttagggtataagtaatgccctttagcacttgtttctttatagacatttagaaattaaaaggtaattattgcatgttaaaacttatggaataaaagtttacatattactatattccactgtactgttaggggaagaaaattaatatttattttaaacaccatctgccaatttattagtgttgttttaagtcttacaaatactgagagtggttaattttattttatgcatgaggaagaaactgagactcagaaaataaaataatttgtcagaattcacctaaccagtaagttccagagcctgtatccaagcttaggtctttctgatttagtaaccacatcaggctgaacttcctgaatttacattagcagtttaatacaagaaataaagtttagcagggcctcttgagcataattttagagttgactttttgttacatacaacatgttattgagtgaggaataccgtt

SEQ ID NO: 58486 - DNA, 1050 bp, Homo sapiens
gtttagtagttgtttaatctttatatagttttatgttttaagtctgcaacatattagctagtagggttgatattgtgcaattcattagaatcttccatgtagcacctgagtgctggacatatgaagtagttgttcactatctcctctcttattagtgaattcctggtccaccaaatgacttgttgttttctaggactaaatgtagaatttaatagatataattggcttcattattattaaaattagggattgagcttggtgtacataataaagtatccaaataatggtggctcgaacaagagagggttttgttttgttttgttttgttttgtttgtttccctcctgacatagaaaggcacgtagtggcttggttatccagataaaagatgccatggtggaaacctttgattcttttggtctttaactcctagtcaaaaaaaaaaaaaaaatggatgttattggccgtatcccaggcaccatgaagtacaaagaagggcacaaggcacatgccaactgagtcagtcacttaaagaactttccttagaagcttcacctggtgactatacatacctcttattgtccagaactcacctcacaggaagtgagttatctctggctacctgaccgactttataaaccagtgctttccaacctttttgacaccagagactggtttcctggaagacaatttttccacagactgggggtagggggatggtttggggatgattcaagcacattacatttatcatgcactgtatttctattattaatgcattgtaatacataatgaaataattatatcattattacattgtaatacataatgaaataattatatcattattacattgtaatacataatgaaataattctacaactcaccataatgtagaggtagtgggagcactcagcttgttttcctgaaactaaacagtcccatctggggctgatggggacacagtgacagatcatcaggcattagattctcataaggaacacacaaccttgatgccttgcaggcacaattcacaattgggatcacactc

SEQ ID NO: 58487 - DNA, 1376 bp, Homo sapiens
atagtagtgagaggatagttaggagagacagggttttagaaagagaatacctgttgtcagtgcaaagcacttataatctttataatatataattataacctttatatattataaagccttataatctttcctatctcatacttaagataattaatttcaatgtagcaaacatatattgaacacctaccatgtgccacacactgtcttaagtagcccagatacgaagtttattaattgaaacagactgtattgtcaagggatttgctacctagcagggtagacatgtgcttaatataatacggtaaagtgcgttattaatggaatgaacaaaaagctgacgaaattcagagagacggaataaaccgaaaaggactccttttctttgatttctaatctgtatgaaaatgatctaagaactcaacatagaatcaccaaatgtttttgatgcaaaggattttagagaaaatactgaatttttttaacagattcaaaaatctaggtccaatgacttaaagtgacttatcaaagctcatatgtctgtttgtttggctggtttgtttgttttgttttgtttgagatggagtctcgctctgtcacccaggctggagtgcagtggcacgatctcggctcactgcaccctccgccggttcaagcgattctcctgcctcagcctcccgagtagctgggattacaggtatgcaccaccacgcccggctaatttttgtattttttcagtagagacgggttttcaccatgttggtcaggctggtctcaaactcctgacctcatgatccgtctgcctcggcctcccaaaaagtgttgggattacgggcatgagccaccgcgcctggccatacatctgtttttttaagaatatagttattgattacagatttagtgtacttgtagaggttaccatctaggtaaaacctttctaattactagaaagcaagcaattaagttcagaattatatagtattcaccttaattgcgatgggatttccaaaaaattagaaataggctaatagaaatggagaatacactatagaagaaatcagcaaattatttggataaatggagagtatcagtttgaatgaaagaaaaataaaataagaagcaaaagaatggcagtttctggcacaaaagtcttgataaaatattcagtgcatgtatgcctcttgtttgccagagtgttgtacttataattttttctatgtattttctctttttaatccttacagaaaatctatgaaatcagaattagaatcaatttatggctgagattattgaggcacagagtgagttaattaacatagctaggttgcatagtaaaagagattgcttcatctgactacaaagcactcattctttcttcc

SEQ ID NO: 58488 - DNA, 1038 bp, Homo sapiens
catctgcttttagataagcagagggtataagaaagtgatttgataaagggggcagtgatgggagtcagcacaaggcatcagcatgaatctatccctaaatgcccatgctgtttgacagtatagcattcataacagtgtgaaaaattaggacccaacactgttaagtgtgacgatgatggacataacttggcccatagtaacccaaagagtctattggtgtatatatttaaaaaagcgtacattgtggattaggatttatgcccatcttaacattaaggttcagctcttctgctcttcatggtgattaaccttccaacccaagccacagtcagaatggagaggccagggtgttacccatttgctaagtttcaatgggcagactggaaacgattacagtagacccttgatatttgcaagagatttgtcctgagaccttcatgtatctgcaaatgggaaaatgtaattacatattattttccccataaaatctggtgaagtatagctaaaaaccattttgacccttcagactattaaggtttctataaacacaagagtaaattatttataaagttgttaaagaaaattctgccaataaaataaactccatagcacataacatcattttagtgacattaactgaaatttacagaatctgcaaatcttaaacaagattgatgtaatgacatttaggtgtacaaaggtgtattgaaatgtgaatgctcagctaacttgtcatgaacctgcttcatgtatgtgagtcacatcattagaactgccacaaaagcatgaacgaatatatcatgccttttggatctcttgaatatttctcttgtaaaatttcttgggttcaaactttatttttttaaatggatgtagattttttagttgatacctacaggaatctatctaagttagaatcaatttgttttttgatggaaaggtagggctgagagaatagttttgtacttatttcatctttatacaatctaaaaataaaggatcctggtaaggaggaggtaaagtctgtgtaattaaaaa

SEQ ID NO: 58489 - DNA, 1057 bp, Homo sapiens
ttcaaatcagtactcagcactgagcaggtaggtttctgtaagcatttggcgaataaatgaataataatgatcttttattgggcacttactatgtggtaggtctttggttaagaatgtacatactttatcctcatcatgccctataaaaattagatattattaatcatagaggaacctgagcttacagaaacctaccatgtgtcacagctaacaagtggtgaacccttgtctttctgctatagaacccagagtctcatcactaaatcatgctgcctcaaagtcttatattctgtgggataaaatagaaaaatatatagtatttaggaagtgtagatattggtatttaggaaaataggaaactaaaaatggtgaatagacagttattccttacagagttctcccgttaaagaactaatgagaaggaaatgaagtatgattttgtttgtatataatttaaagcaattgtcatccaagtatggtgtttgcacccaactaagagcaaatctaaatgtgaacctaaattcactgaaaatttttagtcttaggcttttctttttttctaattcctatgactttgcataagacctgttagtttatggattgatttgctgattaggaagtctttctatgttttgatagtctttcattcatttaactaaattggtcaattcttcgttttttctcatacatggttcttagtagatatatcttaccaaggaatatgagttatcagcaaatgcttgttgaatgagtgaatgaatgaatgacaagagtctctaagtatttcattacttttgaatggtcttctgtgagatgtaattcagataaaatgggccatttgtttgtgtcataagggcaaagatggagaggtaagaagatactacatcaaataaacttttctcatgggatactaatctttctatacacagtagcaggaatatcttaaatgtttctggagcattttcattgcaaagcagtatttgccatcttcatttcccaaatattagctacaacagacaatcctgacataacagatatatggaacatgagggagaag

SEQ ID NO: 58490 - DNA, 1117 bp, Homo sapiens
tgatcacttcatgctgtgggaccatatggctttacactgtttggttctctcttggttgttcaatgtaacatttctaccctgtttggaagcttttggttacttttcagttatgtaaaaatgccattgtatttcacaaaactgagctaatgatattttccattgttgacaaatgatttctcaaatgagaaaataattttaatgcaacttgactcacaatcgaaaccttgaatcatgtgaggcttttgtgttgaataagaatgcatttattgttcctttatacaacttaccacttttaattttcaaaacaataatgtagactatacaaaaaattgtgttggaactttaattttttcttaaaatattacttaatgttccctaaatactttgctattgttaatatatctagtatacatattcttacaattacaataatgatatacctgtgacagttctgtcaaaattgaacattgtttgacttaaagccatattcacatgatccttcaacattttagtcctgtgatgaaattaatcaataaaatgtgatgattggatttattgttctcccttagatgtataccaaattttttaaagtgcagaatagagtctgttgagtattcatttatgaagcccctataattacgtattttgtgattatgaggttcttaaaatgaaatattgcaaatttagctactgataggtagctgattttcctggtgattaaccacagacatcttgaatagagattataaactaagcaaccccttagtttttttattactttttttctgttgattttctgtcttttaagggaaatgatcgtataactattttttaacattctagatttggtgtttccccttaagaaaaatgaacttgttaataataatgaaactctgagtacttttgcttttgattaatgattttcccattattatcacttaaatatgtaatttagataaaccaataattatataattcaaattcacactcctgagatgattaaaaggtaagacttctgaggttttcatctctccaaaatgcaggttcacttccagggttcaggccaactgacatgccatcattcattttgtctttccttcataatgaatctttaagc

SEQ ID NO: 58491 - DNA, 1091 bp, Homo sapiens
ccattatataaatttagtatcattttaaattcaagattgatgaaattacatgaaaatgctttgaaaaagtcagggggttaaaaaaattaatggtttgaaaatcgtaagatgtggatcatgattcagaagcgttttacagattaacttgtgtcttcagcttattaacttgttaaatggcaataaagtttacttctgcttattttacggtatgatggtcatgtactgaaaagttttaggaattcaaaatttcatcttatgaaagatacattaatgggcagtatagtatcggtgcagggatagaaaaataaacaagtggaacagaacaaggagtccaaagcaaaagcactcaaatagtgtcatctgacatatgacaaaggtaatattatagatcagtgggaaaaggatagactttttaatcaaggatgaagagataatcagttatccatgtagggtgaaatgaagttggaatctctatctgatagcacatacaaaaattgattccaagtgggtttaatacagaaatgtgctacaacatttttgaacaaatatcggagaacaactctatgacctcaaggcaaagaatttttaagtagaacaaaaaagtttatagaggaaaagactgttaaattaaaccacattaaaatgaacggaatttttttttttttttttttttttgagatggggtttcactcttgttgcccaggctggagtacagtggtgtgtgatctcaccttactgcaacctccacctcctgggtttaagcagtattcctgcccaagctacctgaatagctgggattgcaggcacccgccaccacgcccagccaatttttgtatttttagtagagacggggtttcaccacgttagccaggctggtctgaaactcctgacctcaggtgatccacccgccttggcctcccaaagtgctgggattacaggcgtgaaccaccgcacccggccaacttgacatttttaaaagatgtaaagagagagaaacagcacacacataccgagccacagactgggagtggctttttcaaatgaaaaataaacacttagcagaaagatgagcgaaagtaaagaacgaatat

SEQ ID NO: 58492 - DNA, 1034 bp, Homo sapiens
caatttacacaaacttatgttgaggtcagttttcctttcctctagaacagttagagaaagagagagtgtgtgtatgttaaaataaatgccagtttaatgtccctattacatttcttctttttagttgaaggctggatttcagcctgtcaagactttcttttgaatcttgattttgtcacctaacacggtctgatataattaaacttgagaagtatacattctatttcttcattctgagactttgaagcgggattgattaaactgaaggagccaagaatagcacctggtaggctgccattggaaacatctttacagatttattccaattcattaatcagttttctttgcctaagtttgcttaaatctctattgtttcacctaactaaactcttggctagccatagtttactttcactgttgcaaataataccattaaagactgtcagatacgcttttgaagttctaatacatgacatttcttaccatcatcctttcaggatagtaaccttttcagtaaaattaaatgacactttttccagaatttattcttagtgaacctatgccagctctcagtgattaatcgtctctgttcctaggtcttcataaactgtttaataatatgatgcagaattctaccttcactcgccatcgctttgttggttattagtttgttggtgtcttgaaattttatagctacaaaggaaatataattccaggattatatttgaattatccctgaatatctacatgaacctagaaatttgaactaattaaaaaaaatgttctctgtcttgggccgcaagatacttatagaaagatttatagtaaaagcagcatttgagttgggaaagaaaacaggaacaaacacgaatatcccttttaaatacatattttggggccaggtgtggtggctcaggcctgtaatcccagcactttgggaggccgaggcgggcggatcacttgcggtcaggaattcaagaccagcctggtcaacatggtgaaaccccatctctactaaaaatacaaaaaattag

SEQ ID NO: 58493 - DNA, 1108 bp, Homo sapiens
acctggcctaaacttctaatatttcacactgttctcttgggaagcactccagagctgggcagacctaggttttcacatgtgtgcacattcacctattcacaaggacatactctcttacgtacatcccagtgagaagttgggggaggtgggactcagcaactctggctttgccttgcatcgtatattggaatgagcattgatctttggagtcaacatgagacacagtttcaccatgcaactaattagctatagaaaccgtctaaatccttaacctcttttagcttcaacttctctgtcatcttgcctttgtcttccaacttgtcttttattaagggccttttcttgtaaggtcttgtgctaggcattaaagtttatttctagtttatctgtaaaatggaagttttgaaatcaatagtttttaagatgcttactaaccttattaacctgaggaccaatgaaaacatataaagggtaagaacaagagacacagaccgtgaggctagaaatcctttccaccaagtgtagagcggagatgcttaaatttaatctcccagcggatcttggggctggtgggagtggatcttgttaaaatgtcaattctgatttaataagtcgtgggaggaacttgagattctgcctttctttttttttttttttttttttgagacggagtctcgctctgtcgcccaggctggactgcggactgcagtggcgcaatctcggctcactgcaagctccgcttcccgggttcaacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggagattctgcctttctaatgggctcccagaagatgctgatgatgctggcctgggacccactcttagtaagtagcaaagcttgagaagatagttggggaaaggaaagattttaaaggaggaggatgataaaagtgaaaggattgagattaccgaaggtaatgctgtacactaattataa

SEQ ID NO: 58494 - DNA, 1059 bp, Homo sapiens
ctattatataaattttaaaaatgaaagtgagaagccatctactttcccaccaatttaataaaaatgtgtttgaaatcaacgtgttttgaggcttggtgttaagcctatactttttgagttataccaattaaaattctaaagtagaaagtgacattaactaatttgactcaaactggtaacttattggcaaattgatgtagttgctataatacaagatgccatatgattaagttagcagttaaaaaatataacttgtgtagccagaatagacggagtagaattaattatttgggctacgtacatggcaaggaaaagatacattttctaaggcaaagatcagaaattaattccaagtctttcttgttcatcaaaaaatagttctttctttaagttgtgaacttgttcattttttttgatatacgaagtctttaatataaaatatattactcatttggacttgccaaattaatttctacattaacaaattataggttttaatacatttagctagctgtaaaaactttaaaaataatctgacttatgtgtacttcctgattgtttttcccatcacattaaatataaaagtaaatcagatcatgtttctttaaataaaaaatgataaactaaaatgcttatgcctttcttttaaaatactgataatagatttcggtgatttcttctagttatcttatagaattggttaatacagagttcatgtattgctaaggtttagggttttctctattactgtcaatagtgtagactaacaataactgtaatgtcacagttgtcacctttgcatggttagaactcagttttttgaaggacaacagttttatcatactcacctttcaaaagaggaagttatgatttggacagaataagtaactcacataataagatattagccagggtttagttatttctggtccttttgtctgtctccttcatctgtcttgctaatctttctagctgaatgtgaattcatcctagagacagaaattttgtcaatgcttttaactaggcttttaggaattaccagggaaattttactatttt

SEQ ID NO: 58495 - DNA, 1076 bp, Homo sapiens
ccagtaggaagtccttccctatgcccagtcccttccatactcatctgtacaaatagagcttctgtgactttaaccttgctttttacacttcgaaaaaatggcggagagattctaaatcatacctatattttcattcgtttggcagtataatatttcattatagaatattattatttttcatatcagcttttgtgttaaactaatataaaagggcagaaatatttgattactattcattataatagctaacatttattgagttcttattaattgccaggtgttattctaatctttttatgtatatcaaatcatttaatgttcacaaaaagcctaattaggtcaatattatctcctctccatcttatagaccaggaaactgagggacaaatgccttaaatgacttgttcaaggtcacaggattttaacgctaccctgtggccaatttcccaaggacttaaccatcaagctatacagaattccttgtaagggtaaaatatatatttccaattaattttttaaaaattggatagacctaattgcctactaaaataatatatctcagccagatattttggtcaatttaatgaatatactgggcaagtcattattctgagtttggtttatgaaattaaatcttttgaactgtaagtgtgttttatttttcaatgttatcatttttcataatgtaaagatactcttcatccttccttctatcaattctttcttctaccacttcaccccacttaatgttttctctcctattctttggtatcttttgatttaagttatgttaaaaggtccttactgtgacatgtaggttttttctttctcaagtttattaaaaagtaaattattctgttacctgtcagttttcttttttatatatatattttaaaggttagtgacaacagtaaatatttgaataacacttaatgttttctaaggagcacgtttataggatccattttatgggttcacaaacagattttcaaagagttacctacattaagaaggatcggccgggtgcggtggctcatgcttgtaatcccagcactttgggaggctgagatgcgtgg

SEQ ID NO: 58496 - DNA, 1666 bp, Homo sapiens
tccatacaattctgaacttgcaggagtgtttatctttaagtgacatgtaactatgtagtaacatttaatggtatctacttggtttttttgaggtgttttagatttgaatcgattttgaagtattcaatctagaaactgttctttaaaaactaaatgtttattacttagatttcatctcattttatctcatttacatatatccttaataaattcttctaatttttcaattcacaaaaatactttataaaaattcacaaaagtattttatatcatttgtcagatgaataaataagtatatgttacatttgactcagaaacttgatgtcttgcctaattgtgttttcaactataaagtttttggttcagctgtaagcacatgtcatgaagacttaggatgtcttcattgttcaaggggctggggatacaaaatttgtcctcaagtaccttacagtttggtaactgaaaattaattgagaaaaggggagcaaagaaagagacctaacatttgttaagggaagcattgatcctaagtgggttttggtccttcagtgtaacatttggtttcatgtgttatctttgtctgcctccactcttgccacatctagacaagtctgagccttatttctttatctgtcatagcagccccttcttttcaatttcatctgtcactaccctggtgtagtatctcatagccttacatttttatagcctcctccctggtctgtcttttgattttcctgcctgtaatccatatcacacataactgcaagtaaacatttctaaagtgtggttatgctcatgtcactcctgtgccaagaaatagtttccattaccgtcttaataaaattcggatttgttcttttctattttcactcttcacctatgacctataatacttcactcctttccagatggtgttatgttctcagtgcccccactctttctccagccttctcatattcaaccatatccgtgtattttacacctctgttcacaacagtgtatccctcacttcttcctgctagattcgtgtccttcaggtatcagttcaattctgtacctttttttcaaaaccttccccaactcttcacacttttgaggtcactctgttatctgaaatggcattatatcttctgtctctgccactcattaattaattcacagataacctagtattttatactgttaaccatctgcttactttaactatgtctacccaatgatgggagtcctgttagcacatacagtagctccaacgatgggagctattagcacattgtatgtgtttaatatttttttaggctggaagcagtggctcacgcctgtaatcccagcactttgggaggctgaggcaggtggatcacgagatcaggagtttgagacgagcctggccaacatggtgaaaccccatctctactaaaaatacaaaaaattagccgggtgtggtggcaggtacctgtggcaggcacctgtaatcccagctacttgggaggctgaggcaggagaattgcttgaacccaggaggcagaggttgcagtgaaccaagactgcgccactgcactccatccagcctgggcaacagagcgagactctgtctcaaaaaaaaaaaaattttttttaatgttgatggttatttaccgggtatgaccttatggttttttgtttt

SEQ ID NO: 58497 - DNA, 1016 bp, Homo sapiens
ggaggcagaagcaggagaatcacttaaactcaggaagtggaggttgcagtgagcggagatcatgccactggactccagtctgggcaacagagtgagactccatctcaaaaaaagtaaaaataaataaataaataaataaattctctattttgatgtcatttacaactgtagattcgatatcataaaaatttaatatccatagttatttgaaaatatgacttgaataatttttcattcagttctattaaatgatgtctgtcttgatatttttattgtattatgctttattaaaagagcagatatttacaaatttaaatagtgccaatacagtagtatatttgttcatttaattaacagtattttaatgtgtattatattctccatatttagtcttgaaaaccctttaggaaaaactatataaacaggtgttcaatcttggtattttaatgttaccaaaattgacaacatatttttccatatatttaaaatattggttcttgcttctctgataacttagtcttcgaattggcttgacttcatagacttcattgtcatttgggtttgtgatgcttcagaaatatggaaccttgcaaagtgaatgttagtattttggtaattagacacaatgatgcttacttactatgtgccagacacttttctacaggctatttatatatattttttcattaatcttattaacatatctataatatacattaatgtttacaacttaaacagtttattacatgttcttcctttgacaagccaaaattaatacgatttggaagttatatttctgtcatgttgctaatattaataaatataaataaattctcttcataaagtagtcttcatttcttggtcacaaaatgcctggttacaaagtgtgagttatttttgaaatactcacaagcattctttgtatcttgaatggcaagcacaatcaagatgtgtgccataataaaaatgataatgaaatgttttactgcttctatcagattaatcactggaaccca

SEQ ID NO: 58498 - DNA, 1338 bp, Homo sapiens
ccttgttttgtttatgtttgtgtttagagacatttaatatatattgttgacttactaacatcgaactcatggccaatagcactataacttacggctgaacaaagcttatcaagtcttttctctataaggcacatcccagccttcttgcacttaggagcactagacggcatttctcagcactatacaaggggctatttaaaacagaataatcacccacaaaaagcacaacaattcaaaaaaaaatctggtactaatttagactacaaaagggacatatgtttacagtatgatagtttaaacgagtaggaagaaagtcacctgactgacctctggtaggaatgcacgtgtatgtcgggcaactcaacatttttcactgctctgtacatgttactgaatgactacaaaagtcagaaattgtgagtattgattttggggttaacaaataaattttagcaggcaggccgacttaaaaatatggaatccacaatgggaacgagattgactgtatttagttttatagagagcaaagtgatattgcagaaaatttatagattttgaagtcagacctttgtgaatccacactctgattcttctttttagttgtagttagattttgaacctccttccctccttttgtttaataccaacaatacttacttttgcataagtgtcgtcaggtttttaaatgagattgtgtatgcataatgggcccagcaccatctctggtgcataatatatattaaataaatgattgttactattattagatatattaaacacaatagctgggacttagagaacatttgtatcatgagtcaaagtgcagaattgtggaccttaaacttttctggtatttctttttttttgagatgggtcttgctctgttgcccaggctggagtgcagtggcacaatcaaggctcactgcagccgtgacctcccaggctcaagcaatgctcccaccccagcctcctgagtagcagggtctacaggcgtgcaccaacatgtctggctaatttttatatttttagtagagatggggttttgccatgttgtccaggctggtatcaaactcctgggctcaagcctctcagagtgttgggattacaggcgtgaagcaccgcaactggcttgttcatattttatataaaatttgcctttacatttaatatttaaagcactttatatggcattcttttatgtttcttttatacctcttttatatttgaactggcctctttctttaatatggtctgtgaatcatagtttcaaataaattttaggttgacagccactccactaaatctcaaaacttaattgcaaactgagaaactgctcta

SEQ ID NO: 58499 - DNA, 1030 bp, Homo sapiens
aactggggggaaaatgtaatgtttctattgatggtataatttagacactataataagttcagccatttgagttcttcaaaatggttatattaaaatgatatttttattaagcttcaataatgaaaaacaatgtgatttaatatgtgtatttttatattattgtatggattaattgttaattcagcatttaatggctaacttaaatatgattggaaaagaaacttcaagttgccattgcttttacctaaagtttttaaagtctgaaagatttcagcaaatgcattaaacaggaatgtgtgacatcttcttttagattgcttgtctaatttggagagattaaaaatggtaaaatgcaactttgagtctctttacctttgcatatttaaaggtacaatagtgtggtgttggtaattgtaagtaagcttttctgtgctatgtctttggagtgaaaattcatgttttttttctgaattacataaatgcttttgttttattttgtataatgactgtcttttagatctgaataagtcactttaaaaccttggcctatgaactttgccttatcaatcatgaatctagatgaatgctatctagttcttggttcagttttacctatttttatttttggttcactgcttgcttgagcatagctgggatttgtagcccattttctaggcttattgcaatctcactgtggtattttatagaagctattacaactgataggctagcttcatggtattgatgatacatggcttaaccatactaaaagctgctttccctctctaaattgtaaaaaggtgatgaagtttcacttgatggagacatactatatatgtgtgtttatcatggaactagtgcattaggccataagctgtttttctggtctatgttttttgtatttaaaactttactgaagacaatggactccttcgggttttctttctttcaaccctgaattgtccttgtttgaatttttaagtactgtaatttttttttttcaataaaatctctgacttgggcaagaaag

SEQ ID NO: 58500 - DNA, 1626 bp, Homo sapiens
caggtatgtcccatgcagtacttagacatatttccaccaaaaatttagtgcaagtatataatacttatattaaaagttagtcattgatctcaaattcaaatttaactgccatcttgtatttttattacctgacaagactaattgtgtaactggatgataaaactgagtctttggtgggggggggtttcttgtatttgcacaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtcagtagcactggctccctggtagatataatgggtttaaggtcagtctaggaatattcattcaaggaggataagataaagtggaaattagagaatgtaaacacaagatgctgtaaagaaacatattggccactaatatagctactacatttatcatgctttcaaattattagaaaaattgacttgctttcttgctaggctcattgagaaaatgttgaaatgataagaatgttaattcggaaaaaagaaaatgggtatttattactctagtgattgaacactggttagttaagtgctgactgccttagtactttgctaggcattgcttcagtttttttaagtgtgagttttgcattttcccaaataatattcgtggcattcaccgccaccaccaacttacttttctttctctattgataggatcctcttcttcttctatgcttcagtgatcatagaaaacttctaaattgagtactttgattttacaggtttccaagctagactcagtcgccttcatggaatgtcttcaaagaatattaaaaaatctggagggactccaacttcaatggtaggcatactttttctgtgtaattgtcatgtttggaaatgtttccatttctatggaataaaaagccacatcctcatcctttattcatattctaatgttaaacttaaaaataatccatttttttgtaggctacaaactggaccagtgagattcccctataaaccaaatcttctaatgctaataaattagttacgttttgaacatctggggaatgacattcgagggaacctggctcctgtcctcttccctggaggaatatcattgaagtgagagcctctttgatgaaaagatggggctgtttttgctggaggactggtattcttccttttagtcagaagtgaacctgactggggaggctttctagggatttaggttggcccagggtggatagaaactactgtaaattatatatttttctcttttatggttttttttttacattgaatccatttatgtatacttgctttgccaaaatgctaacaaagctagaaaattttaaacttccagatcgacaagtattccttaatgtttatattgtgactgattaagaattaatttttacatatctgactgttgtaaataaaaatcatgatgcattgacatttatggttcatttttagagaagtcttatataaccagcattatttaaaatatttgcattttactcagggta

SEQ ID NO: 58501 - DNA, 1092 bp, Homo sapiens
aaaaaagtaaaaaaaaactttgacaagcctgtcaatctttgataagtatggaaaggcttagaatgatatgccagcatttattgtgaacttactatgtttcacgttgctaagtgttttccttgcatttaagtttttaattaattcttaaaatccctttgagattcccaagtttttaaaatgaagaaactgactctaatagagttgaagtaactttcctgatgttacagacactagaattctaattggtctgtctgatttcagagcaagttcttaatcaatgactatttgatttccctattgaagaataaagttgtgtattacatcaaaaataaaataactttatttttctgtaatagtgttggaattcagatatatggtagtcagtttcaagtgaggccctgttttttcttatgcttaaacctgatctgtgtaattttaatgtaaagctcagtaaaagtcctgatatctaagtgctgttaattgtgtgttttgaaaaatttttttaattaattccccagtagaaacgagctgatgactctaatttttgaaatgcctttaattttccattgtgacttagttgaaatatagctatttctcataaaataattttcaactgaagcttaagagtatttttagttttcctttaaagatgtctgttgtaagagattttagaaatcagaaatatctttctgtaaagggaaaagtttatgacaattacaacgaccctcttagaaaccagaattagtggtggcttctcataatcaagggaaggagactttaatgaatcgcagatcatcttaaaaatgctgtttgtttctttctgtttttcttttcttttctctatcttttttttttaacacaaggtctcgccctgtggtccaggctggagggctggtggtgcaatcatagctcactgtaaccccaaactgctgggctcaagggatcctcctgcctcagactcccgagtagctaggactacaggtgcatgtcatcatgcccggctaatttttaatctttttgtagagacagggtctcgctttcttgcccaggttggtctggaactcctaacctcaaatgatcctcccactttgg

SEQ ID NO: 58502 - DNA, 1640 bp, Homo sapiens
gctcatgcctttactcccagcactttggtaggctgaggctggtggatcacctgaggtcaggagtttgagaccagccagaccagtatggtgaaaccccgtctctagcaaaaatagaaaaattagccgagtgtggtgatgtgcgccgagtcccagctactcaggaggctgaggcaggagaattgcttgaacctgggaggcggagattacagacatccaagatcgtgccactgcgacagagcaagactctatctcaaaaaaaaaaaaaaaaaaaagtttccagagggctttgaaaagtttatggtatctgtttttcttgcaagaaaattgtcattcttatatggaaataagtattatttgtattaggccattgtgacttaagaccattcaaccttacttgaaagtaattgtctgactcaattaccgggagggagagtatgtggcagctgatataacatactcaattctggattatttacaattagattacctgctttttggattcattgtgcaagctcccccccttttttttagttctccttttattgatctgcttttttataggacatgtaactggtaatggatatgagatcaaactctcatttttcatttcttttcattgtaaaaagtatttgagtatctactaggcatgaacaggctacctagcagtccacaaacagcccaggtacacgttttcagagtatgtttttactcttgaataaatgttaaaaaatatattttctctgatttgaaacttatttataaactattttctgttgtcacttaaaagttaggtgcaaattccttctgtgcaaagattgctaaatatttaaggtattttggtaacaagtataagcgttttcaagactacttccaaagctttcctactacaaaaagctttatatttccttggggttgatttataaataagagaaacttcagtgtggggggctgtgtgtgtgtgtcagatttaacaaacattgatgattaactacaatttactcttcactggtggcacctggactaataatggagactctgttctcaacagctgcatagtctgggatagccaggcaagcaaatgatgaaaatgaaatgtgctgagtggaaagtattagtgagggaagacttgctaagggaactgtgctttaaagcaagtagtaagacttgttcaggaattgaggaagtcaagagaagagagggaaatggcattcataggtagagagggagcagcttgtgcaaaggcatgaattgtgaaatgaaaatacatactttgtttttaccggcaataaagtgggatcagaattacagcaaaaagcatttctcagaggtctatctgctatggtaaatagtttggattttatcatcttatagtcaatgggatcagtgaagaatttttaacagtgaagaaactcaagttgatttacattttttcaagatagtgtgatctttatagctgtattttggtattttgtttatctttgacctccaatccatgcttaagtgggaagtgaattacgatatgatagcagagagaactaagtatttgagagtatttgagaccaattttaagagttagaatcgatgggaggttgactgactatttgggaggatgaatgagaaagaggactctacggaaaata

SEQ ID NO: 58503 - DNA, 1825 bp, Homo sapiens
ttcattgctcataagcttattctatcttggaagtaattcctatgtttaataaaagaacttatataagaagaggcctaaaatgaatcaatatttaaaactgtaatatcttggataggaaaattagctttgaaacattttgtaatcattaatttttgtcgaatttagaatgaattgtctgttatagaaaatgaggttactgtggttaagactgactattttcttttttctttctctaaaaaatgaaggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaaggtgacttttatattctctaaatataaaaatatttatctccagtgtttgtggttgaatgttttatattttaattaattctattttaaaataattataaattgtaataatgatagtgatattactgtttagctatggttatatttccttatactttatgatgtttagcacaaagcaaaattgcttgtttgatttacacaaagtcttttgattgtattataatgactcaattttcagctacaaggaggaaaggaaatggattttcagtggaaaagaatgtgcttttgaataacagcacgtttgtaactcagaattggatatataattatatgtttaattatagacctttagcttttggtactttatagagtgtcacaattcattaatctatcctgattcttgaacatcaaaagtttataccacttcgacatgtctgtggcttgacataaaaaatctggagctttctaggaattctgatcacttatgaattttaaaacccaatttatagtctagaaacacctggttttgtcattagaaaaataggaaaaacaatggtcctgtggtagtaaatctaatctgtcaataattgttaagtactattttgacagcatcaaaaggtaagtgatcatttttcttttatactgaaatgatgaagtgatgctacttgcaagaaatgagaatgtattaacactttttccttttaggcatgggtccgcaaaaccgaatgctgaactatgagccagaaaaaaacagtctgtaaatatggcctgagaaagagtaattgatttttaatttatagggctgctatctttttttttttttcgagatagagactcactctgtttcccaggctggagtgcaagggt

SEQ ID NO: 58504 - DNA, 1046 bp, Homo sapiens
aaaaagcaatagtcattgtaaaaatagttgactgtttatttctcggggaatctgtttttggggctttcttcactcttgctattcccacttatattaatatattgctaactgacatttaagagctcatgggccatcaatcaactcccagttcttagggtagattaagcaataagttaggactaaagcatcttcctgattcttcttccttgaaccagaaatatttgaaagaaaaacactaaactctgttttctacattgattggtcttattcttaaacggattccacttttaggaaggcctttttctgaatttattagagcctgaatttattagaatagatcaggaacccaaggataatagttcactcatttactgggtatttggtagaggaagcgaaacaaacaaacttgacctttggcctaacatttttaaataaagcttgcatatcaaatcttggattgatcatacattttatattgctcagcataatccaataccacccgaaaaaacaaagtactcatctgcccaaatcatttcctttcataaaatccaactttatgtagatgttggggccataattttgttttggggtattctgttcattcggactattttaataaaactattgatgaactattgttatcttagatattacccaatattaactgttcccagaagatttcatttccaaatgagttccaaatgaagaaaaatggctcttacaattatgaatataaaaatctcaaattagttaagtggtacattcactgaatttagtataattcaaactttaaaactggttgttcagtaagtacagatttgtatagaaaagtgctatatttccaggtttcccctttaataggaaattcttatttaagaaactatctctaggataaagtgttttaatacattggtcttctgatgcatcagtgtaaactgccaaggcaaaggaaataaaagagctgttggtcatgtgatggtctcttaggatcactttgtttttgatgggccagtaggagacaagagtctctctgcctcccgggctgg

SEQ ID NO: 58505 - DNA, 1035 bp, Homo sapiens
tttaaaggctcgcttgtcatacaactcaccatttcttatggcaccagagtataacaaagtggtagcacttagtatttttgaatgaaattctaaagtcattcctgttctgtcagaatgaatatgttccagaaaactggatctttattttctagtctatctgtatgactatctgtatgactatctggaatgtaaaaattccagatttcttaatggaattttcttcttcattaattgaacagatatttactatataagtatgtttgatcccagtaataaattccagtcccactgggaatactgctactaagcagttaattaggtgccaggttttacaaatatgtgtcatctcatgtaaatcttttgaggtaggtgtatcattctttgcattttagataaggtgacacagaagcaaagatggtttaagtaactggcctaagtatcatatttgcaggatgattccagtatacccccccaaaattcttaaccacttttatatgttgcctatgtgtctgaatgagatataatatctcaaggaatatgtaacctagcagttagatgcccaaatttgttaaccagtctggattttctgacttatttagctcccatcttgactttttcaacttctccagtgtggacgttgctgtttcaatttttaggcaccaaatgggtaaatgtggataatttctgtattcaactatggtattcttttttttttttttttaactttattatgtggctttgcttaaaaaaaagccattaaaataaactatattgactctggacttttgtttctgcattttcattcctattaggtattttgattttattgaaatccagaaaactgcatagtaaatggtgtgcatttttttgaattgcttgttttttggagtttgttagtcttgaacttagttgcatactggcaggtttgagtcaggtttttgtttcaacaattaagaatcaaagcaataaacagtatgattttgttcaagtaattcattaaatttgttatagcttcttagcatccatatttatgtc

SEQ ID NO: 58506 - DNA, 1009 bp, Homo sapiens
agtttacatctgagtcaataatgagcttgcttctatttagttccatcattaaatctaccccctgtcagggacagcggaggaaaactaggcctatccctgtaaatctgaaaggaagtgagagcaaaggatatttgcttcccataaataggctggctttcaagaggtgcggggaaggggctaaattaggttgaatcaactcctttcctgatgcacaaactgcaaacccactccttcttccttgacatactgaagggcagagagaagcccataaaaacatgaggaatgggaaatatgtacttcccactaactagatttgtagggttggcaaggaagcaaggttagaggagagttttagaatggtagaagcttgtacatgttcgtcagagctacttgagggagaaggcctgaaaatacagaagagaaaaaaataaccaaataaacatggaccccgaaaaggtgaaagaggatgcagtgaagatcattacgttgtaggcttaaacaagtggaagaagacctgaacttctgggtcaagaaggaataaaattaatgtaggatcatgtaaggatgcttttgtgggaaaggtcagatgttaaagtaattaatgtttgaatacctcaatattctggttgatcttccagagtaatccttacaagaatgagagagggtggaatgtttagtggtactgggggccagctagatttgaaatccacaaatagcagtctgcctggttatgtaatttattccagcagttatcaacaacctgatattgtaggcatgcagaatgatagtagtaataacagctaatatttattgaatgcttactgtgagccaagtactcttataagtgctttacataaattatttattttaatcctcacatatcctatgagatagactattacttccaattatcaatgagacacaaagagattaataagtagcccaatatcagtgttagtatttgatggtctagaacagagccacatgtacaatgactacatgacactat

SEQ ID NO: 58507 - DNA, 1039 bp, Homo sapiens
tgcaatatattttctcctaaacaagttcttcatggaattatttagttacacattcatatttattcttagaagagcctggaagccatacttccaggccatacttccaggctgattagagaatgctgccatttgtaacatctgtcatataaatgccagattgataacggtgttattaactctgaattaatttacaagttactttttaggtgactgttgtaaggttaagctattagagaaaaatttaaatctgtttacaagttaaaaggttaacaaatgtgaattgccaaatgactaggaagtgataatttgatagcttgggcagcaagtgactttaagaatattaattaaatattataaaggaataaaaatagtgaaaatagtttgcactattggttttaaggatacaaatgtttaccttactttcttattaaatctattccaggagctatttgcaaagggtttgctcataacaattggagtatttaataaaattggcttttcctctcctgtaattcctcagttagaaaatgtagtcctttgatgatgatctagggctttgaagaagaaatggattctaaagagaaaattagatggtagttattatgctgtctaactagcaatgcattgtcatttgtccattgtgttacaaatgtcttactttgcctaccttcttcatttaatcatgtaacttgcctgtaagcagcattagagaaaagaatgttgccatattactctttcagctgttttctttgcttatcccagagacgttcactcttaatatgctcaatatagaactcttcatctcctccctgacacctggtctcttctaaattccttgcatcgacacagttggtcaaattatgccaaatactagggaagcatactcattttctctatctccttccttaggaatgcctctcctaactgcatcttgctcaagctatatatgactagcaagtttaattagtatttaaaagatcaaatccctttataaaaaggcctactccaaaaatatattttcttatggcaaataaaatat

SEQ ID NO: 58508 - DNA, 1509 bp, Homo sapiens
tggaagaattaaggtgtctggactacaacccagttctctctgttagagccgtgcctctcttccaaccacagtgctgcttccaagggcagcaggcttccttgtcccttacctctgtgtgccctagtgctggcacctaaggtggtcactcaccctctccgcagatgccagggaaccctgggatggccactgctccaccagatcaacaggctcctccagctgagtcaacagatgctcctgatgcggctctccatgagtgccttccctgagcttttctcaaaggacagacatttcttatgggaatgtgcctgctttgcttgggccgcccagcagatgttgtatggcaggggtgtggtcaacagtgaaggatcacattttaggaatgtagaagttacagcccaggattcaggagaagtcatggctgaaagatttatttgtgtgtataattctgattagtaaatttgaccagaaaatgaaatattgtttacatttccctgcatactctggataagtcttgaatttgcagtcatcctcagtgaaacatagttaacaacttttgagagtcgtgaagccagcattcattagtggcaccatggatgatgtaaagagcattgactaaatgatattagaaaactacagaaacagtccgggtgaggtggctcacatctgtaatcccagcactttgggaggccaaggcaggcagatcacctgaggtcaggagttcaagaccagcctggccaacatggcgaaatcatgtctctactaaaaattcaaaaattagctgggtgtggtggcacacgcctgtaatcccagctactcgggaggctgaggcaggagaatctcttgaacccaggagatggaggttgcagagagctgagatcgtgccactgccctccagcctgggtaacgggtatctcaaaaaaaaaaaaaaaaaacaacaaacaaactatagaaacaaagatctacgttgtttcagtgcaagcagattctgaagagctatagcattttaagccataaaagtagcatttctacttttttcttatgaagggagacataaaattagctgagaaaggagcatttgatgttaaagaacacaaagagatggttcctggacttacacaggcttgatgatacctatccatgaagagaatttccatgtgctctgattgaacaataaacaaatatgtgtctattctctacccatctattctaaatcttcattaatataccactatatctcacatgggctcatttaatttttaatccaattgtttatatagacaagagccccataaaaaacatttgtcacaggtctcctataccctagggacatcctgatatcagattgctaactctggaatggctagatgccatgaaagagacgtatgtatagacatatagatagataatttctgaagctggattatccaaattgtgtagtttacaaaaggtcagaaatatgcatatatatatgtatatatatatacacatacacatacaaaatcatgacac

SEQ ID NO: 58509 - DNA, 1076 bp, Homo sapiens
tttttaaattcattagactagttcaaacactattgttcaagaagggaagagtactatatttgctatatttggagcaaaatgtcagtactgcttacaaattggatttttctttttctttttgagacagggtcttgctttgccacccaggctagagtgcagtggcacaaacagggctcactgcaaccttgacctcctcccccaccgccccccaaagcgatcctcttgcttcagcttccccaggtagctaggactacaggcgcataccactgtacctggctaattttttttttcttttttttttttttttttggtagagatgggattttgccatgttgcccaggcatgtctcgaactcctaggttcaagtgatccacccgtctcggcctcccaaagtgctgagattacaggtgtgagccagcacacctggccaaattggatttttctattcaaatactggataattccaagttggaactgttctgacttttcagcgtattattataaatgctgattaggttttaaggttctcttgctgttatagatcagccacattacgggttaaaaaggtttttggccaatatggaaacctaatttatctaattcaattcaatgaacacttgttgtgttcccttaggttccagtcaccctctaggtgttgaggatacaaaggatgaatatatttctgcattaaaatttcagttttaggaaagatattaaacacaggactgtaatatagtgtattagtataattaaaaggtagttttcaagatcatggttcaattttggaaaggtaaggatggagacagagaaattcatatcctctggaacccagcctaggcgttgcttacttatatcttacgtgtattattgataatatactatgttattatattttaacatatctctctccttatagagataagttccccaaatgtcaaaagtatgtcttgtttattttcacagggtcttctttgcatactttagtattcagtaaattgttttgttgaataaatgtataaggtggcattctatctaggctttagaaggatgaatagttttcctgacctgggagtata

SEQ ID NO: 58510 - DNA, 1033 bp, Homo sapiens
ccttgcaaaaatggggacaggcagagctccaggaagggttcggggggccttggcagcctctgcctaggatattaaagtttaatttgcctttactctttggttctataggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacaggtatgttccaccagttctcttgtagattagattgtttgtctaggctagctcttatcttgaccgaactgtttcttgcagtgtttgaccaattaacgttccagtttttaacttgttttttatgtgaaggtggataactaaggttatgtttaggaatttagtctaaattattccattgagcatgttcactttttaatcatctatgcaaaggcaaagtaatagaaatgtaaacgctgaggaaacatctttttaaaatcaagtaattatacacatggtagtgattcctgagcctattttatttgttttagctgtctgtttgctgactttattaggttgtgaactaagaagcatgttagttactttttttttttgccaaaacttattttacaataggaatctgtgacaatgtcgtaactcaaggattggttgtagttctgaaaacggattatttcagtgttagatacaaatcagtgttggataaatttgaattcattatgcttttgttgaactactgatgatagttgttagactaggtataatctattaattaaaggccaaaagttgtacataaatttgtggtttattataaaagctaaaaatccatgataaggctttcatatcacctgtacttgatgatctctgtctaaaatacttggttacta

SEQ ID NO: 58511 - DNA, 1046 bp, Homo sapiens
aaatacagaacatagtttttaaaataagtattttttaaagtaggattttacaatggtttcataacacaagagttgcagataacgtagctaaatactttttaagctactgaggcattatttttccaatttacagatgaaattgagatccagaaaaatctttcttggagtgaagcacaaagttatgtaccaatccacatttgttatctgtttagaaatttatattcattcattgaaatgtatattcatttttcagttgtatttatcaaatgtatttaaccacttatcccgttctttcctttgagtacttgttaaatgcttgcctcttttctagacagtgaaaatacatttttcctatcctcagagtttgtattctagggtaattatttaatacatcattctggtcattttatattctacaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacaggtaaaaacttttctataggattcagtgtatcagactttcagctctaaaactagtcttgagatggaaaaccagactatagaattacagagttttgtgtttttttcctaaattttattaaaattcctccatgcccgcaacctttagagatagggcttgcctctctcctatctgaaatcctgccattttgcacattttggagaatagaagcctgtgtgggccacagctttaatttcagactttacccatagagggtgtgtaacttacaaaatatgaagagtcagagagttttaggaaataatggtagaaagtcattcttgcattgaggcatctttagtgatgtttggttgagagattaagagcataaatactttctatgacctttggcatgagaactttgcttctccagctgcctcagtagtttcttt

SEQ ID NO: 58512 - DNA, 1640 bp, Homo sapiens
aagggaaaagaagaatcagattggagaggcaattttaaggtatagattgacttgatttgtgattaacatgatgtagagggatatgggagagggaggatttattaataactcagaggtttacaacttgggagactcagaaatggtgacagctttcaccaaaatagagaatataaaatatggaacatgtctgagaggtaaagatttttggaggcagtgactgctccaggttataatcagaaatgagaaggatgacagtaaagatcaggttaacagcagcagtgtggcagaagcatttggttagtgcgggaaatagcatggccagaaacaaggaggcaaccagaatagcagagtatggtgaggccacctggggcaggcactaatgagtcctgtatgtcttagtagggttcctgaatctttaagaatgattaacttgtttactgagtcagggaagatgaatagtctattttagagagttttccacatgaataaatgtaatatcttctaggtttagataactaattttcagttatttggaaggaattccctaatccagaagctgtaattcttcgatcaaatacaggaagcatcatcccaattacataccaacatgtggcaaggcatattgaccaatatcttgatgttgaccccgagtgatttttattttattttattttattttattttattttattttatgttttgttattttattatttttaaagagatggaatcttgctatgctgcccagcctggtctcgaactcctgggttcaagtgatccacccacctaggcctcccaaagtgctgggattacaggcatgagccaccatgcctggtgaccctgagtgatttttaaaaatattacattgtatttagaacactgtttaaggaagcaacaaaaacatattttttaagtaaagttttataaaaaaattaagctttaactcttaaaggattaatacctctgttcctctattcaaaacatgttcttatctagagtgatttgtttctcagtatgttaatcaagattttattaatgtagaggcattaattttttttcttagctttcaaagttgtaattattccttttaatgttttcttgaaaagccaactaaaattcaatcagatttcttggaatgtaattctgttactctaaaggccgacagaagcggatgtgatgttaaatctgtgagtctctaaggagaatatattggctgctcttaggaaagcattggctttacttgtactcttgaattacagactttctacaaggttttcatttatttgaaattgccaatatatcaatttcaggtttttttttaataatgaaactgaaattataattttatagtaagggaaaatgctagctggtttctgttagaaaatgattttttggcgggacatggtggctcacatctgtaatctcagcactttgggaggccgaggcaggctgatcacaaggtcaggagatcgaaaccatcctggccaacatggtgaaaccccgtctctactaaaaaatacaaaaattagccaggcgtggtggtaggggcctgtaatcccagctacttgggaggctgaggcaggagaatcgcttgaacctgggagatggaggtagcagtgtgctgagattgcgccactgca

SEQ ID NO: 58513 - DNA, 1038 bp, Homo sapiens
aggatcaatgtgattgacatttatctccactctgcatgtcactgatatggtatagacgctataagccctgtagatattatgggtatgaagactatttgaggtgaattggcagtgagagcaaattttggaaacaggagagagaactacttcgtgcctataaaaagctctctcactccttccccaagaaaacaggagtctgaattttggccagctgggtatttgaatcttactgactgttgcagcactggtagtcctggtaaattttttcagtgggcgagcttttctgaaatttgattaaacatattagtcaagggaatctgtgaatagatttagaagtagaatgtttgaggtggttgacaagacatttagaattgtgattaatgttttaataaaatgctaagttagaatgaataatcataattatatagatggaagatatattctaacagttcttaaataattttagattctctaaatttagagtgttttctagcttagagagcaatattaatattttttacctagtctactgaacataatttcagggagttagtatttaggactttttacctagagatgcggtaaaccttttaaatttaaatttgctttcttaaaatacctgttccaacattgctcacctttcttctccctcctttttgccctctccttcagtgggaggagcacatattcagctttctgttaaacactctttggttttcaactgagtaaggcaagcaaggatatatgttagaagagtgggcataatactttatattaaaattatagggactaaaagtctaaatcattgctgtcaataggactttttttgatgatggaaataatttatgtctgtgctgttcaatatggtagccactcgcagaggtgactactgagcatttcacgtgtggcttgtgatacagaggaactaaatttttaattttacttaattactttaaattttaaaagttacacgtggctagtgggtctatcccaactatgaagagaataaagctacagagcatctatctagtctaatga

SEQ ID NO: 58514 - DNA, 1866 bp, Homo sapiens
gctagaatcctactttatcttttaagttttgctaattaccctgcaatgaatgttgaacataaaaaatttgactccctttccatgtgtccactgtttccttgtgccttttgattaataaaactttatttttaagtgagaacctctgttttcttgatttttaaaaaaagccattgctattttgtttttaaccatcctattttgcatagttctatcacttattcaagtaaaagttggaacagaacatgtaataataatagcaaacatttaaacaatattgattttatgccagacaatatttaagggtttcataatgccccttaattcatacccttttccttataaccctgttaggtagatgttgttattgtccccattatacagatgaggaaacaagcagtaagtttcagtaacctgcccaaggccacacagatagtatagtccaatccaggtttgagttacagagctgctatacacaatagtgattgctcacattgtagatattaatgtcttatagaaaattagattctagaaattgaactcttctctggaaagaaaaatgggcattcagtattttggtctcatttaaccatgacgtaaacctatggccaatggaaggtagtagtagatgccatgctctttcgggtcctcacttccaaggtgacaaaaggaacaatgatcatgccaaaaagggtggcagccacatgtgtgcccaaggacagggctattaagaatttctttattcaaaacacagtagaggctgcagcaagtgtcttcaatgcatatgtgcttcccgagctgtatgtgaagctacattattgtgtgagttgtgccattcacagcaggaagcctgcaagaactgaacatctccacttctatttagacctgcagatgctggcaccaaagctcatgtaaggagctgagtctttaaggactgaagcaaaactatcctctggagaaaagtaaaatggaaatagtacttaaaaaaaattaatagatgccgttaatcagaaggtgaaaattttcctggctgtgtcaatttagagttaacatatcaccccaggctgttgttgtcagtttattctgtaacttgctactggataattcattataggtcttgcctgagcatgtctgataattaaaactttatatttgaattatctggatgctgcagaaatggaactactctactgaagtggtatccaataatttactatatacagctattggttttttattcctaagatacaatatattggctatttgctgctctgttacttaatgacattagatgactcataaatgtaagtggttgacatttttgctattaagaatttagatattcaaattatgctttataaatgaggattagatttttatcatgttattgcctaggagataacaggtaactaaaacttgataattaaggatatcccattgctgttgatctagcatcttttctaaaaatgcatgttttacaatatttatgtgaaactaatttttatttgatgtgcagtaacaacaaatcaatgcaaaattatacattaatgaatttaacagtatgaagttttaagacataccacagctttcctctaggtggcatgatttcagctatcattgagtcaactgataaaaatcctttttccctacaagcacacgagtatgtagtttctgaacaatcagtataagtgtgacattgattagatttaattgttacaactggttaaataaccagattgaccttataatagtctattgtttaatgatcttaagtaacttaaaattgtaagacaaagtcctcttaaagaaacagatacaaaaaacttgttacctccaataacccagcaggcaaaattatttgtctcttca

SEQ ID NO: 58515 - DNA, 1055 bp, Homo sapiens
cacacacacacacacacgcacgcacacacgtgtgcgcttctctgctccggagctgctgctgctcctgctctcagcgccgcagtggaaggcaggaccgaaccgctccttctttaaatatataaatttcagcccaggtcagcctcggcggcccccctcaccgcgctcccggcgcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcc

SEQ ID NO: 58516 - DNA, 1053 bp, Homo sapiens
ccttggccaagtatactatataaatacagtaaatatgaatagaactggccaggtgccaatctcctaggatgaattttagtcaagaatgtatttatgggatataaataatactgtgtcaacatttaaagaaggggtctgattagttttgaatttattcatattgatcttttcacgtgctgttagtttaagactcgaagtggagttatgctaaggtttaccgatagtttgcccactgggaattagtggacctctagtagtttaacaatccatttgaagttcgaggcacatctattcgaaagatgctgcacaaggttttagaaacttagaaagggtgattcagttatacacaggaagaattcaaataattgacatgtaagaatctgtagagagtccgacaatcaaaaagaggaagagacacaacgtttcattttctttcttttctctccctttttcattgtaaccaatcagcacatgttgtggttctaaccctggtgattttgtactccccccaacacccgcacccctactcccactggaacgtttggcaatgtccagagacactttgggttgtcatgactggaggtggaggggtgctaccggtatttagtgggtcagccagggatgtttctaaccatcctataatgcatagggcaaccccccattcccaacatcaaagaattatcctgaccacaatgtcagtaatgcctctgttgaggagccctggtatttgttgggggttactgaattctgttaacagtaccatttagaaaataataacaaaaataaaatatctttatgatcaaagcatattcaaatgagaatactgaataggaggatagtcagacagttatcttaattaaatggagtgtggattagaccattgtatacagtatgtactttattttttgtggtcttaaagcccctaaattagagacatcaaaacttcccatttatttagcttaagtgatggtgttgacctatccattactagcttcagtcagcagcagtgtgatgttagaacagagaaaaaagaagtgaggaattatcatggat

SEQ ID NO: 58517 - DNA, 1141 bp, Homo sapiens
ctccagaaaagtgtgaatgacttattctgattctactttagacagataaagaaacaatcacagatggaggacttttctgtgcaaaggatgggtggtttggtcaaggaacggtccccccagaggtcagtcagggctttctgtggggaaaatgtttctacattcaagttcatccttggcattttgggctctgcaggttaacgagagggagacagaggaaggagtgcaccaaacctctgactcctacctggaagtagccaagcagaagcaaagctgaataatagccatgacctcaggctctgaagcaggaggttccaccttcagatggatctgttaaacttcaccaccctgggtttcttgtacctgtcttcactgttttctgtctgagatatcttgaggcatttttaaaacattaagttgttttggatagtaatttagtcactcatttgtatctcttcatagtattaagccttaggttattatgtgtgttaactaaaatcactgatcggatctctaaactaagtcctgaactgccatgattccacctactaaacttacacttttcttctacgtagaatgaggtgaccggtgctagtttgtcctggagagagaggtatttcagaagaattccactgtcagaaaatatcaccatcaataatgaaactatgtgtgtaaagtcatgtctaattttattaactgtttgtcacaagtactcagattatagaaagagggtcttgatctaagctgaccctgaattgttatacatttggatcagttttccctttcttgctgagaattctctaagaagagtagaaactcattgtagttcagtgttgggaggaatgattgtacccacttacagagttgctatatcacaagagagatgcattgtttgtttgtgtggagaggctggagggattagggcaggagcttatttgatagggagtttagttgtacatttgtaagacatctaattttacttaagatatcattgcagtaagaatggctttatctctatcctatagaccctcacagtagacaaaaccactacctactcagaacaaatagcccttatgagggaataatttttccttgattcacctgattggattgttttgaggtcaaatgaggttctgtaaaaggc

SEQ ID NO: 58518 - DNA, 1134 bp, Homo sapiens
atatcatgataagtctcatgatatgatggttttaaaaagaggcattctgctacacaagctctctctctttgtctgctgccatgcacttaagatgtgactttctcctccttgccttccatcatgattgtgaggcctcctcagccaagtggaactgtaagtccaataaacctttttattttgtaaattgctcagtctcagctatgtctttatcagcagcatgaaaatggactaatacaccccctcagcagctgtttacagcatagcaatcaaagtgattcctgataaaatattggtcagatcaaagtcttctctttaaagctctacagtggcttcgtatctcaccctgagtagaagccaagtccttaccatgacttaggaggctggctctgacctgttccttagtcacccacccctcagccataatttccccctcattcatagggctcccccatttgtcaatgacctctttgctcttcctcagacactgcactcactccttcctgtggcttgtggccactgttccctccacccacagtgcttttcccaactacccatatggttggttctctttatttctttaggtctttccttagagaccacctgctcagggagaccttctttggccaccgtacctaagatctcagagtcgcttttcccaacacatcctagccccaatgtctactgtgcttttctccttgataatcttcattatctgccatatttgatctattccatctttatgttgtttataatcttatctctacctctagccataaactactggagatgtgtctggtccacagtgggtgttcaataagtgttttttaatgaatttaactaaaatgtcaaaataagattcaactataaggaatgtccttcaaataagtatgtaacttataaaggggattctgttgagaaacatcactcatttattcggatttggaaattctgctccatttgttttaaagatatctaaatattgatgaagaaagaaatgtatataactatgcatcttctgtgacttattcagagctaattctgatgaagtatttaatattaatagataataaccatgtaggtaaaaaaataaaataaaattatgtaataaattaatgaaactgatattcttgggta

SEQ ID NO: 58519 - DNA, 1041 bp, Homo sapiens
ataaacccttttgtaatgtattatcctttttatatgtatctaaatttgttttgctaatactttggtaaagaattttatgtctgtgttcatgaggaatattgttctgtgattttctttaatgcctttgaaaaacgttatcatcggggttatgctagtcacttaaaagcattgggaaggattcccttctctgtgtctgagtttatgttatttcttccttaaatatttgataaaattcactattgaaattacctggacctgagatttccttttatgaaggttttgataatgaattcaatttctttcatagaaccaggatattcagattttatatttatttttaggccagttttgataatttgtatttctcatgaaatttgtatcttttttctgatttgtcaaatttattgacaaaaagatgttcatgatatttccttttaatgcttttatgatttgttgttgataacttttatttcattgctggtaataatttgtatattttctcttttttttcgtggttcatcttaccaagaagttaccaattgtattaatcttttatagaaccagctttggctttcttattttctctcttatttgctttctatttcatttatatttattcttatgtttcttattttcttctatttacattaaatctatacatttctcactaatcattactgtagctaagttccactaatttttttctttctttttatttatgttgaaatgttttcaaatctaaatggtcccattgctgtacttgtataacagaccaccccaaataataatagttttgttatgttcacaaattttgtgggctaagaattcagaagggggatggtggttatgacttgatctggggcctctcctatgggaaaacttgaagattggtaatgactcgtcgtgtgattgccaggaactggaatcatctgaaggctcactcacatatatggcataatgctggatattaactgggacctgcctttggtcttattaccgtaacacctatgtgagacctcaccatgtagtatcttggcagca

SEQ ID NO: 58520 - DNA, 1034 bp, Homo sapiens
gtgcctgtgcacgtatgtgtgtgtattttttttaaccaacatagtatcccagagcatgaatatacaatgaatggattaagattcactggtactgtaactgttctccctcttaaaagatggagggagtaggtaaagaggatatgaactggcattagtagattttaatggattagatacaagtatgggatagttaatacaatatacatgagagtagttttaatatgcatttaacttataaaacttagaagaaattgaaatcatttattcaaaacactattattttggtaattaaagcatccattttcatattcccttttcctttctttttttttgggggggggcggttgttaaacagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggtaagacctttaaatgttggtaatttatcactgttcacttttgtctaattctatacatcaaatcttacttggaacattatttagaagcacttgtatatcattcgatgcattcatagtttcagataaactttacatattgaggatttcaaagatattagaattataaacagcagcgcatgaaactttaattgattttctttttgaataataacggattttgagactcttgtggcagttaaaatttttcttctagtttaattttcagttaagaaattattcatttcaatttttaaaacattttacttcagttaccttaactcttatgaatataagtttaaacatctattgccattaagatatacagtcaaaatataccactacatttatgaaaattataatcttcagagttaatctcacaagaatatttgtaaatttttgttagactgtctttagcaagccctgttcctaagggaatataagtagctttatataagctctttattctgctt

SEQ ID NO: 58521 - DNA, 1279 bp, Homo sapiens
aaaaatgcatttgagattccaaacaatttttattaagcacacacaacccatagtgaggaatgaagttaggtaatttttttttgaaacagggtcttgctgtgttgcccaggctgaagtgcagtggcgtgatcatagctcactgcaacctaaactcctggactcagtgatcctcctgcatcagcctcttgaattgttaggatgataggcacttgccaccatgcctggctgtttttttttttgtttgcttgttttatgtagagatggagtctctctatgttgcccaggctggtctcaaactcctgacctcaagtgatcttctgcttcagtctcccagagtgttggtattatacctgtgaaccaccatgtctggcccaggctaggtttcttttaaaaatgaattataatgggaaaaactagcaaaatgtaagattggaaaagaaatatgaaggggataggttcaaaagttgttaaccttttattttgtttaataatctgttcagatttctgatttaatgtaagacagtatgtcctaatgggacccaatctctgagagtgtagttgtgtttgtgtaactttataaaacaaaactactctctgtatttgatgtagataggagcccattctttgcggttttatttgattagtggtactttgttatgttgaactcagttttacaaactttttttttttttttacagtatgtgatcttctaccttttctaggtagtgtgtctagcttggacaggtcaaaaatgatacttctcactaaattttattttcaaattgtcaataaaatgttatgtgctggagtataaaagaaactgagaaatttacagtctagtaaggcagagagggaagtaaagtattctaatactgtacaggtattattgaagaacaatgtcgaaggtatagcgtaagcagcaaggagagaagtaaatctttctgggagttgggaactgctttgttgaagtggcaactgagtcttaaagaataattgagaatgtgactggtaaacaaggacagaaacatgttcatgaaagaaagcaagggacacattaaatccttccaggaaatagtttggtgtacatcccaaatcctagtatcattgaattatatacagggagtgaatgatgtgatcaaatgggcattttagaaagattatgctgacaactctggagggctgactagtcagtgtgaaggtcagaaaaacagcaagaaagcaaatgcaatagatctagtagaatgatgaagtgctaaactgacacactattttaagactt

SEQ ID NO: 58522 - DNA, 1108 bp, Homo sapiens
cactatgatctctgccccaactcaaatttggacatatcctcgccctatgggacccagtaggatgataactcacgtgctagaatccaacagagccacaaaagttggaatcctttccctacctgacattcttcaaaatattcaatagatgtatggcttttaatccctcttgggagcagggagatgttgtcctatatcaaatcatccttctcatgccacttaaggcagtgagaggaggagggatggatcaaagggctctccatgaaggagagtgacactatgcagtaagcaaaccacatttcaattttgagttaatgtggcagctgcttgcaagaatttattttgattttgaggggtcagtttctcacacttcagggcatcaacctcttcagctttgtaaactcaatctaaaaaataagaccctgaatactaatcaaggcccattttttgtttcccatgggaaattgtttgtctcagggaaatctccctgagagggccaaagcttcttgaaagcaggcatgcgtagttgtaaagaaaacaaaacaaagttctgaggtgtttcactgccatcttcaaatggatcaaagttcggcatgatggactttaggagaagtccctctgttgctggtttttccttagtaaccatcatgcacaccacccccctcatcttccagttgtaccagccagctgtctagcaacttgcttggtttctgcttaaaaggactgtaagtttccctccttttacactcaatgcaagtgtgtcgctctttaactgtcttagtctgttcccattgctataacaaaataccatagaatcattaattgataaggaagtccaagagcacagtgccagcagatttggtgtctggcgaaggttgtctcttcttcaagatggtgtctttttgctaaattctcatatggcagaatgttatatccacacattgtggaatggagaaggcaaaaggcactaggggggttccttcaacttctgttataagagcactaatgtattcttgagggcagagccatcatgacttaatcactttccaaaaggcttcacctcttaataccatcaccttggggtttaaattccaacatgaggatcttggag

SEQ ID NO: 58523 - DNA, 1031 bp, Homo sapiens
gcattcaaccaaaagggtactcagggtctttgagacacctgcagagggaattatccatcaaccaggcacataagtggaggggacaagctcatgaaagaaaaacatcaccctgaagacgggtagctgggaggcaggcgagggaagctaacaaaacacccttcttttatgagtcacttttttaaggtcttgcttaaattttttgtttaaaaaaattatgatttaaaaggttcaaacagcctagggaagtaaatccatgcatacttccaacattagttaatatttactaagaaatcataggttacaacaaattaaactttttggctctcttactgagcttttctggccaaccatgttagggactgttcctacagatagtttataactatttttttacccctctaagcaactaaagtgcaacgaatcagaagaactctgggtccatgtggttcttaagccagggtctttggaaaatggatttgaggttgaggaatggatcaatgtgaacaggcagacactagacgtgcccgctaataactgggaaaagtgagttagatttctccttgtttgaggtggaattccttcatataaacctgggcaccctcagagagaaattctttatagtccaaactgatgtttattttggactctgtttctctttcagctttcagttgcgaccttaggaatgagctcacaattggaagcaaatctgtcttctgtttctactgttaaagaattacctacccactgacaaaaacacataggattaacaatggctttgtcccagatagatgctttttggaattgtacaaactgtatttatgatgcttgtacattttggtccaacttttaaatatttcaataagactgattgaattcttagtaaatagaatacttcctctgttcagttttgctctgttgaatgctggaagtttggtgagtctgacccactacacgtatctcagatgatttaaaaacaaaggcaggccatttggttttgatgctgtgtctgttttgggcagtgtctcagattg

SEQ ID NO: 58524 - DNA, 1267 bp, Homo sapiens
ggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtaggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaatatggtttttgtattcatttgtttctgaaaaatgtgcattatgtactatgaggaaatttctacaaagagatgaagacaattgaaagccagatatctgttattgatctaagcactcccaacatgtctcagaccctgaaccgccagttataccctacactgataggtctcgaagcactttctttccatagctcctaatacagaatctgaaattgtcctaaatctttctgtttaaaaaacaaagcaaacccacaaatggaaaaagcaacaataat

SEQ ID NO: 58525 - DNA, 2013 bp, Homo sapiens
ttttgagacgggagtatcagtctgttgcctaggctggtgtgcagtggtgcgatcttggctcactgcaacctccgcctcctgggttcaagcaattctcctgcctcagcctcccgagtacctgggactacaggcacacgctaccacgcccggctaatttttgtagttttagtagagactgggtttcaccatattggtcaggctggtctcgaactcctgacctcaagcaatccacccacctcggcgtcccaaagtcctgggattgcaggcctaagccacaatgcccggtggaattcaagttttatggagagtttggaaccctgttatatgttgtttttcagtatagtcaggtctgttttacttccattatgacctcccacattaaggggatgttatcaacagtagaagcctccagatttgaattttggttatcatactcttgccacttatactagaattttggttcaatgtaagctttaaagactatttttcttttaaaaaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggtaagtgagcttgcttttttattttttgcaatgttctctgacaaactggaaaatatattttcaacttttaacaaccaattttgaaaaatataaagccatttttattaaaaagttctgtttctacctttatagcaagtaatgattttgttacattaattaactgacttttaatatttagaaggtcagtaagtgcgtacctttcctcacagtgaacagcagcgactattttaacttgcctaaattgatatagcaaaaattaaaacagaggaaatttgcctgcatttgtactgttgctccaaaatgctattgaaaaaaaagtatgaaaaatgattttttcttactaggttgcttgggttacaagatctggcaaaaccgagctggcagaaccaattgccattcgtcctactagtgaaacaggtgagaataggcattggagtgcaagagaatgctcactgaacgttagagacagcctctaaagttgagtctcagcttttgctttgtgatagctataatctctgttgacgatataacatttcatgaatgttgatgaagattgaatgcaaacttaagttgtctagagttttattctctaatattcattgtagagctccttatcattaaattataggatttttaatttaaatactcatttttatgctgtaaatttttaggacttttcaaggagttttattcttagaataatttttattgttggaattgattataatattgcaaatgcaatttttatgccataattatttttaaattttaataatacatttaggtttgcattcatgtagggtgttcataggttgctaagtacttttacgtcatctcgtgttattcttacaacagtgttgtgaggaaggcagggaaagttactgtgatttccattttgcaggtaaagaaaagtctctgaaagattaaatgatttttctgaaattacgtatggtaaatggaaatgctgttggaaaatttgaggttttgggctttacagtgtctttcaaagtgatcattcatctgtagagttcaggattgtctgttcttattgatatttctagtgatacttttgtataatacattattaatattgtgataccagtttttttctctcagactatttggcaaagttttgtttgttttggtttactaattatagatcatgagcaggctattctaagacaggtatcttcactttgcacttcattgcaagagctttcatactctgagtagatgcatcagatataaattaattctgcttctcatacataactgctggattcagcaaattgtttagcttctat

SEQ ID NO: 58526 - DNA, 1259 bp, Homo sapiens
tgtgtttgcagatctacttttaaactttggacagatccttttgtagttcctaagtgtgatggttgggttttcacactcatatgtgagatatgcctccctcaaaccttatcaccacctgggcacattccccgtgtgatattggcggaaaaaagaaagctttgagcattgtatttgtttaagtgtgcttagacaatgacttgagttaaatactgtcttctctttttcctcttttgttaaactaaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggtaatgaatcgcagaaacttcatttgaagcaaagcagtgaattaattcaattcttaatagtttttaaaacaaattttgactggtttaaccatcacattaagttagagaacgctaaagctacaatgtcagcagatagcatttattgattttccatttagttttaaaaataggtaacacgtttgtttggttcaagaatctcagaatgtaagaagttcctgtgcatgtttcccatctttccggttttccccaccaccgtaatcagtcagtagccactgttaacagtttcttctgtatctgttgagcgattttcatttattattcaagtaaatacagatacacacacacacacacacacacatacatattttctctcctcctttttaaacatgattggtagcctaattatacacattgttttgcaccttaagcagatttttttcagatgaagatcttttgtggggactaagtgagagcttcattctcaatttaaaaattgatagtttaaatataagacaaaactgactaaagacaaaatggttggatagagggctctttaaggatcttccaatctgtataaataatgtacggtcatacaccacataatgatgtgtcagtcaacagtggactacatatatgacattggtccataagattataatggagcatgtatggaaacctgatatatggcacttgatattggcatcgcagatcaagtgggggaaattattgatattcagtaatgttgctgggat

SEQ ID NO: 58527 - DNA, 2376 bp, Homo sapiens
agttttcctagcatgttactaggattaaaatgcacatttagatctttgttttctgtaatccttagcaaaccgtagtggtcaagatcacagcctctggaataaactcgggattcaaatactagctctactacttattgtgtaactctggggaaggaacttaatctttctaaacttgacaacttctctaagggttgttttgagagttaaataagataccacgtaaagcacttagtgtagtgtctggcacagactaaatataccataaaatgataatgatacttttcatattataattcaaattctctcaagaatctttaggtaccttctaaatcatcagggaagattgcatagtggtgattagtataattttactctttttggaagaataacctgagtaatttacttagttatctagaatattccatttcctaatgggaggggaaatatatgaatacatagctttattaagagtatctcattgaataacagagtggtttgctcaccttaattttctcctttataacgtttcaaattataatcttggcgaacggggttttttttttttttttccgtgtgaaaagtgtgccatctgactttaagctctaatgaatacctgcttatagtgtaaaatggagcttctttcaaatagtcatcaaatagtcatttttctagaaatagttgcagggaagttccttcttttccatttttattttagctggtggaaatttcccttttttccccccttgattctcatatgtctgattaacttggccgtttttcttgagataaagtagtttctgctgtgaaaactctttcctaaaaacagaataaacaagagacacaacaggagtacaaatcagacaatctactctcatcttctctttgtacattttctcttaattttactacctttgtgtggtacctggtatgacactctaataggcagaaaacgttataaagtagctggacaaggaaatgtgctttgctgcctcatagatgcaaattttgtgaaggtataccattggtatcctgcattcctctgatgcccatttgagtattcttcatggcttctgcctggtttcatttagctatctggagcattattcgaatgtagcagtaaaaattggatagggtgatttggagacacttttcctatctattttgattgatacctccaagttcccagtggtacactggtttgtggtgagatagtagcaccatttcaggtaaggtgtccagcttgggccctttgcctgtgttgctatcattctctgctagagagtcacaagtgtctcggtggggctgagtatatcattcttttttattattatgttgaagtatcagattaaaatatataggtaagtgtctaaaaacttcaacatgctttctcatctcattgtcagtttttaaaattgatataactattcattagttggacccaaacttcctttttttccccaaagttgtatttaatttctgtttaataagctgtggaaagtaaggtttgtataggcaaagccattgatctgatctttgttctgattttgtaaattctgacttcactatttatagacctaggtcttgacactgacagtttacttagatgttctattatttgtctgtttacttaagtaaaatagaaagttacactgttgtatgttgaattgtatttttgtttattcagcttatatataatttatgtttttaatttagctttatcacttattgtaggctgatgatttaacataggtttccccatgattaacttatgggaatgatttgctgataattaaagatttttaaatggcattgaaatttccagaaatttccaaagttttataaatatctctttctctcttttattttaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggttagtgtgttattttgtttatatgcttttgttttttatgtttcagggtattgtctttgcctcaagtgttttgtgccccatcaaatctggctaacttctactcatatttcagttcttaattctcttaccttgccttttagagaaactttgttgattgtttcttacgccaactagatttgattggatgttttcatatgacaccgcccatcactgacatagtacttaaacagactgtattttaattgttaaattgtttgtttccctccaacctgta

SEQ ID NO: 58528 - DNA, 1538 bp, Homo sapiens
gtgaatatggataagattattctgaaaaattaagtggcagatcatttaaaagaaaaaagctgaaagaaaggtataatgtgagctgggttttaatgttagaagggtttcagtagggaagaatgcagtctaggcagcagaaagcatgaataaaaatagtatctttattcactcttcagggttgattttagtgaacatagctctagattttatacacaaatagatacctgtaaatttataattttacacaaatgaaactgttccacaacaatgagttacaattatatcacagagtttgatggagctcttgccttatcaacaatctagatgtatttcatctctaaaaaaattaatagtgatacctaatgcttattgatattcactttttctcagcctttgtgactaagggctttacacagattactttttattttcccatcaacttgatgggttaagtatggttatcccccttttatagtaaggaaacagcttaaaataactcaaagttgcacagtgagtatgtggtagagcagtgatttattctcaaacttgatggatatgttataatttctttagtcccctaatgacaaagatttagggtattttcaggtttttactatagtaaaaatgcttcagtgagtatgtaggtacctctatctttgtttacgcctgtcatttttcattaggataaatacttaggagattattcatttaagctttttaagggattgaagtttaaagtttctgtttttaattggaaacattataaaacaatcagtttgaaataattttgtgggaaaacatttaatatgaattaattattttacttttggttttctctcttggtagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggtcagtatgttagagaaagtcaagaccacattttcagtgtgtgaattcaaactgcttagagtagtctcatcttcttataaaacatcgactgctcatattttgatgtaataatcaacattgattgatacctgctatgtgccaagctctgaaaatatatataagaagctcataatctagtggaggggtgacttactggggaaggaaacatacagactcagtgtactcttatgtgatgtgactgtaatcctttgtgatatgtataagttgctatgtaaagggtttgtgttcttaagtggcaacaaaggtggaaaccatttataaaggatatttaa

SEQ ID NO: 58529 - DNA, 1003 bp, Homo sapiens
aagcattaactggacaggtgcagtggctcacacctgttatcccagcactttgggaggctgaggtggccggatcacttgaggttaggagttcaagaccaggctctactaaaaatacaaaaattagtgtggtggcatgtggctggtaatcccagctacttacaggctgaggcaggagaatcacttgaacgcaggaggtggaagctgcagtgagcttagatcacatcactacattccagcctgggcgacagagtgagactgtctcaaaaaggaaagaaaaaaagaaagaaaagcattaacttagtgccattgaatttatctaggaattcagtgtttattgctgttcagataattttgttcaaataaactattttgtccctttattttctttttagcccatatagttgcaaggaagccccgtgtgttttgatatacattcctgatgggcacacaaaggaaatgccaacatcagggtcaaaggaaaagaccaaagtagaagccacaaaaaatgaggtaatgacttttacggatatgtgtataaaaataaatggtctttctatcccagggtttagaatatatttctttacagatgattatctttcttactgtggagactgaagaagacagttaagtcttgctctttgcattttgttgttatcctttcatgtaagattttaaaatctcactctcacccaaggctggagtgctgtggcgcgatctgggctcactgcaacctccgcctcccgggttcaagcaattctcatgcctcagcctcctgagcagttgggattacaagcgtgcaccatgacgcccggctaatttttgtatttttagtagagacaggcttttgccatgttggcctggctggtcttgaactcctgacctcaggtgaaactcccacctcggcctcccagagtgctgggattataggcatgagtcaccgtgcctggccagaccccttatactcttaagaatgatttgcttatgtgggttatatttatcagca

SEQ ID NO: 58530 - DNA, 1546 bp, Homo sapiens
aatggcaacaatggaaaaataaaaacaaatttaattataccactgttttctgcattcttctaatgagaaaaaataacttccattacttagctgtttgactctgctttcatctacatttttctcacatgtgctttatatatagtgtctaaacattgctcttgtgattggtcatcatgactaattttacactgaacagtgaagtgagaaaaatacatcagctccagaaggggatgctactgatgatttggaagtagaataggttagagcataatgtgtatgaccatttattgaggcaatctgcaaatatttattgattacctatatgagacagaccctagctaggtactgggaatatactgagaatatactggtctatatatactggcctctacatatagcatgtaaaccagtagaaatgtcatttatacttttaatctatagaattgccttattatagtgaccgaatgctattctgcttttgatggtgatgtgttaccctaacactgattaaagaaaacaatactgaaacaaaaatatccatattctcttaaaatgggcttgtccaaactataaaattgaatatcacatttacctttaggattaagatataaccccactggaaaacttttccttgccttctaataccagattttaaaattattttcaaaataactctaatattatgctttaattggtttcttttcacctgccagtagctattcttgtgaaagaagtctaaatccttcatgtagtcttggtttacagttgttctcttttttctgcttaatggtaaatatcagaaaagagttaacagttgaaaaaaaattagtaaatgcagtaacaagaaagccagttagtattcctgtgctattatttattttgcttatggcgctctataagatatcgcagtgttttaacatgaggatgtatttgttgcaggttattgacccagtggctccacgatatgttgcattactgaagaaagaagtgatcccagtgaatgtacctgaagctcaggaggagatgaaagaagtagccaaacacccaaaggtcactcttacagtttcaccaatgtgtttctctctgttaaaagaaggagcaggaaataaaaaggaaaatgtgctttcatggcagtggcatgattttgagatgattttctttctttctttctttttttttttttttttgagacgtagtcttgctatgtctccaggctggagtgcagtggggcgatctcggctcactgcaacccctgcctcccgggttcacgccattctcctgcctcagcctcctgagtagctggaattacaggtgccccccactacgcctagctaattttcgtatttttagtggagatggggtttcaccatgttggccaggttggtctcaatctcctgacctcgtgatctgcctgcgtcggcctcccaaagtgctggaattacaggcgtgagccactgcgccaggctgagatgattttctattcaacattgtcaggatttgatactaatcgaagtaaatcttttttggattttttgccttaaaaaag

SEQ ID NO: 58531 - DNA, 1597 bp, Homo sapiens
tactgcatacttactgaggtttgcagatccctgcagaatattaatttcctacatatatttttgttttattccaaagggctttataaagtatattcatatgtgaatgacaggataccatcttttttctgattctcatggtcctatgtggaatagggaccttgaaaatgtttgataaataaaaatgtatgaatgcatgggatttccatatttgaaaatgtcaccattgtgtcttttttttcaaatgtgcttctactgtttccagtagtgcatttattttactgcagtatttgacaggtcagcagttatcctgttccttgaatttgggctcactagtattgcatactacctaattagtataactagctcttagacaaatgtttaacaagctgaatatgatttattattgattaagtatcttctactctccacatctacacattacaaaatttccttggtacttaaaatttacatatttccagggatgacccaagatttcctacggttcgtggtgtactgagaagagggatgacagttgaaggactgaaacagtttattgctgctcaggtgcgttacagtttcttttccagcttgtctgtttgaaatttcaggtacttctattactgtccctttactctttattatctctgttgttctttctattccttgtttgtgccttatgatccaagggcagattttttttttttttttaaaacaaacttttttttttttaaagtttatcactgcttataatagtgaaaaattgaaaatgtcctaaactcctaagctagatttggagaaaggcagctgaagtatttttagcagtgaattatatgacttgactgtgagcagtctgtagactgaacctttacagtgaactgttaagggtaaccaaattagtttgtatacactgagttttatatttcactagaagtaaacttgaaagtatttatcgagttttttttttttttctaaacatgcttagcatgaaataaaggcaaagttctaattaatactgcttgcccttaaaatcatgttgttattgttttttagggctcctcacgttcagtcgtgaacatggagtgggacaaaatctgggcgtttaacaaaaaggtatgtatgttaactctctgccttcttttctcatgcttaagtcccaaataatgtacaagtagaagtcattactgtgctcatggtagagaaaagtttgtgaagaatattaacattttgcagactttcaggaaaatggaatgttttccttttttaaatacacgaagagcattaattaagcctattaactattccaaataagtaacaatgattgaaacaaacaaacttggaattatggggaacagtaatatttttttccttaaattttttatgaacactctgcatttcatttttctgctttcaagctgcgagctctctgtaagaaggtattacttaatgcttttatttgccttaaacatagcttttagcatattacatgttaaaacctgagatgttatatggctttgaagcacaatcacatttatataaaagacttgcttatacaaacgcattgaaaatgcattattcctagtgttaaaaaccatgtcct

SEQ ID NO: 58532 - DNA, 4653 bp, Homo sapiens
caaggtcaggagatcgagaccatcctggctaacacagtgaaaccccgtctctactaaaaatacaaaaaattagccgggcatggtggcaggcacctgtagtatcagctacttgggaggctgaggtaggagaatggtgtgaacctgagaggcagaacttgcagtgagctgagatcacgccactgcactccagcctgggcgacagagcgagagtccgtctcaaaaaaaaaacaaacaaaacaacaacaacaaaaaaaactgtaccactgctgccatcattataatttgaaactaatacaagttggtgaaagctgattaaacttccttgcttcatgccttgtcagcccaatcaactgtatttcaacatagtggtgtaacatattttcttttactcatgtacttgatagaaggagggtgttgatgtgtgatattatcaacagtgtctctgatctgtattcttccttacaattgtcagctgctcacaggaacagcagaacagtgtttttgtagattctgattcattgagtgttggtgctgatgagacctttgggattatttagttaaaattcttttatttttaatctccgtgacatgagtttacctatataacaaaacttcacatgtacccctgaacctaaaatagaagttaaaaaattaaagttaaaaaataatcttttggctgggtgcggtggctcacgcctgtaatcccagcactttgggaggccaaggcaggcggatcacgaggtcaagagatcgagaccatcctggccaacatggtgaaacctcgtttctactaaaaatacaaaaattagctgggcatggtggcgcgtgcctgtagtcccagctatttggggggctgaggcaggagaatcgcttgaacccaggaggtggaggttgcagtgagctgagaacgtgccactgcactccagcctgggcgacagagcgagattccgtctcaaaaaaaaaaaaaaaaacttttattttggcatctgagaaaaccaaagcctagagaagtaaagcggcttttactaattgtcatgtgctcttttcatttagtcatcacagtgacagtctcagaagagcttctctccagtggcataggtgggcacccagttctcagtagtagtaggtcttattaaagacaaacagtggaaggtagcgttggaaacaattttgaagcagctttactttaattaaatgatcattctttttgataaaaagaaaaaggagaatctccttaaggttgcaatgtttgtaaataccttgtcccctctgtgagattttacatttgaagttgtttcttataattgttttatatatggtatagtcttttttttttttcctgtcagggtcagattttctatcacagtactttttgttagaaaataaaatatgacttgggtaccaattagaaggacttttgtttagttctcatctcctcaaaaaggttaagtttaagtatttagttaaaacatgttaatgagtttctttgtgaaatgtttttgttttagttacttacacattgggcatgcaaaagctgctcttctgaaccagcactaccaggttaactttaaagggaaactgatcatgagatttgatgacacaaatcctgaaaaagaaaaggaagattttgagaaggtaattaaaagtgtagtgatgaccctttgccagaaaagtgaattaaagttacaggattacctaataccttcatggtatgaaaataaattttgttctcatagctgcttttttccctatctatatattccatatctgagacctaagccaagaaatgtcgagctcccataccaaaaaacttaagagttatttttcctttccccagttatagagtttacctgaatgatatgttttcctataataccaatttattaaatggtcactggaggcaggttttttggtcatataatcttaagtttatgaatgaaataaacactaagtaggtattggaaaatgtgaaggtttcctagcctcttatctttattcagaagtatggcagtgtattcaaagagagggcaaatgattgtcagttctcccagtaatgaccagcttttccaaagtaaatggaaaactccatcgtgagatcagctttctcagctggaaatttggaggctaatataatgagtatctatctgttttttcttttttgatctaatatcatgtaacttccacaaccattttcaggctaaataagactgatggtctatgttacatttgcttaaatgcagtatcaagggttgaaaatgcacgaaaaaatgcaaaagatatactgatggttattttggtttcttactacaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccgtaagccacattgttttatattttaattgatattcttatattgtgcttctttagtagaacgtgatttcttttttgtgaaagctgctagtttttttgtttgtttgtttgttttgagaaggagtctcgctctgttgcctgggctggagtacaatggcgcgatctcggctcactgcaacctccgcctcccaggttcaagtgattcttctgcctcagcctcccaagtagctgggatgacaggcgtgcaccaccacaccttgctaatttttgtatttttagtagagacggggtttcaccatattggccaagctggtctcgaattcctgaccttgtgatctgcctgccttggcctcccaaagtgccgggattacaggcatgagccaccgtatctggcaaaagctgctagtttaaatacatttgggtatatgactcatttgtcttagaaatcttttttcttcctctatctttatgttcttgttattttattaacatcacaactgcatgtgaatatgcccttagtatctcacttattatgtgtagtcttttgcattgtattcattcaatttgaaggattccttctgcaacattttacagttttcttactttaaatacttagcctttctataatacaatgtttgatgataatgttgtcacccaagtcttccttttggcatgtgggtaaatatgaatataatatatagtacaagctcagtactaacctgtatctctgaaatatcacttgactgaagagcatatctttcttattcatggcttctctcctgaacttctaaattgggtgattttcattctgtaattatgttgtcagaacttcactataattaaacctggagtgccacatttgggaagtattagtaaattaaaatagttataatgagtcttttttattttgaaaaggttttctacattttcagaggtggctaaccaatggacttttagacctatcttgattatttgagggcaagtgtcttacatttctagtagcttccacagaaaattattgtttaacagtttgtatgcatacagggcaggtttttgctagatattgtgatatagagggagccatagccacttggaatgtagagtccttttttctggtattaaactcttttctttcctgtgtcactgttttctatcacctcttattttcttggatccaagagtatcctgcttctcattgggatgatgaaggggctttcagggagcccatgagctcagactctcaacctgagctgtgttctttagataggcacggtctgtagtgccaatgcctgtgggaccttagggccggaccaaaccattctgtcccttaggcatgaggtggcaaaataagaatgcttctgctttaaaggcagaatgttaaatttcagggagatgagaagagaaggggctggcccgttgtgccatgatgggaagggaaacactaggtgagcggagccttcaggccttgtactttttcttatgcttaattgataccacatgagtggaatgtattgatgttaccttttctaaaacgtatttgtatttgctaaatgtattgtgaaacttctttaattaaaaaatgacgcatttgctcttggtactggatactggaaatattacagtgtttttaaactaacacagggtggttataaaacaagaacatgaaaatttatatcaaattatagcactatgagaataatttgaatttaaccagattagtgaaccgtaatgtaattatcattttatagctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaagtaagtatatctccttcaatatgctaggtagccatctgtgcttttgttttgatcttctttaaacatggagtacaagcaaaatagtcaagaaacctggccttttgttcatccatgggttcactggctggtggccttctgtaaaggcatgtagcctttcacgggccgtttactcacctgtcaattaaggttctaccacattatttctaagatcacttccatctatgaaagtcctg

SEQ ID NO: 58533 - DNA, 3242 bp, Homo sapiens
tttttttttttttttgagacagagttttgctcgtcacccaggctggagtgcagtggcatgatctcggctcactgcagcctccgtctcccaggttcaagcgattctcctgcctcagcttcctgagtagctgggactacaggtgcacgccgccaggcccagctaatttttgcatttttagtagagatggggtttcaccatgttagccagtctggtctcaaacttctgacctcaagtgatctgccatcctcggcctcccaaagtgctgggattacaggcatgaaccaccgtgcctagcatcccatatactccatctgatacatttctacttatcttcgaggtccagcttggttcttaactgcttttaagcttttcctgataaacctaggtattgctgattaatttcaactgagtgccctaacagcaccctgaacatatctgtattactggtatttggttttatttatattcttaaccagattttgtaccctcaagtgtagggatgatgttctagtcatcatatttttcataaccagtgtgtgtagtgcctggcacatttgttgaatgagtgtgttcttagacatttaaccataagactttttgttgtgatggtggttgtgtttttcaggcacctgagaaaaagcaagatgttgggaaatttgttgagcttccaggtgcggagatgggaaaggttaccgtcagatttcctccagaggccagtgggtaagaaaatgtaactcacatttataattgaatatatttagtgggaaagctttaaaacagtgattaaatacttaaagtattaataggttaataatatagaagaacataagattttaattgtgagagttaaaattctaaacgttttaacagtttttatgttattaatagttaatgttgatttaatttgtagttttagtttgtcaacttagtaaaagagacattttagttttatcctgacagaactttaattatgtaattaacaaaatatccaaaaataagaaaccttaaatttcatttttatttttagatttttgggctttcatttaattggatttgtatttgtaccctgagcaatccttttaattagcagttgaagttataatagtattggtctttaagttattttttttccccaagtgaaggggagtcctgaaaagcctgttcctattcctttctttccattaggtttcccaaccccttcatctcttggcacccatggaaagtagtatttgaatagctcattagagaaaaagactgttctgtatggtgatcaccaggctggggctgcttcagcccttgcccaccattccccaaggctgagaaggaagtctttgtctttgcacacctgtcatcctatttgaagtatactggacaagctttataatagcgtccttccaatgatgttaatataataaaatacctcttattaaagcagttagcctcacttagaaaattaaccattaggaaaatgttctgccatgttttgtaattgaggtgattattttttccaaatttaagatttccaaatttaattttttcagattttgtattctatcaccataatgaagttctcacctttctatagtacacagtagaaactggaagatacagaaacaattttcttttagcgatgtatttaatacttcttcacaaactatttcataagcatcattaacagtaaaattgcttttagaatttcacattttgtctctgcttttctatgtttgctgattcaggaggtgaaataaagggtagatagaaggagatgaaacagaagtgatgactgtggaaaattcacagacttgatcgttaaatggttgattggtaattgactaagtggattcaggcataaataatacttaccttacatggtttaatatctatagacatcttgggttcctaccatctagtattctgctactgtgcacttggtatgagaggtcatgattgtcctgttggatagtgaccttgatcgtctaaaagccacctttttttggcagtggccatttttagctgcgccacttgaacatttgtcttttttaaatcttttcatattttgcgtcactgtcacttctgggaatagtgagttccccatgtttgtatatttacagtataatatatatttacctgttgtaaattatgtcagagactacgctcatgagacagttttggggtcaggaatataaatcagtatttagttttttttactatgcatagttttcatcatctcttcttgtactgttaaagagtttttctttaattactattttttcattttttcttttctgtgtcttaaatgaaaggccagaaggcttggcttagtcttttattcttattcttagctaacatatacatagcacctattatgtacaggtgctaccacatgctttacttatagtaacttattaatcccaacagccttctgaggaggcactgttgttatctctgttttacaaatggtttcggaaacagattcatatgttgtagtaacttgccaagctcaaacctctaccatctggctctagaatccatataattaaaaattgtactacatgtatctgttaacatatggcagaagcccaattcagcatcagttctaactcatgcagcatgattcttttgtgtgtgtgtgtgtgtgcgcgtgtgtgtgtgttttagcgattctgatatagagtcactctttaactgatgattttagttgtcttgtgacttatagtcctcttagctttcttgaggtttggaattgttagacctgcagatttagaaataacatttttgaaataatgttttgatctcatcacctttcttaaattaatttctgtattttaaagccaagcacattaactgtaaaataataggtactaattgttaatcttttcttgacaatggttataacatgttattgggtgcaacgccctcaagttaaaagtacaccacaatatttttcttcctgggaacttatggcccttcatttagttttatttttaataaatttttaattttagaatagttttagatttacacaaagttgcaaaaatagtacagaaagtttccatgtaccctgcacccagtttttcctaacattaacattttacattattatggtacatttgtcacaactaatgaactaatattaatatgttattaaactccatccttttttgggattttgttagtttttccctagtatctcttttctgatctaagatttcatctgggatatcacatacagcccttttttt

SEQ ID NO: 58534 - DNA, 1022 bp, Homo sapiens
ttattgaatagtttaaaattatctttgctcataggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggtaagcctttttttctttttttttaaaaaaaaaaacactttgggaggctgaggcgggcggatcacaaggtcaggagattgagaccatcctgaataacacggtgaaaccgcatctctgctaaaaatatacaaaaaaaaaaaaaaaattagccgggcgtgatggtgggcgcctgtagtcccagctactcgggaggctgaggcaggagaatggtgtgaacctgggaggcggagcttgcagtgagccgagatcgcgccactgcactcctgcctgggcaacagagcgagactctatctcaaaaaaaaaaagatgacatttcagtctgtctgaggccctaggtctgaaaagacaattattcctactcataaagtttattttcttttaataaatttaaaaggatcttcttgcaagaatctgacatttttaagtcttggtttcacatttaattgttcatctatataaagccctaatctttataattatatagctaaatattttgatcatccagtgtatgtcccttaggcaatccaaactccatataaataaaacctcattaattttacacctttgcaattttttctttcttctgaatctcctggtttttgaaccattgagcatcaagtcctgggattctgcagcactttttcattggttctgtaggaaaatgtgacatagtgtacagtacaaaagctccttttctctaccagagttgctccactttgatctgttttacactttaggaatgtgttgtaaagttttgatttaattaaggttttctaatgtaaaatttgaaaactactgtctacttggataaagatagcccagtccactcagttgttttggctacaaat

SEQ ID NO: 58535 - DNA, 1340 bp, Homo sapiens
gtattctgctctaaccttcctaaatctcataaaattcaaagtacacagaatggtttctaagtactaacttttaaatttttcaagtaaatgaatctgtttggctaggtaccatcccttcggttcattcaggttggcttatttctgccaccaattctcaaattcttattttcctgttctttcctgaagtgccccgccacactcctgtaaaaaaaaaaaaaagcagaaagcatagcaaaataaatgtggcatttatttaagttctattttagattttaggcaatcagaatttagtccacataatgataaattgtataatttgagaaaggaaaagcatagtaagagtgtactgttgctctagttaactagaatttttttatggtctttctttttataagttgaaatgttggaatgcatttcttttctgtcttttatgttgacagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggtatcaataattcttaataatcctctgttttaatcgtttaatattttgctggataaaaattatatatatttctgtgtgtatgcatgtatgtatatgtgtgtgtatatatatgtttagacagtaacttaggactttattacaggggaatgacctccctggctgttttattcctatccagctacgggaattccctgtgtttttctgccgtcccgtcgtctgtctcacaaccccaacttccttcttgcctttggagctgatcttattcctgataaagaagtccccatcccatttatgttagcacctctcctacttcagctattattttactccagacacttgtctctgacttgaaaaaagccattattgctcagtgagtgtgtgactgggaggttagggagtagtgggatgatgtggagttgtggtttttcttggaggtcacttccttcttctacaactagtttggaacaagtaagaatatgctttttccaacttggaaagacagttttttcaaaaacaactttcttgaggtataattgacatacagaaaatcacacttatttaaaaatgtatattttgataaattttgacatatatatgtgtgtgtatatatacatacacacacacacacagctgtggaactatggttacaatcaagataataaatatatccaccacccccaaaagttcctcatgctgctttgtaatcatccaccctcaccaggtcccaagaaaccagcatgccc

SEQ ID NO: 58536 - DNA, 1210 bp, Homo sapiens
gtctcaaactcctgacctcaagtgatctgcccgtcttggcctcccaaagtactgggattacaggtgtgagtcaccacacttggccagccttgatttatattaaatcactgttattctcaacatcccagttatattttcatatttgcacctctgaatagacatgtaaagaacaaattagcagactgggcgtggtggctcatgcctctaatcccagcactttgggaggctgaggcaggtggatcacctgaggtcaggaactcgagaccagcctggccaacattgtgaaaccccgtctctactaaaaatacaaaaaattagcctgtcgtggtggcagccacctataatcacagctacttgggaggctgaggcaggagaattgcttgaaccctggaggcagaggttgcagtgaaccaagatcacaccattgcactccagcttgggcaacaagagtgaaactgcatctgaaacaaacaaacaattaacagatctattttttactatagtagaaaatacatggtaaatataataaagtttccatttttacatttcttcataagtctcatgacttactgatttgctagagcagcagtaatattttatctcgtgcttatattctagaaatgtgatattcacagatgtgaattctatacttcgctacttggctagagttgcaactacagctgggttatatggctctaatctgatggaacatactgaggtaagcaatgaacattttgttgtgtgtgttttgtcttatgcttctgtttttttatgggaacctcatcatttattgttggcttatgaactattctacttaaggatattaacagagtgttaattatatagaccaaggtacagaatgctcatcttgtttttttgtcacaaaaaaattctttttttgtaattcctaagtttgaacctttagtcccctaccagctgtacttttgggagcatttagtgccatcttggccttcacagattcctagcatttcatagccagatggggctgtatagatcatctcatccaactttcttactttacggataaggcagcaggcctagaaaagttaagtttgaacagggtaacacgcatagtttggatcccattttcttttctttctaagtgtatgccttgtttaattaattatttcagtagtaaattagctttatatacaatcatgtgcctcttaacaatgggatgcgttctgag

SEQ ID NO: 58537 - DNA, 1024 bp, Homo sapiens
ccggctaattttgtatttttagtagagacggggtttctccatgtcggtcaggctggtcttgaactcctgtcctcaggtgatccgcctgccttggcctcccaaagtgctgggattataggcatgagccaccatgcctggctggcactatactaatttctttttgtctccgaagggagaagcagattaatttcagtgtctctaactgaaagctgaacaaattcaaaaccagttggatatgctagtgaatggattctggattctgatttgttgctgctctgagacaaaagactacattttctgtctacagactactgagaaaaaagttcactccttgtaggacttaatattggtttgttgactcatcctgattgctttatgattcaagttataaatactgcattgcttttaaagataaaaaatcttttcatattatttataggagctttgctggcagtagaacacgtgaaagacgatgtcagcatttccgttgaagaagggaaagagaatattcttcatgtttctgagtaagtgttttcatctttttattttcagtactgattggctttttcttttttttagagtttttttagagacagagtctccctcttttgcccaggctggcatgatcatagctcactgtacctagaactcgtggactcaggatcctgccatcccagcctcccgagtagctaggactgcaggcacatgcctccacacctggctaattaaaaaatgttttttgtagagatggggtatcactgtgttgcccagcccagtttcgaacccctggcctcaagccatcctccggcctcagcatcccaaagcactagggttaaagacgtgagccaccacgtttggcctctgaatggcatttaaagaaatattcggcatcgccgggcgcggtggctcacacctgtaatcccggcactttgggaggctgaggcaggcggatcatgaggtcaggagatcgagaccatcctgggtaacacagtgaaaccctgtctctactaaaaatacaaaaaat

SEQ ID NO: 58538 - DNA, 1053 bp, Homo sapiens
tgccaggaccacaggtgtgagccaccatgcccagcctcctgatacattttttgttacttagaaaatcaccctgaaggtggcctgtttctgtagtgtattacagaactcagaattctgccagtattctgtgaaactcttgtcattttgaactgtatgccagttatcaaatatatcatttttctaattgctcctctccctttttaatttttgatttaattattcccagtttaattcaattacattttatctttaagtaatataattagatgaaacattttaaaataatagttgcattgctagaattttcctattttgtatgcattcatcatgttatatatttaatgttaatttcaaacttaaaataaagacctttttcccccataccacccaagagcatactgtagatatgaggcttcagtatctcagcataactccagtgtacatccccaacaaacttggaaactccaggtgatctcacacaagcacccaaatcaggaaatacacttggatacaatgcttccatctaatgcacagaccccatccttgttctatcattatttgttacaaccagaccctccatagtgttgagatcaaaatcccgtattatgctttgtttgcatctgattgtcacctctctccagtttctttcagtctggaatggtttcctagtcttcccttggctttcatagctttgacctttctgaagataacaggccacttaacttgaagaatatcctctgtttaagttgtctgatatttcctggtgtctagattcaggctctttgtttttggcaggaatagcgtagttattccttgttcttcattgcagcccatcagttggtgcatgaatttaattttcccattactgattattctaaccttaattttaatgggcagatgcattggaatcatgtaaatgttccactttgcatcagatcttcacccactagtttcagtatccattgatacttcctgcctaacttgatttttatgattttatgatgtttgcgagatagtgactttcccattctaccattccttctgtatgtatta

SEQ ID NO: 58539 - DNA, 1379 bp, Homo sapiens
tttctcagagggatgaactcccagtcaactcacctctccctttttcccccggagagcgagagttgctcgtggaaataagattttaaaacttaaaatccaatagtcgtcgcttctcttttagcatttttcccccaactccttttcttacctcctttcctgtcctgtccctcctctcaggagaaatcctcagttcacttgagtcaaattttccttacgttttatcgagttcagaagaaataacccagacgagcatattagcatttaggatttcaactgaggctgcatttatttttaattaaatgtggtagggtaattggggaaaacacccaggtacactgtagactgatgcggttgcttttactgcaccctgtggatgtgtagtaaatttcagagtaaacattggatctgtcaccttactgacacatcttaagttctgtttggaattattttttcgacatgaccaagattattgttggtagattgcttagaatttctgctttttcattactttgggaaattacacagaagaatttaagtagtttgccgatttttttttttcttttgagagtcagggtcttgctctatcgtccaggctggagtgcagtggcgctttcaaggctcactgcagcatcgaacttccgggctcagatgatcctcccacctcagcctccttagtagctgggactacaggcgcgtgccaccatgcctggctaattttgtgtttgtgtcttttttggaaagatggcgtttcactgtgttgcccaggcaggtctcaaactcctgggctcaagccatcctgacttggcctcccaaagtactaggattacaggcgtgagccacagtacccagcctgacctaatatttgttaatgcatatgtatgataatacacacacagtactttctaatgttgaagaagcccatacctttatatacagttgaccacgtggggctgatgaaattattcattatattctcaactttggtgatgttttaaggttgttgaacaaaaacacaacttaatagccattttaaacatttaaaagatggtaatgttttggcatattggttgcagtaatggactaaccgcacaacaaatcaatgaactctaaaaggaatgggtttgattcctgagctggaaaggcattagagtgccttcatgattgagagcaaagacatttggtttctgcagacctgagtccaatcctggctgccacttactagttgtgaaaccttgacaagttccttatttagcttctcccatagtttccttgttttaagaaagggagaataatgtcttccagataggattggttgccagagttaagtgagactatagttaaagctcctgatactgtttttttttttttttttttttttt

SEQ ID NO: 58540 - DNA, 1040 bp, Homo sapiens
catacagttaatttaatttagcccttatttatagcctttttttttttttgacacagggtcgctattgtctaggctggaatgcagtggtgcaatcatggctcactgcacccttgaactcctgggcttgtagtgaaccgaggttgtagtaactgagattgtgccattgcactccagcctgggcaagactccatctcaaaaaaaaaaaaaaaaaaaaaaaagaaaagaaaatgctaaataaaattaatattaatcagagaaaaaataattttatatcctttagttagttaaaattgttctgtagtcttaaatttcaagtgaattaaaacttaacctttatggacactcattatttcatccagaatttattggctactattggataaggaagcaaaaggcacttaaaaataactagaaaaaccacaatccaattagccactaacttgattgattgattgatgtttttctataggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattc

SEQ ID NO: 58541 - DNA, 1047 bp, Homo sapiens
agttctttgaaactgttaaccagaacagtaatgataataatcagcagattctctcaggagaagttctttgccagtgatattgttcttgtactttataacattatcatgttttttgagacggagtcttgccctgtcgcccagactggagtgtagtggcgtgatcttggctcactgcaacctccacctcccaggttcacgccattctcctgcctcagcctcccaagtagctgggactacaggcacccaccaccatgcccggctaattttttgtatttttattagagacggggtttcaccgtgttagccaggatggtttagatatcctgacctcgtgatccgcccgcctcggcctcccaaagtgctgggattacaggcatgagccaccgcgcccggctatcatgtttttattttttaaatcatgatgctaatataactgaatattccatttatgggctaacgttcttctccaaataaccacaagtcttgttgtttcactcgtttacacaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataaggtatgaaaaatgtctgtcatctgctctgaagtgcaagtgaatcattgaaatactcaacttctaaaaacatgaaataagagtttagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtaaggacgtggatgaaattggaaatcatcattctcagtaaacta

SEQ ID NO: 58542 - DNA, 1117 bp, Homo sapiens
attcacctgccttggcctcccaaagtgctgggattacaggtgtgagccaccgtgccctgccaaattttcttttctatgccaatcttaaaaataaacaatcatggcccggcgcggtggctcacgcctgtaatcctagcactttgggaggcttaggcaggccatgaggtcggaagttcgagaccagcctgaccaacatggagaaaccctgtctctactaaaaatacaaaattagccaggtgtggagatgcttgcctgtaatcccagctactcgggaggctgaggcaggagaatcgcttaaacccgggaggcagaggttgcggtgagccaagatctcgccattgcactccagcctgggcaacaagagcaaaaactctgtctcaaaaaataaataaattaattaattaattaaaaataaaataatcatttctcattgttttagtttgcatttctttcataattagtgaagctgagtatttatgtatttaatggccagtgcttttctctttgtaggtgttgcccgttcttgtttatttgctcatttttctattggattattcagcttttatatactgatcttttacaaattaagtcatttgtctggtatgtgatacaatatttttttctcattttgtcaagtacctgtttatttagtttatggtattttggccatgtagaagttttaattttatttttatttattgattgattgattttgagacggaatctcgctctgtcacccaggctggagtgcaatggtgcaaatgatctcagctcactgcaacttctacctcccaggttcaagcaattctcctgcctcagcctcctgagtagctgggattacaggcgcgtgccaccaagcccggctaatttttgtatttttagtagagacagggtttcaccaagttggtcaggctggtcttgaactcctgacctcgtcatccgcccgacttggcctcccgaagtgctgggattacaggccaccgcgcccagcaactcttagttttatagagtcaaatttatcaatagaatattttatggattcttggttttatgcttaaagggcatttaccaagcttatgaagtttataatttttatttccatgcttttatggtttct

SEQ ID NO: 58543 - DNA, 1046 bp, Homo sapiens
gccctctggtatctaaaatgaatttaaaaaggtaaattggttctagaactatacctaatgaagaggtctactgttttagtaagggtttgtcaatgacagagttaaccacaatattccattctctgagtacactgtaagttctgcaatggtttgatgatatttcttagctcaatataaataatattagactatttgtgtcaatagtttttttatgagttaatttatacgtttcctttcaaattgcagttttaaaaatggtattaagtttaaaaaaaagaacataaattgtaggccaaatattttatgtatgaatgctaattatcattttatctttgcagattttgaaatacatggccaaatattttatgtatgaatgataattatcattttatctttgcagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaaggtaaataatctgtatttctgttttaaaatgatatttgtaaacactcaggtccttgaaatagtcagaactttaccaaaggaaccttttgtttgggtttcgtttgcttataataagatctattggaaacgcctttctgtcacagaaaattcagattttatttcattgatttttgtaagaacttatgtttggatattgaaggaaagactttgtgagcatttctgattgcattctcagtttcttaatgttcatattttaaaaaactattttttggtaaattcttttttctgctttcctcaagggggcttgttgactgattttaggtgttaagccaaaattcaattctaaaatacatatattttacattaatcttttatttgatcctttttcttcagtcgactgggccaagggaggattctctttttcttatatgttatactattgtacatttggatgtaactgtgaagatttttttacttccttgtgaaa

SEQ ID NO: 58544 - DNA, 1059 bp, Homo sapiens
gctactatacatttgatgggaagtatgaagccaaacagttgagaactttttaccaaatgtatgataaggtaaagaagtattttttctctttgagtaggttttagtatgcgttacaagattctacttttaacatcatatttttgtcttttatagggcttggtttatcgatcttacaaacctgtgttttggtctccgtcatctaggtatatatgcatttttcggtaattaaaagggagaaatttgtgaggcttccaagtatttatgtttaatatttttaacccttaggactgcattggctgaagcagaacttgaatataatcctgagcatgtcagtcgttcaatatatgtaaaatttcctctcttaaagccttctccaaaattggcatctcttataggtaagatttattcatagcttgagtgtaccaaagttatagaattatcccatttgctaacatatttacaattgtattttcacagatggttcatctcctgttagtattttggtctggaccacacaaccttggacgattccagccaatgaagctgtttgctatatgcctgaatcaaagtgggtatattattgcattttttgttttatacacaaatagaatgtattccattattaacattattttgaatttattttatcctgtttattattgtaaaatttaatgaattataacttagttattatgttcatatagattttattaacctttaggtgatcctttttatgaccttatccagcttttcgggaaaatgaaatagaagtataagttacaaagtgttttgaaaatagtacagtttgatcttgaagtcagttttttcttttttctttttttttttggagaccgagttttgccttttgttgcccaggctggagtacagtggcatgatcttggctcaccacaacctccacctcccgggttcaagcaattttcctgcctcagcctcccgagtagctgggattatgggattacaggcatgcgccaccacgccaggctaattttgtatttttagtagagatggggtttctctatgttggtgaggctggttgca

SEQ ID NO: 58545 - DNA, 1100 bp, Homo sapiens
tatattttgttacttttgttattaaagtttatggatatgcttcaataacacattttggctttggtgatttaaatgtataaaattcacaaattcctatttccttttcttttcttttctttttttttttttttgagagggagtcttgctctgtcgcccaggctggagtgcagtggtgtggtatgatctcggctcactgcaacctctacctccagggttcaagcgattctcctgcctcagcctcccgagtagctgggactacaggtgcacaccaccatgcctggctaatttttgtatttttagtggaagtgggtttcaccatgttggccaggctagtctcaaattcctgacctcaagtgatctgcccacctcgacctcccaaagtgctgggattataggcctgagtgccgcgcccggccaagtacctagaatttcaatgtagaaaaagaccaggctatactgagatgtttttatatatattgttttgccagatattgtcataagagaaaatgtcttgatattttaattgttcaaaatgatactttataggattgtctagtggacgaagatggagttttcacagatgttgcaggtcctgaacttcaaaacaaggctgtccttgaagagggaactgatgtgggtgagcatcatatctgttgatatcatacatgttttctgaaaagtaggtagcagtaacctttgctacctattttccctccttatactttaacagaaacaaaaaaataaattatgtcttgttttgccatatgttttaaaatggagtttgggactttttcatcttttgctttgaagctgctttatttaagcaagtcagggcagtcaacagggagtgaagttattttagggctatggagataataatcagcagtattacttttgtggaaggatacaatcaagatcagggctggatgttgactgtaaattacacattccctactcactttttaacccttgtaaataactgacctatatggcatgatttatgtattagaatcttgggaatcctccagccttgaattgtctttctgtcttcctttacagattcagagaccaagtgctatgaaaacctttctttgcccaca

SEQ ID NO: 58546 - DNA, 1064 bp, Homo sapiens
tcccaaactgttgggattacaggcgtgagcaaccacgcccagccaagttgactactcttttattttttgagacggagtctcgctctgtcacccaggctggagtgcagtggcacgatctcggctcactgcaacctctgcctcccaggttcaagcgattctcctgcctcagcctcctgagtagctgggattatgggcacacaccaccatgcccggctgatttttgcatttttagtagagacgaggtttcaccatgttggtcaggctggtctcgaactcctgacctcgtgatttgcctgcctcagcctcgcaaagtgctgggattacaggtgtgagccactgtggctggcaaggtgactactcttattgccacctgttgctgcagatttagtattttctggaagtttagagcatttttaggattttcacagtactttttaattatgtctaatttggtgtttttttttttaaagttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggtataaaaagcatcctgttttaacaggtcgggcatatcattccctcagtataaaggggctgcatgtgaggttgaggtggggtttcaggagtaatagggattgctgctattatgatttagtttcataacattgtagaattttagatctggaaggaccttggacttccattttttcattatacatgtgtgagaaatgaggcataaagaggttgagtgatttgtccacatcacactgttagtagatagactttcttgcccagtgtagtcaaagttgcatagaatttggacagaactgtgttacctagtttaacctcccactgcctctgtttcctcatctatataaagtggtaataatgcgtatctcatggagtaaggaaattcgagtttccagaatatggtctgatacataataagcagtcagtaaaacttttttaaaccctttg

SEQ ID NO: 58547 - DNA, 1067 bp, Homo sapiens
ttaggaaacacaaattcaagccctggttttaactgttacttgcttagcttcataatttaaggaaccctaaggtgcagaacaaatcatttctcaagacccactgtgtatttctgtgaatccaattagcaagtgcttgtaaagtgcttcgaaaaagatatgtggtgtacgtatatacatagttttgtatacatacaaatactctttatcttttatacatacaaatacataaaatactctttatcctaacatttctaccgtatttgctaaattaatatgaaatttgagacatttacttttacttcgatattatttttatgtctttttccaatacatttaaagctgttttactgttttattttactctttacctaaacttgccagtctaatgataacattgtaaaaaaaaaaaggcaaaatgacacccatttttagaattattcttttttaatgagaatttcattagtatgaacagtgttatcaattgtaattgtgcgtatgtgtccatgtaaatgtactttactagtatctctcttttatggttgtaatctttttgttttttttttcttttggtctttagatttattcagatttttctattataccatattcatattttcttaactgaaaatgttctggacaaactatataaaatagtaatatgtaactaaatactattgtcatataactaggtagttattacataaggtttttatggtctgataacataaaagtttatctttactgttaaagtccatctaaaatgattcactgtcttagaaacatgcatttatgcccattttcctttctcattataagttcttcaaagtacatgatggtaacattatacttttaaaatctatccttcatagaataccaacttactgatatccagcttttataaggtatttcaaatttaaatttgtagagcatatttatttatttattattttttttgagacggagtctccctctgtcacccaggctggagtgcagtggcgcgatctcagctcactgcaagctctgcctcccgggttcacgccattctcctgcctcagcctcccaggtag

SEQ ID NO: 58548 - DNA, 1106 bp, Homo sapiens
ggacaagtaggtgattctctaaaatgtattttattttcgttttaaggatcttaaattggcagccaaagcccttaatatagttacttcaatgtaaaaataaaaactatcttttatactctcaaataacacatgattgtaatgaagaaggcagaggctgggattgtggtccttttaacttatttcaggcctgactctccagttaggtcccaaaccacgctgtttcttttttaattgtctgagagcctttaaaatgtgtagatccttttgtgattcgtaagcgtgatgattgggttttcgcactattgtgtgaggtgtgcctccctcaaaccttgttacagtgttggcacattgctgtctgaagtgaaaaaagaatatgtaaagtgtgattgtgtagttaaatggaaatgatgaaaaatgagattgcaacttcaaaatgcgcatttcattattatattgttgaaaattatacactttaaagcaggtcctaaatgtacatcaaatctgaggttgctgataatttgggggggtttttggagctgcttttgtgaattaaatcatttgtctgtttttttctattttttaactcctgtagctttttactgcccgcctaacatcctgtaaccgttcattgttttgtgtacagagttgctaggaaatagtgaaaggaaaagcagtccttcctcttcccctcccttattatagagacctccctggcactgctgtgtgtctaaccaccagctgtaatagaggaaacagacatgaccagggaagagattaggtatgagcatttgtgcattgaacaagattgcagagcacgctctttctttttccagttttgtttttagatacagtctaatttgagattgttagcccgcatttcattacagtgctagtatagtttgtacttacattgtgctcaaaaatatctgaataggagctttacctaaaacatttgttcggctaattggaattgaaagccattgtgtttatatatttttttctcaatgaaaaggatcaaagcaaagagcctccgtatggtgctgatgtccttcgctggtgggtagctgattccaatgtcttcaccgaagttgcaattggcccatccg

SEQ ID NO: 58549 - DNA, 1046 bp, Homo sapiens
ttgatgccaagtcttcatctgttgctccagtgtgcaggtgacggtcctaccttcatggtaatgagtccagtctgaggcgttatcctcagcctgtcagcaccccaaggaccttgcacatagggattataactcctactccttcccttaaaacactaataacattggagtgggtgggagccacatgttaaataccatcaactaacttattcatagtcctttaatacagtagtctagactctagttgtcatccacctgagaaacagaatgagatagcgtagccatgagtgctttcaaggaggtgggtacacctggacggagtaaaattgtaggagagtgtattgtattctttaagtagaagatgattagagccataggattagccactaggaataaactcaacctgaggcaggtcccatctaggtgaccataatgtataaagtattgtcaactgctgaataagttgttcttgttcaggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaaggtaaggaatacttcatttattctcttaatgagaaatatccctgatcaaggtgcaacttctacttctatctgcttcataaaaggggcacttatccatttacagtgactgctgtgtgacacagtgtgtcttggtcatgtatttgtttctgcacctatttgtagaggagtagggtaaatttcagaattctgtgctttctgaaatgtattagcagcttgacagtgtcgagaaatcaccttttttcttaaatacctttataactgttctgaaatggctggcatggtggctcacacctgtaatcccagcactttgggaggccgaggtgggcagatcacttgaggtcaggagttcaaaattagccaggccaacatggcgaaaccccatctctactaaaaatataaaaattagtggggcatggtggtggcgggt

SEQ ID NO: 58550 - DNA, 1042 bp, Homo sapiens
ccctcacccaatgatacatgaaaaaaaaaaaaaaaggctttgaggctgacagacctgggcttgacctgcagttccaccacgtatgggttgagaatcttgggcaagttaacctctctttgcttgtttcttcatttgtaaagtgaggataataaacaccatataggttttttttgtgtgtatgtatgtgacaattagaagtaagagacatcttaggatctagcaaagtgaagtgcctggcattctcaataaatactgttgatggaaatatttagttaaaaccttttatgctaattaggattgatacatttagtgatgtttgctcaggatgcaatggtataccagaaggttcctctctaaacgtgagattttatagtgtttctttttataacctcagtttatggtacaaatttaacataaactgtaactttcacatgcttccttccagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtaagaaggagatgaaagtaacaagtaacatctggagaattgaataattataggtcatctccaactttccagtggactgggtttattctaaaggtagatatatacttggaatacatctttctatggaaataataaaaacaattgccaagtttctaagcccgctcttaaaactatcttacctgatgatcttgggaactgagggctagggacagaagagggagagagattttctttctgtcctttgaataaataatggtcactgtatatgaagtttatgttaggctgacttgctcccattcctcttttgtgtccccctgctttgatacttagtaccccagtactggcccagtcctgcccactgttccccagtattgattctaaaatttcctattatgtataccccggattaaaatatttagccattcttgtgaggggttaaggaggaagtttta

SEQ ID NO: 58551 - DNA, 1312 bp, Homo sapiens
ccaaatttaacagctagaaagtctgctctgcctgagtagatgtagaactcggtgacttgggagatgtcagttaatctcagagtcacggggtctctaattcctcagctcccttcaggtgttgagttgtatgatcccattatcttggctatatatgtaatgggacaaatggggaagtgtctgacaagctttaccaaggcaggacaaaagactgaaaaagaagcctctgctaaaccaattaagaaacagtgttacaagttgaatgcctatcagaaatactcttcatgtatttttttataggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattccta

SEQ ID NO: 58552 - DNA, 1102 bp, Homo sapiens
tccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcacca

SEQ ID NO: 58553 - DNA, 1045 bp, Homo sapiens
gatacccataattacactgtatggctacattctaaaaatataccacaataaatacttggtatttgtagagctcaaagcactcttttacagagttttggttagtttggttttttcttttttttttttttttcgagacagggtcttgctatattgcccagaatggcctcaaactcctgggctcaagcgatcctcctccagcctcccgagtagctatagtttggttttaatcagtaaatatttatttagcacttggactgctctaggcactatagggtacaaaattagttgtattttatcctctcatcccagctgtgaggtaggtttgctaaagctgtaataccactaagcagttttttcaatactgttcccaaggacagataatattagcaaatcccagaagcatttctaaacacttgtaggaaaaataaagtcggacttaaaatttttagtatctttgccttttttttttttttttttttacataagttttacaagataatacatttttacagtgacctgatgtggatacaactttgcaacttggcaaaaagcaaatcttaacttacattataattaatttgctgcattttacacatctctgattctcaattttggcaagtacaacaggttaagggttctatttagtgtccccttctgatgaatatgatgatcttgaacccattcttcctcctcaagcacggtcatcctcctctgatggcaacagcagaacctctgggaaaggaacctttcggtatccagaactcccaggtggcagcccagtgtgggatttggagcatgacaacaaaggcattttctcaacatttactaaaggagagtggggtgttctatacgctactgatggggactgtacatgaacacatttaaattgaattacaacaacattttagataggaaatatagaatcttataagaacataatctaaattataaccaattttaaatagcaaagtttaacaataaagctacttaagtgtttgaattagaaataaacagtaaaacatctgtattaattataacagagttg

SEQ ID NO: 58554 - DNA, 1061 bp, Homo sapiens
actcataggtgggagttgaacaatgagaacacttggacacagggtggggaacatcacacaccagggcctgtcgtggggtggggggaagggggagggatagcattaggagatatacctaatgtaaatgatgacttaaggggtgcagcacaccaacatggcacatgtatacatatgtaacaaacctacacgttgtgcacatgtaccctagaacttaaagtataataataaaaaataataataatatttaaaaaagaccaatttcaaagtattcttgagagctagttgtttaaatgatgtgttccttttttgataactaaacaatttaatggaaaagccactataagtgacagaaaagctaacaatacttggtttaggtattttaaaatgaaacagtaacaatgcattgctctatctctttctccattttcaagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggtaatcatgaccctttgaatgttaattgggctcaagttataaaattgatagttggaataaagaatcagttaagtttccaatgaagccttttgctcttccttttattagaacatctaggtataaaaatagaacaatagaatattttttaaaacataaaattataatcaaataattcctacagtgtgccaggcctgccctacgcacagggatatagcagtaaacaaaacagacaaggttccttcatcatggacttgatagtctgctggtaggagcagaaaagcatgctaaattttgcattgaatgataggtgctatgaagaaaataaagagggccgggtgtcgtggctcacacgtgtaatcccagcactttggaaggctcaggtggcagatcacttgagcccagaagctc

SEQ ID NO: 58555 - DNA, 1042 bp, Homo sapiens
tatttagttctcaagcttgaggattctagttttgctcagagggtcgggttcagtctctaaaagacgctctgaaagcagaccaggctgttttcttggagcttttcaggttagattctcatgtgtgtatcttccatctaccacgattatttggctaccagatgccttagcaagctgaacagtgagctcagaagtgccaccatctatagtaactaatgaggctgtttctttacaatacacaaagaacactactttttaaaagtcaatatttataccactttgtaaagcttgactttaaaattggttgacagtaaatctaaaagaaggaacttaaatatgctaatgccttgactttcaaattcttgcctgtctattcagtgtggaaagtcagctgaaccagtgtattgtatcctggttcttgtttggctgacagtaactatagcagttttcctgcagggcctaattacgttcctttttaaaaaacaggatgtgggaatgagtgacacagcaatgacatctttcctcggctcctgtttggatcttcttcagatcttaatggaggtaaaagaggtgtatttttcattctgaactgctcctaagatattacatattctgcaaaccattgcatttaataaatgactattttaatgaggttgtttttcattcattcatttctaaattttgacttgagcccagaaggtagtgatgttttcttattaaattcttattgaaattagactttgtgtttttttattacaatttgggacagtgtgcaatatgaatttgcactttgctgctaataaactcattgggatatttgtaagctattatttttccattactgaacacagtcctccattctcaaaacccttaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatg

SEQ ID NO: 58556 - DNA, 1960 bp, Homo sapiens
tgcctatatatataccagtaaaaagtaggtgagaggaaagtatatcccagcagtcctggagatatgaggcaacttgttggattcagagaactagaagtagcttaggatggctggaacataggctatattagaagaaaagaaaagctaagatgaagacattcctgtgcaggctgtgaatttggattttctagtagtatgtgtaagcttagcacagggtctggcacatgtggtaagggctcagtaaatggtagctattattttatattgaagacactggggcagttttaagcagaggaattatatattcaaatttgtgtttaaaaagatgattctggcaacagacaaaatatcttgggactggggtcagctgatcttggttgttccaaggctgttgcagtaatcccagcaagtggtagtgaggtgacatttttctccaatgtctcctgtgagtttcctctcttatcaagtagtatttctgagggcagaacttttgcctcccacttattacactgtagacatatacagtaaaatcttaataagtacttattgcgtaaggaaatttttctgggctaggaatataactcccatgtgctttagagtggttttcctttctttctatttcaaacaattgtgcctttatcaacaagctgaattcttaggtgttcttgattagtagccctgaattaggctctgggttttttttttagtttttctttggtaggagtgggatggagtctcactctgttgcccgggctggagtgcagtggcacaatcttggctcaccgcaacctctacctcctgagttcaagtgattcccctgcctcagcctcccgagtagctaggactacaggtgcatgccaccacgcccagctaatttttgtatttttagtagagatggggtttcaccatgttggcgaggctggtctcaaactcctgacctcaagtggtcggcccaccttggcctcccgagtgctaggattacaggcatgaactaccacacccggcccaggctctgggtttttaggcaacacagttatttgactgtacagatttttagagtttttacttatttaatagttcagaaatatgtaatttatatttgaaaaggattattcttgagcccagtgtgagattaagtttcaccaccaatttaattgcatctactgttggtagagccaacagctaattaatgaggctgtcacatttacttatagcgccatttacggtttttaaattcggttactttttattatttgtgccatagtaatgtctttttatttaaattattaaatgttacaacattttatctttttattttaggttggaaaatcaccaaaagataggttatgccgaagggtaagtgaatctcccatagctagaattatggttgttaattccacacttttatgtagtactttattaactgtataggtgaactttgccttttatcattgtgatgacgtatcagaaggagataagaaaaatgaaaagagaatactgcattaaggaaactggtcatgaactatggccagttttaatttacttttccagattgttagatagcatattaaactaggtttttataagatgttgttcagctttgaactgtgaacaggttaacatgctaccattgctgcatattccgattagacatttataatggaagcatccaacatcaaattgaagcaggttcaaatgaagtagttaatttgatctacctatatatatgatatatataataacataagtatacaaatacaacattagtcttaactaatattctaatccatggatatgggacttgtatttgacccaagaaattaatagtactagcttccattgttgaagactttttctgatgtgttcttgagaatggttgtatgactagagtgtgtacgtgtgtgtgcatgcatgtgtgtgtgcatgtacccacaaacactgaattatttgctttggggat

SEQ ID NO: 58557 - DNA, 1050 bp, Homo sapiens
tttttagtaccataaagattgacagccataactcataaaccaaagttctgtggggttgccagtaattttaaggggatcatgagactagtaagttcaagaattgcctgaacaaagcataaactcttaagcttgctctccaataacttttgactttgaatccaactgatttttctatttctttctcatttgcttcctagattttagttaaaatgaagcatccgtgtgcttcccgtcttagatctggacctatcctcttccctttccctgcctctctcactcatggatatcgaaatcttacttatctttcaaggtccagctcaaatgcttctcctccaggaaacctttcatgattcactaactgcaaattttctcttcttcctcctaatatccacagaacgttattcctctgttgtgaagcatcactttctactgtcctggaatcatttgggttcctgtgcttatatcttgcaggaacataaacatcttacatttttagttgtctttgggggctcacactttttatcagcagctcttttaggcatttgatactggaaggactgtatatgaggtttataaatacccacatgtttatagatttttagtttacttcttttctcattctttataaaacttgtgaactttttcttattgtaaactcaccacacttcatgttgccacctagtgaaagggtaaggatgccatttgaatattaacctaagcaatggaatcaggggcttaattctggaatgagaattttccaatgatttagaagccaaacataagaaattagatcacccagcacactgctcacatttattttcactgataattgtgaatttactgtgaagcattctttttgtggaaaggtttttatttgaatcaaaagatgaggaaagactgagaaagttttggtaaacaatagagtataatttgttttcgataataaacaggactcgttaaatatctggaacgtttttcagcgtgtttacaattttttgtactatattgatgactgagacatgatataatgctgttgattagctatagcta

SEQ ID NO: 58558 - DNA, 1050 bp, Homo sapiens
taaataggtctgtggagattcacttaacattgtcagccactgttgtttataggctaaatttaatattgcctgcttgaaatgttcattatgatggagagagatgaaatttcagattgttttttaggttgaagagtgcattctgaagaaatataagtattttgatggtactgatagacaaaacttggcccttgccaaagatggcccagaaaactctgaaatgtatactggttgagtcagggccattagtgcaggactccttataaatatctgaactcaccatccttgcccatgagtctccaatctactcctgaccctcatgtttcatccagccaagtagtaatatttgtgaaatagcatgtatgtgttgctttgtgatgtatcctcagtatccatcagctttcaagttaaaagctcattcaagttaatattgattcagaatctttggcaaagaatcaccagtgcattttttattagttttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtaagctgaagtttatttgagcatttgcatccatttttttatgttacgagggtttcttttaatagaaatgacggaaagaatagagaaagaaaaatacactcagatttaaaaataacaataaccttctatatactacctttaaattaattttctctaaagtctcatttggtcagttccacgctcaggaactgctaggtgcttccctctgcctaagaaaattggcagtgattctcaaagagtggtcagaggacctcaggagtcctccttttttcacctacatgtctatatgagaccagattttcctcttatacttcaaccaaaacacagagcacaatagattgaatggc

SEQ ID NO: 58559 - DNA, 1034 bp, Homo sapiens
gtgagaccctgtctcaaaaaaaaaaaaaaaatgctaacattctagaagataataaagtaccctcaagaaatatcctaaaatggtacttttaataccatttcttttagtacctacctctagtaccatgtttggtttggtaccaaacatgcagtgtttcaaaattatagtttactttatttaaataacttcctactcatgaaacgtgatttgtaagtaaagttttaagcagaatacatgataggtattatattaattaaaaagtcgacttttgcttacagccttgaatttcagttcagataatgtgggtgatagatgtggaatgttgttttgttttgttttctgttttaaaggacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtaggtaaaataatacactggtctttgtatgcctcttcttttagaagaaaacatggtaggaacatatagcatctcagagattccatttgttttgaaatttaaataatgaaaggatttaatgtactgtattttttggccaacaaaagatactctggtcaacaggttgtattaatgagtatactaaagagacaatattggatcatgatttgctttctgctttaataaatcaagcaaattgaacaattaatttctcttccttcataatgttttgtttctctggaattccagattgtgattcaataagattgttagtccaaatggtaagtagtcattgattaatgtgctttgtttttcttctaccaggtagtttctttttttggaagtgtttgcatggagaaagctccactgaggatatgtgtcacactttggagtcggctggtcttagccctcagctgttgttggtaaggttt

SEQ ID NO: 58560 - DNA, 1037 bp, Homo sapiens
atcattttgtgtggtcagttttattatggctataagaacttgaacaatattccatgatactgtatttcaaataagattttgaggggattatcagtgtctccctttttaaagaataaatatttcttttatattagatataaatattcatacagtatatgaattatgtagtcagggaaaatattttcaaaggtatttccagataatttctttaaattttaagtattagatgaagatatttccgcttccttttttatctccctacttttagagcatcttattttatttaaaaagttagacattttgtcatgacagaaaaattatttttgctttcaaaacctggtatagcttaagcatctcagtatttaatacatcagagcatcagggaattacataatattgagagatttaatgaaagcaaagcctgtttatgagtctgttaaatatatctcttatatatacttttccttctgccttttagaacttgagtctgttgatgaaggattgctacagttttgtgccaataaactaaaactgctgcaactctatgagtctgtcagtcaattaaattcccttgattttcatttagacacaccattctctgataatgtgagtaatcccacattttatattatataaaataatctctttgattagttttactttttaaaattagtagtaaagaagtagaaaattaagaattttttttaaagctttaaaggtatattttccttaccaagccccctgctagctctctgtgctttgctgctatatttatattatttatacaagtgctgagattataggcataagccactatgcccagccatgatatgtttttgtacatatagtatataaaaatagtttgaaagcctagcaggttgtatccctgagagccacatacaggacttatatgtagatacaatgagaatatttttctatgtttttattttatagtgtttacgctgctttataattaagcatttaagttcaatatttagtttcctcagaatagtaagagttgcgtttgacaccctttt

SEQ ID NO: 58561 - DNA, 1013 bp, Homo sapiens
caggagcctgccatgagtggcctcattagaaaaaaagaagcttctatcacccaggaaattacagaggtcttagaagctccccatcagaaatggggggtcaaagaccaaatgttagaacaaaaggttctcctagcacctctgtctacaaagggattaagagctctgactgatgaactaggacagagaccaaacactagaacaaaagaaactcctagcacccccattgttcaagaaattataggaactctgtgtcaggtactggggccatagaccaatatgtatatttcttattattttatagctacatacatgggagaattcagtgaatagtgatacatgggagaatttagtgaatagtgatttctgttgcagtccgtttttaaaacactttattgagttattgtagaacagaaaagcctttgtgacttttaattgtgtcttccattctactgacaatgctaattggctctcattttgctcagggtaaagtctctgttattagagatgacatgatgatgacaaagtgggcatctagagaggcatattgagaaatctgtagtagaaagggtcataacccacacggttcttctcatttttatgccatctttcttcttatcctaaatcatagaacaacaaaattgggaaaccagcataatgcaaaatgtcttcttgattttcttttttttaatggtacttctgaatcatgtatgaagctgtgaattttataaagaatgctagaaaacccagtaacaaaagttataggtcttctaggactgactaaagggaaggaagaaaccagttcaggctttgggagactgttgaataatggggaagaaaacaagctagctgctagcctgggtaatcataggcagaactggagcaggttatgcttgtcctgggttctggcctcttacagtcactttctttattgtttcctggtagttacttcattataggcctgaccaacatcttgagccaccctctaagcccatttctcctccacaaacacgcag

SEQ ID NO: 58562 - DNA, 1061 bp, Homo sapiens
tatattatatatataaaatagtaaatatgtgtgtatgaccacctaccttaggaaataaaatcttaccaggaactctaaagagccctgagtgtcccccctcagtcccattcccttctcccatccctaaggtaactgtaatttagaattttgtggttctttctttttctttactttatagttacgtcattcctgtgtggctcctttgaaacctgttgatgcatttcctgccttttcaaactttatataaatgcagtcatgccctatgtcttctgtgactttagtttttccttcaggattatgtttctgtgtcattcatattggtgtatgtagttatagttataattgattcatttactatgccatacaaattctgctcactgactagaatttatttacactcctgtcagtgaacggttaggttgtttccagatttttgacattacaaatgatgctatgcttatccatgtacatatttcctcattcacatatgcaagagtctctctggcgtttatacctaagagtggaattgctagggtgtgagcttcttcaactgtactagttgatggcaaattgtttcccaaaatagttgtactaatttatattcccacctgttctgtatgagtccctgttactccacagcctcaatattccatggtattgccagacctttactttttgccaggctcgtggttataatatggtcaccactggtgatttcttttactcccactcctcctatccaaacccctcataatgctattcaagtcctaactccacaaattcttacataatgcttcgatccccatggataactctgaactcctactctactttcaatcaaaactggatagttaatgactacttattttctaattatttcatgtatgttaatcatagcttccccgacttttttttctttaggtcttttaagctccttcaagtaggaaccttaccaaatacttgatttttataattcacagcatctaaaataatgctactgtgaaaatgtaagaaaaaactgtatcacaggttttttcttttctcttacacagtcactcgac

SEQ ID NO: 58563 - DNA, 1098 bp, Homo sapiens
ttcttgcagccactataagagagcttactgtgttaggtactgagggtatagagatgtaaagacatgcttctctgttgtctgaaagtgtgagtctaggagcctggttagaagaaacacatgagaatggctacaatactacaacatagtaattgtaacagacaaggggaccagctgtagtgggagcagaggaggacacacttattgtttctccagcacaccatacacttttatccctagatctatgtgcatgtgggctagaatgcctcctctgtgtttgttcacttggtcaagttctactcattctatgcaaactggacactgggagagaaagagcaaggagaagaggaaggagagtgactctaaagaggctaaggatatctgacacacaggccatctttctatttactgcatagctcttacatggaatactctgtaataaaaacctattggtaaacatttcagtgtgtctacttttttgctagcataaaaatgctgcaaaattccaaagtgttaagttcagttcagggtagcttccctgctctgttaattaaactttggaacattgaaactggctagggaaaatgattggatagaaactattattctattcatttatccccagcctacaaaatgaaaaaaggtacaataaacgttattgtatgtacatctttatgtagaggtctggttaatttattcaacaaataaatgagtacctattaatatttgtgctagaaatacaagataggaccccaccctgataaagcttacgttttggtgatggggagacaaacaataaactaaatgaatatcaaactcttagtgggcatcatgaagaaaataagtaggttatggtagagagtaaaggaagagggtgctttaggtagactagtgaggaaaggcctctccaaggacatgacattcagactgagacttgaaggatgagaaggagccagctatggaaagaggtgtaggaagagcattctaggtagaggagcatcagggatataggcctgggagccttgaagacctcagagtgttcaagaaacagaaagggggttggtgtgacttgactgtaaagagtgaggggaaaacaggaca

SEQ ID NO: 58564 - DNA, 1052 bp, Homo sapiens
tttaagtgacatgatgacaagatagtggctggcttggggacattggaaaagaaggtagatgccatctgctgactgatgatcctataacaaatagtaaatagctttgctggtttttttttttttaagagtattataaaggcttttagttggtattacaatttttttgctatgagaaagaagtaattagaggagaatattttgttcagccttatgctgtaaagggaattgaggcagtttgggaagaagcttgaaaggcttaatttaatttcatggcaagactgatttaatggactttccttcattggtgtattaaggccaatggtaggaagtatagacttggggatttgctcaatagtaaacagctagtggttaataggtggtaaatgggtagtggttactggatcaggaatcacaggaaggttctgggtcaaggtcttcagttaaggtaggcagcatggaaaatttccattcaaaagagcctttgaaatgtgctccatctgttttacagaaactgttataacagtttagagaggcaattatgatttagcagattaacagggtgctggtcagatggaggccccagagaattgtttgtttacaggctgagaagtggaatatagcacgacctgattggagattcctagaacattaataatctgggatgatactggaaaatgttttgccttatttcattattttcagtagactctcatgccacctgccacacaggagacatgagcatcagactgaccagaggcggaagaagaacacttacaccataaggatatgccctaggttatcctctgaggctgggcaagggtctcctcattaggctgtttcttattaggactttggactttggattgttagaaacactcattttgctgaagatcttcctctctacattaatacaagcttagtctagcctagtgattctcaaccatgggtgatttttgcctcctcagtggatatttagcaatgatttggcatcatctagagacatttttggctttcacagcttgaggggggtgcatctagtgagtagaggccaa

SEQ ID NO: 58565 - DNA, 1197 bp, Homo sapiens
actgaggcaactggggtctggagcagatccccagtaaactgcagcaaccctatggtagagtggccagactgttaaaagaaaaccagaacccaggatgtagagctggcagtgcctgacggcgcgtctgacgcggagttgggtggggtagagagtagggggcggtagtcgggggtggtgggagaaggaggaggcggcaaatcacttataaatggcgcggaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgagtgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggagatggtggcagtaccagtgagacccctcagcctccttggaagaaaagggcccgggtagatcctactgttgaaaatgaggaaacattcatgaacagagttgaagttaaagtaaagattcctgaatagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgccgaaattcttgcagatcatcccgatgcacccatgtcccaggtgtatggagcgccacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcactcac

SEQ ID NO: 58566 - DNA, 1010 bp, Homo sapiens
agaatacttgctagttgattctttgttttggcaatttgatggttttgatgaatttgctgtgatccaggggtattcaagtacttctctgagcattggcctctggctgggaacatgcttcaacagtcttgaaatgaggtccctggctccctctgttacaaagtcagggaatgtgaattctcaacccgtgatattcttttgtaggtctcttggtatgtatttgcctcaaaaggaggcttcccaactaaaaattcacagcaaagaactccaaggctccagagatccaccttctcatcatgcatccgaccttcaatcatttcggggggcaggtagtccagggtgccacagagagtggtcctcctggaagatggagcatgttctgaccacccaaaatttgcaatttcaagctctccagctgatccaagaagtaagttctctggcttaatgtctctatgaataactgtttttgaatgacagtaagacagggcacttgccaattctgtgatataagtagcagttctctgctcatcaaactttgaaagtttctgaagttctgtattgactgtttcaagtggtgtatattccagaattaggtagactctggtggcatcatggaaataaccatacagtctgattatattaggatgttggaggtgggactgtatttctacttctcttctgagttgatgctccactcctgctttctccagctgagctttaaataacaccctaagagccagaataaacttgctttgtttttctcttgccaaataaacattaccaaactttcctttacccggagggcgaccaatttcaaggtcttccaaagcccattgcctctttttgattcttcatttttctgttttgatgccagttcctcctcaggattattttcaggtgccgacagcggggactgcttgctgttttgggtgttattcagtggcctggaggcaggatgaggtacactggttgcctgcaattgcttctgcttctgattctgaactggcttgtga

SEQ ID NO: 58567 - DNA, 1080 bp, Homo sapiens
aggtgagcactgcaggaggctgtgtagatggcagacaccaaaggcttattgctcagaggagataaaaacaaaagtcattttgattgacgacagtcccggtgaacctgaatgagattaatagtcatctgctttcctcagggctaccacgatggctgggtgcctgcaggactgctaagatccactgactgtctgatgccctctctcctgggcctgagcttgtctccaggaagcactgatgcaagtgcagatgcatttgagttgctccgaatagcaagggggtgatccagtagagctcagtgttactgcgtggggagcaatggtcaactggaccctgatgggacacccctaggacacaaggttaagaccactctaaagcaaagggcactctacttagtcatgctgttagcaaggccacgaggttgcttgacgcagtgtctgggcacatggtaagagctcaagaaatggttgttttttaaattgttgtttttataagggtccttaccgatgggtattgaatattcctctactcccttcaccgctaagattttgcttgtataattattttgaagtgatatgaattacaaatatctttttcttttttttttttgacagggtcttgtgctgtcactcaagctggaatgcagtggtgcaatcaaggctcactgccgcctcaatctcccagcctcaagcaatcctcccacctcagcctcccgagtagctgggactacaggcacacgccaccatgtccagctaatttttaaatttttagtagagatgaggtcttgctatgttgcccaggatcgtcttgaactcctggcctcaagcgatcctcctgccttggcttcccaaagtgctgggcttataggtgtgagccaccatgctcagccataaatgccttgtcttttttttttttttttttttttttcctgacagtcttgctctgtcgcccaggtggagtgcagtggcacaatttcagctcactgccacctctgcctctcaggttcaagagattctcatgcctcagctttctgagtagctgggattacctgtgtgcaccaccacacccagctaatttttttg

SEQ ID NO: 58568 - DNA, 1511 bp, Homo sapiens
tcatccaggctggagagctgtggtgcaatctcagctcactgcagcctctgcttcctcggttcaagtgattctctgcctcagcctcctgagtagctggaattacaggtgcctgccaccatacctggctaatttttgtatttttagaagagacggggtttcaccatgttggccaggctggtctaaaactcccaacctcaagtgatctgcccaccttggcctcccaaagtgctgggatgacaggcaagagccaccacacccagcctcttattctttaacgtaggtgtttttttaatgaaatcacgataaacttccctcttagtactgcttttgctgcatcccataagttttgctgttgtatttttgttatctgtcctggagaatgttctgtgtgtgcttgagaagaatttatattgtgctgctattgggtggaatgctctgtatgtctacgtgtccgttaggtcaatttgttctatagtgttcttcaggtcctctgtttccttgttgatcttctgtctagttattctatcattatcgaatgtagggtattgaaatcttttattgttgtgtcgccgtctattcctgccttcagttctgtcatgtttgcttctgttctgatgttgggtacatatgtatttataattgttatagcttcctcatgaattgatgcttttatcactacgtaatattcttctttgtctgttgtgacagtttttgacataaggtctgttttatctgatgtaagtttggctacctctgctctcttttggttatttcatcctttaatttttagcctgtgggtgtccttaaatctaaagtgaatctcttgtacacaacatatagttggatgttatatttttaatccattcaacaattctgtcttttgattacagtgtttaatccatcttcatttggtgcaattagtgatagggaaggacttactattgccattttgttaactattttccgtcttgtaggtttttgtccctcttatcctctcttgctgtattcctatgtgtttcattgatttttttgtagtgacctctagtgtaagctgggttctatcagcatctaaaaccagtccctctggcagtcccctaaaaatcagagcattggatccgtgctccactctttttccccatctgttgaatttttaatttcatttatcatatttttaatttctaagttttaagatttttctcttaagcttgtctgcctttttaagtagattcttggactttgcttattttatgatttcatcttcatttccttgaacatttaatatatagtaatttgcatccttgcaatttaatatatagtaatttgtttctggtaattccattatctgaagtccctaggaggttagatttattgttgatatctgctaattctcattcactatggttgtttcttattgaattgctggtatttgatggtgtcattcactatggttgtttcttattgaatgtgctggtatttgatggtgaactcctctttgcctgattgttatttgt

SEQ ID NO: 58569 - DNA, 1024 bp, Homo sapiens
tgacacctagcagaagtgctagctgctgatgctgctgttattattccatttaattaaagcttgaaagaagtaaatttgccagttttaagtgcatctcagggttcctgaattacatggttttcattttttaaatttctgtattttacatcatggatttattcctttttataccaagaaaaagtattacatttacaacatgaggtctttctgttttactagaatttttgtagtaagtgtaagagggccactgtgaagctgaattatctgcaggcggcttggtaagcagggaattagagcagagtacagaagaggagagttgtttagtgacatagatgtcctcagtgggaatggacgtatttgtggtgttacataatgtttaagagcacaaactttgtagacaggacattcctggggtttatcccgagctcagccttttacaaggtgtattacattgggcatgtctccttatctgtaaaacaaagataatacacacctggttggatggttgttgggttttcattggtaggcttatataatatacttttgtaataatagatgttcagtaatggtatcaaagaagcaaggaatcaaaccaaaatgatgagaaagttcacagttgttgatcaggatgtatttctcttaccccacagtcgtgatacaactaaattcatgttctttgggcttgccttttctccatgcttaccagtttcttcattttaatgcattcattcttgagactgagtacaaatatacttgaaatgattacagctttaaacatgctaatggaatctctctcttgagactgcattgattttactgaacccaaatataaaggcaagtcttaagtcagggatttacagcttgaagataattttcataatgtcattgtgtatgctggaatatagtattcttctgttgtcttttctgaatcataatgcttatatttttgccccttagaaatgatagataatagtttgatgagctagaagcagagttaggagaagctctttttttttcttgagac

SEQ ID NO: 58570 - DNA, 1188 bp, Homo sapiens
ctcaaagcatgagcctgctttcattctttatttgctataaaatgagttcgttgcctagaagcaatgctatgtggaataccatgatgctaaagaaatactataatggtgaaaatgtattctgtaagtccaccagtgaaggttttgtcatagcattgtggacagagaagacaaatacatgtctgtagcaagtatctgttccaatgagaatagacaaaacaccttcccttctattatgaaagtagtctaaaataatcaacctgtcactgggtgactgggtaaccttctcttacccacctgcccactccaccccctgccgcctgccacccccaggagtggtgctattttgggagctcagtgttgttctatgaagctgacagattagccttagtgaatgttcatctatgttgctgggcccatgcataaccttcatccctgccatcatggctactttgttcatgaggccattgggcaagaatgggtggctggagaaagagagtaactgatgtatacagcatgagtcatcttttctgagtatgtacatgggaaacagtgatctccatatgctgtgctcattcagggagatctattcacagatttcctccttgttactaattttcaagtcatactctttctaagtccttgatcattcagccaagccattagcaccagtctgtgaatctctatagatttatactacatactctctctctttctaggcaaaataaacaaccaggtacactgctcaaagttccgcctgtactcttcctttggtaccaccccagagtgggactctagtgctccatctacttatgggtggtaccagcatattgtgcagaaacaactgtaaataagacttgtattgtttctttcttcatcaccaggtcctagggaactccccatgaggccatacttgttgatttagacatcaatgtagcaggggagcaggagtatgggtcaggagcatctcatgcaatgtaatttgttccttcaagacctgctcaagctttatctaatacataccatttgcatttatagtggaatgttgcagtgcatgcccaactttttggcttgatgaatcggacaacacccagctcataatgggaagcttatgttgaatggtaacttggtggcctatggtcaattgctcagtgtttactagagttcggtagtaagctactagctgcttcc

SEQ ID NO: 58571 - DNA, 1038 bp, Homo sapiens
tttaatcactgtgctaaagtctgtaggaatgaatgaataatcaaaacatatttttaatggaaatatttttaatttgaacccccatctttttttgctttaaaaaactgataatccagtttatatagagagagccttccttctttattgtgctgtcttccttttggttatttcattgtaaatcagtacttccgttagaggatagcagtggaaaagagaagagttgccaggttaaaatggattacatgcttatttattaaaaacattagtttagtgagagacaaagtagaaatcattgcattaaatggcctttaaatagcctgtggatttaatttctctgagttctctgtgatcttaatttaatacaaataattgagggttttttgttttatgtgtttttagtctgtaacttctttttgtgtcttggattgaaacagtattcattaactaaaggctttgtgacatctaatgagtatgaggtactgcactggggaagcccagtcgtagggctgtatgtatttggatgtttaatcctttgtttcatacatgaaaatctgttgtgagctgagtatctggtacaaagtgttttgtttggtatgagacaaatgagtcagcactttttctgccctttggagacatacaattaattatttaattatagcgataattgttaagaaggtaaaaaccagatgtatatgcaaattgttttctctatatattatccaattaggtctcggatggtacaaggtagataagagatctactgaattacaactcaggtggcctgagaattgctgtttaatgttgggaaacaattctagctgacagaaacatagcatcctgtgtgtacctttcttataaagtaccatatcatatggaaactgttagtttttcctactaacctttaatattttgggccatttcttgtaataatgtttatttcttcagcaactataggttgtcaattagtattggttaaattcaacaattcaactagacaatgtaatgttgaagtgtagggacttcatcttattcctgaag

SEQ ID NO: 58572 - DNA, 1046 bp, Homo sapiens
tttatggctcttcagagccttcaaacagttgtttttaatattttgtctacagattatatttttgtctgctgataggtttagttagttacaaactattctttgttggaagcagaacttccctactcctttaataaaatgactttgagaaatgaaagtttggttattgtttctaaattgcaatgacctgtattggtgctaatatcacttggccaaagggtggttgtggtatgcaaaaatagcatattccaaagtcctgagagcagagctgtgacagccctaccttcaggtctaatatgttatctgactttttaggagtatttgaatattcggtcaccaagcagatttagtgactgtcataaaacattgcaatttttaaaaaatatttctaaggatgtatagccagtgagtagaagaacttcatttcagtcagtattaaaggcggggaaaattctcttattactcaggaatttgagtctggtgctccatgggatgcagcactgaagagctaatgaaatcattatctctgcttactttgactacactgcacactcagggcaagctttagggtcacattaccactgctgcagaaagaataaaggaattcacagtctactggattaagtggaaaacttgaagaaagaatgacaggattggaacttgtgttttcagataaaggtagaaatttaaaattcatagacatgctgtaattgagctaacataatttcttctatttaacagccttaggattgaggtagttccaaattaaattcactgtttaatctagcatgagctgaattgatattcttgccacattttctatttgagaattaagctattgatcaggaaagtgagatcagctatcccaaactgtacttcaaagagtccttccaaggaaaggttgtctcctaagtgatgctgtagcaatcctaaggaaagatgtaatttttgaaaatatttgttttggtggatatcttataatcagaatatataatatattcagaatgtataatatatgtaatataaaatatatgctgtgtattctgatt

SEQ ID NO: 58573 - DNA, 1034 bp, Homo sapiens
aattgtacacagtgtccctgtccatggcccacatagcttttctacttttcctggatttagttgtgggttactctggcaaattgagtgatttttaagtggcatctagaactactcaggcctgttgtgctagctggaatacacagcaatgcgactcctactctgtctttcccaaggttgtataaacaaagttgtacttattgaaacatgtgaacatgaaactgaatgttgctttctttatctgaataactaaaacgtgtacttgatgatgataagtaatttctgtcataaaatctactaatcttgttgataaagtattgcttttccaaataggcatataaaaatgatacaattttgttttctttaacccgtgaaaataaagatgaagactcactaaatgtagccagtacactgtgtgtgtgattgttttttgagtgatttacatgtatgttgatagatttgctttcttttagaagttctgaaggaaaagcagatcaagtcttcattaattctcatgtgtttagaacattcagcatttgacctttcccatttaggcagtagcatctcccagtcagtcatacttaaaaagtaatggaatgtgaaacaatccatttttccctagcattgaaaaagacagtaaaatttgcttccatgtcttaggtatactcataaaaggcaggtaattatcgcacatttatatgaaataaggattcattgtaatctcacttctagaagtgtttgggtaaatttgttctggtttgatctgaatttaagctgatccctctcctttatcctcttctgtgtatcagatatttataggaattactgccttcctttgcaaacatcaatgatagataaaagaatctaaagttgatacaccaactgcttaatactgccaaaatacaaagttcttaaacgtgtttggtttttggaattgttaagtatctttggcttcaatattgttcccataatatgctcatattatttgtattacatattttgaattaatggaatccaattcaatgagttttcatagt

SEQ ID NO: 58574 - DNA, 1039 bp, Homo sapiens
tcatccctgacatttctccctctttttaggacaccagtcatattggattggaaccccactcttctgaccttatttaaccttcattagctccttgaattccctgtctccaagtatagtcacactgggcattagggattcaacatatgaatttaggggggcacagttcatttcataacagggatccaaatccagctgacaattcaagtgtttctttgtgaggagagatgcttgatggaataggaatctggtattccattatccttactcaatataccatgtaaaacatcctaatgttccttcttacagcaaccattcttcgacaactgcctatcatttttagtcaacacacacccaaacccacgcacatcttcttgttatcgcttatgtttttttctctctccttgtccaaagctgctgaaggagaggaaactaaggattaaacaatatactcaagacatctttgagatataggaacccaatggctgtgtattgttgttttattggaattaaaaattccagttaaagttctgattagaactttggccctgcctacacgtctttttcttgcttcttcagatggaagtggagtgaccttctgtttaggtgttgtttttgttatggatgccccagttttcacaaaatgattttaatcctgtccctcagctcatgtctgttctttgtagaacggaataactgcattccaggtaccagtcagggattgaatttatgaactaattgcagtcaaaaacccaacttaagaaataattaaataaaaaaacaccccaatacttttggaggaattcctgaagaatttgctgccagtctatttctttagattagttgttctgaaacatggagctgccaggaaacatcagtatgtttctgttagttttgagatatgtcccagccgattctaagagaaaactaccaaatttgccagtaatttcataaaaagtaactggagtaaattcaagattattcatatgacagtgttgtcttcagtatactgtaatttgatgtactttgtcaagacaagaga

SEQ ID NO: 58575 - DNA, 1023 bp, Homo sapiens
cacaggagaaggacagatgagtgattaagacgaggttttattcattcaatttacaaatatgtactgaccatttagtgctgggtacttttaggtgctggatatgcaatattgaacaaaccagacatggatcattctttgattgggtttatggtccagtggtggagatacatgattaacaggtaaaccaaaatattacataacaacaagctacattcaattgtaggcaaagatcagggtgccatgaaagagagtaacagaaaggtcccaggctttatgtggtcattttgaaataaaaaggaacttaggtgggaagataggggaaaacattctaggcaaatatccttgtcttttattccgctgagaaaatagaaaccaaaagtcatgagtactcttcacttaccattcccataccttaaacattactgttgagaccaactgatgggagggatggaaggcaagcaagatgacgcagacacagggcaccaggaggaaagtctgttactactacgacggggatgttggaaattaatattatagacaagaccatccaatgaagcctcaccaaatctactactcacaatttgctgcccagctatggtctccactgaacaatagaaatctgtcaccctcacaaacccagtactgaggagatgaccaagtaccacagggatgactacattaaattcttgcgctccatctcttcagatacatgttcgagcacagcaagcagatgcagattcaacgtcagcaaggactgtccagtattcaatggcctgtttgaattcttacagttgtctactggtggctctctggcaagtgctgtgaaacttaataagcagcagatagacatcgctgtgaattgggctgggggcctgaaccatgccaagaagcctgaggcatctggcttctattacatcaatgacattgtcttggccatcctggaactgctaacctatcaccagagggtgctgtatattgacattgatattcaccacggcgatgggatggaagaggccttctata

SEQ ID NO: 58576 - DNA, 1114 bp, Homo sapiens
ctccgagatgggattgacgacaagtcctatgaggccatttcaagttcagtgctcttacagtgtggctcagactccttatctggggactggttaggttgcttcaatctgatcatcaaagcacatgctggcctgtcgtggtggctcatgcctgttctcagcattttgggaggcccaggcaggagaatcacttgaggtcagaagtttgacaccagcctggccaacatggtgaaaccccgcatctactaaaaatacaaaaattagtcagacatggtggtgcacttctgtaatcccagctattcgggaggctgagtcatgagaatcgcttgcaccctagaggcggaggttgcagtgagctgattgcaccagggcactccagcctggagaactgagtgagactccatctcaaaaaaaaaaaaaaagggttgaggggggcatgccaagtgtatggaatttgtcaagagctttaacctgcctatgctgatgctgggaggaagtggttccaatttgtaatgttgcctagtgctggacatatgagacaggtgtggccctggatacagagatccctaatgagcttccatacagcgactacttggaatagtttggaccagatttcaggctccacatcagtccttccagtatgactaaccagaacacgaatggtacttggagaagataaacagcgactgtttgagaacctgagaatgctgccccacaaacctgggtccaaatgcaggtgattccagaggatctgtccctgaggagagtggcgatgagagcgaagaagaccctgacaaatggatctcgatctgttcctctgacaaacgaattgcctgtgaggaagagttctctgactctgatgaggtgagagagggtggccacaagaactcttccaacttcaaaaaagccaagagagtcaaaacaggatggaaaagagaaagacctagatgagaagagcaaagtcacagaagaggagaaaaccaaggaggagaagccagaagccaaaggggtcaaggaggaggtcaggttggcctgagcagacctctccagctctggcttcttgccaagtcccctgcctttctccaccaacacctcagattttatgctttctatttct

SEQ ID NO: 58577 - DNA, 1038 bp, Homo sapiens
tttcattccccatgacctcttctttactaatattttagtaaatgatgattttaaaataaggcatatatttggcataaaacaggaaaaaattataatctctgtattaatcttaaatgtaaaaatctgaaacagaagttaaaatctgttttataagaagtaaattcttatgttaaaatatccaaatttgaaaatattccctttgaaggaataagagaggcatgctattttgaatcaatgcatttggtgagtgtgtagggagatagtcatagttgttgtgtgtgtcccaaagtcttacacctctttttggcccactaatcaaactagaaatgtcacatgaaacttcttgagtgaactagtaattttacatttgctaaaatagagctataataagtggctgaatgttctgattgaccacacataatgtagagtttatttcctagcaaataatgaaagatcgatggatgaatgttggtcatgaagaggaagaactaaagccatatactgagcctgatccggatttcaatgacacaaaaagaataggtaagtatttaaacatggtaagaagtgctgtccctaggcaacaagtaagagtcctttagtgtgccaaaatagtgtttaagagtataaataggaagcaatttttatttgaaaaatacttgcattgtcattttaatgataatatgctgaaaattatacatttcaagttccctaatttgttcccatatatattatggtctaattcaatgtttgacaacagtgatataaaacctaatgtaaataaatcgaattctttcctttcagtgatgcccagcaggaggaatggctgatgtaactatcagcactgatcagactgataagcatcagcgaacatagcatgtattttaaccaaagacatagaggcaccgaattaagagttgaacactttggctctccctttctttttccactgtcttagcaatgtttattctccctcctcactcgtcctgctactgcccatacccaaccagagctctccttctaacttgttctcttcatttc

SEQ ID NO: 58578 - DNA, 1024 bp, Homo sapiens
gggactgacctgatttttgaaatcaaaatttaatcttcgttcagagtttaaagcatgcaaatatggataattttaatacagagtttttgtttgtgagcagaaagtagatcagttgtttttcagctcattatgctatttttaaaaaaattatagctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtgtgagtaaatactctggtatattgcaatttattgtaataacttgttttagggttatgtgtaaaatttttatctttcatttttttaaatgattgaaaaatttaaagggaattataatttaaagaacatgcaaaagggaccacacttctcataaatgcaagttaaaaacaacaaaaaagaattcttttttgcatgcgttaacacttaacctcaacacaaaatggtacatgaaactttcctgcttcattttcctttttataatgtttatttaatattatattggcacatttcatttttatttaccaataagctgtttaatgaaggcagactcagttaaataattaatttataaagttgcctcacattattcacttaaaacagcaaactagaaattatataatgggaactagaagaagatgctctcccataaggcagcaggaaagaatagagataagaaaatataaaagaaaactaagatatacgaaatgtagaaataagacttggtaacattcagataataggtgttttgaaaggaaagggagcaaaatgaaggaggagaaatagttaaagaaataataacaaaaaataaagagggaagatttcattttgaaaagacccagagtgacaaatagaagccagaaagaaaacctattcctggactcttaaaatagaatttata

SEQ ID NO: 58579 - DNA, 1032 bp, Homo sapiens
acaccaaactgtgactttggggaagtaaaaaatgactccagtcataataattttatctgaaactatcgtatatccacaaaaataattttgtactttctcacatttacatacatagtgtgtgtgagatttttttcatagatgatagtgataaattcaccctgtatacttttcataagaatattaattgttttgttagtcattaataatgccactaatgttagtttctttcaaatgtttcagtcatgaaaggtgttagtcagtttagattttttaaaatatagttcttaaattttagtaaaccacaaattttcctctttttttccatggtcttctcaactgctttatggtgaaagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctgggtaatgtgttggttacatctcattttgttcattaagagtttctaaaaatatagcaccatgtgaaaatacatgatagtcaccatcacattaagacctttctaataagattcagtgtttgttatggaggaaaaattgaattgtaacataaactttctatgtactttggctgttattggaaatgttgcatataacttaaatcattttctagaggaatttttttaaggatttgattttacatccgtctataaagttaaaaattgctgtttaatttgtcatttaggtaaattgatttttttattatttaaaccatacgaacaaacactagactgtgagttgagacccgcagataatgatcaggctcaattccttgttcttaataaaaccaggcttcagttttcctgtcaatgaaactgatgaactcaaagagcctgttcagatataaaattgtataattgtttttctagtatttttctattttaagatttcccaaattcagtacatctgaacattttaa

SEQ ID NO: 58580 - DNA, 1024 bp, Homo sapiens
gcagaggctggcctggttccgcttggaggcagcaacattgcaagacctttgtctcagactcaaactcacttggccaacctcatcttgttctacaacaaaaggacctgaaagctattttacttctcccagggccacagagacatatttaacagacctgcagaagcttctaaccaaagcagaacccccagacaagcagcagggttgactaagcagtgagggagagtctctgagccaggctcatgttcttgtttttgaaactggagattgccatacatcagccagacactctcccagaactgtttccgccaaataagctctttctggggtcaccaacttttagacccaaatcatttggccagacctggataattgtctggaaaatgattgttaggtcccaagacggggtgggtggagagttctgaggaagtagaaagctggagggaagctgttgggaggtggaagaggattttctgagtgtgccctggtttgtttctctgcaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggtgttccgcttgggggcatccacagaactgcaacaggcttggtttctcttcaggctcctccttgcattctgtcttgctatagtttctacagtagaggatgacattggtaaaggaaacatttaagagaagtgcagtttgagttgggattgggcatgagtggatgatgcagggtattgttttcagggtacctaggatttgttttaatcaggtatggttagacacgcagacatagaaatgactgtcctgaaaaaagaagatgttataccaacagattctctagaaactggaggcacgctacgccacgcaaggccaagtgggggagtaccagggtgggtcaggaggcagaggga

SEQ ID NO: 58581 - DNA, 1168 bp, Homo sapiens
ttctgccatgagctaaggtttaaaatacaaggacctcagggaatttctctccatagcccctaaactacaagctccttgagggcaggggtttttatctgctttctttactgctgtttccccactagaacagtgcctggtaggtgctcagtaaatgcctagtgagtgaatggtgttgttgaggaaattattactggagtatagctgattggcagcaggtcctcgctgtttgaggatgatgggggaagggggtcgctgctggagtgggagtgggaacccaggaagaggaagcctggtgagtgacattggcccagagccggccctggctgcagccctgtccctgtgtatgggcaggaactgctccagctcctggccactgcaagcccaaactcacatctctctccttcctgaacactgctcccctcttctgcactgaagaggttttgcttctggacattacttagctttgtagttggtctaggccattttgtggagtggtggggcctgactatcctgtgttcttggcaaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggtaagcgacccactgcttttgtgcatcatgctcagatgtgctgctcgcggtgctaagggaactctgctctagccagagccaactcagatccgccagggtccagtcattcactcattgctgctgccatcactcattgcttgcggagttgttcacccattgttgctgccatcaacacgctggcctcggggggcgttgctctcacccgttaatgcttgggccccaaagcaaacagtcaaaactcgaaattgtagcaaatctgaggttggaatatgtaatcatagctcagagataactgagggaagcgaagataaagagaaagataaagccattttccacttctctatcactcagcagagctctcaaagatttgagactttcagaagacccatgccccaaagtgcagaccaagaggacacaggcaatctgccccggagacataccatgctgtggcctgagttctctcccagggcacccacatgctcttctatgggattgacacca

SEQ ID NO: 58582 - DNA, 1052 bp, Homo sapiens
agtcagtggcagtgggatcaggaccccattagcaggctgcctgtctgtgaaggtggcagcaatgaatgtgtgaatcatgactgccttctcttgggtgatgtccccactcttcaaagaaccttcagattgtaacttgggttccactgcagcttagctacaagggaagtgtgggtttgtcttgcaagttacacatttctcattgtatatctacacattgactttcctgttaatttatgactctcatggcaaactgcactctatagaagatctgtcatccctgcgatgatggaatcagggttttgagactgggagtcaagaggtggacctgaacttgccagcattctgcctccctttgagtcctctgggagatatttcttggtgtcaccttgtgctgctttcttctgctataatagtttcatacttaatatgagccaaagaataaacagactcaaaggctaatgaagccaccatttaaaagataactttctcttttctcttaggatacctgggatgaactcctaattggtagtgtagaagtgaaaaaggtaatggcatgccccaggtaaggagcctagctagaccccaggactgtggtgtggcccattcattggttcctaagcatcacctaacccttggttactgcataacaggtgtattttgacaacggtggacccagacactggagtcatagacaggaaacagccactggacaccctgaagaggtagaataccaccacagccagtgtattttaaatattatctccaccccagaactacctatgggtttaggtgctatgtctgctttagggaagatatgacctttctctccggagaaccttccagtctaccttctgactgattcgcgtctattggttaatgagagcactgttgcttcctctctttttctggatggatcctctagtgctttggataaacttttttttttttttttttgagaggagcctcactctgtcccccaggctggagtgcagtggcgtgatcttagctcactgcaacctccactttctgggttcaagtgatcctgcctcagc

SEQ ID NO: 58583 - DNA, 1168 bp, Homo sapiens
agacaggacactggaaaaagattaacatctgcagtagtccagacccatctgccaacttcatgtctgtctgaatttttgttcaccagtgaaccccagctttgggctcataaacctggagggggttgaaagcatggtgcttaaatgcactaaacagaagatttgtagagttcagggccattccattttgagttttaggggcatttgtttcaatgagttgtgaagttgaaggtacccatatagacaaagtatttattttatacttacacataagtttttttctttttggacttaaactgaagccatggagaaattgcgtagactttcaggatacttctagaaaaactagaattatttgcagtttgactaattgtccacagacttctctcgcaacattttagaaaattcttgctgtgtatttataaataacttggaaggcaaacttgagttctattgagaatacttcgattattatttcctttttgtgtctgatgattgaatttttgcttgtttcagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggtaaagggtcagctttgcttctgaatacgctgtcttgaagccattgctgcattttcttgtgttaattttttttatgttatgctgctttaattcttgagagaatgaacagttttatattctgatctttggagttggaaaatgcccttaatttctgttccctgcagtaatttgtgtactcctacctcagccttctccacccctatttcccatttaatggtaaaatgctgatggaagaggctcagcagaaagacaggtatatgttcacagctcattacagaatatcattaaggaatagggaaatgaaggtgattgattctcagagttatgtacattctcagagttatgtatttattttttctgtctcagatagaagggaaaatgtttaaattattcaacatcagcttgggaaatgtttaaattgaatgtcttttatcaaatgtatttttaaagtataattgaagtttgaaaaaaaatcagtgcatcatggtgactgggtcctg

SEQ ID NO: 58584 - DNA, 1054 bp, Homo sapiens
tccagtcatgattgactggacctggatcattgtgtgagccaagggctttcatgtgttctctgcatctgagggagcccaatggctgtgagataccataacgattgagggttttccatatcactccgtcacaaactcatccaatcagatcctgttttgcagtggatggaggcaacaaacatctgtggttcactcagcctcaatttccaattgtctctgctgcccagaaggccttgtgtaatctttatctgtgagaggatctctgtgagatagatatgataacaggcactttatggatgagaaacaaaggcttagataggtcagctgacgtagggcctgggagctgatgtgagttagagctaatgggccatgctttctgcacagcactgcaccatacatttatatgtgtaacctcaataagtgactgttttgtgggagtttgaattatttatgaacagtaggataaacaaccaaataaccagagattcttattatttattcaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaa

SEQ ID NO: 58585 - DNA, 1031 bp, Homo sapiens
agaatcccagctttgagaagagcaaggaactttagagggcccctaatccagtagttttcactgcaggctgttcattggtatcacctgaaggtgatttataacctatgatgcccagttcgtgtgtccagaaagcctgattaaattggtctggggtgcagcctgcacatcaagatttttttaaagctcccaaagtgattctaacaggcagcaaagtttgagaaccattgatctagtccggtattctcattatgccactacaggaatggggcttgtccaaggtcacatgcatgattaattttagagatttagtccttaatgttaaagtaggtcttgccaggttcaacagattcaatagatatcaacagactgaggtattcgtatgtatcattatttaataacaacagaatctaatatatagcataaaatataagattttttgagtactgatgccttttttcttgaattttgagatttcagttcagaactaaaaagaccaaagtctgaggactttcaaaaccagcagttcatggtctatatatttacctggatattagaatatggaccaaatattaatgttgatttaatctcttcatctggggaacctagtggtttaagctgttaacctagtggtttcagctgttaacagctatcaaaacaggtatcaaagaagcccaaccatcttaggcttctagggactttttggtaggtggtctccacagctgtacaaacttgtgggcagaggagattcatttgtttgttcaataaatattgttgaatgcctttggtgtgctaggcactaatctgcaggctgggcaatctgcatcacaatgcttatcattcaaatgcaagaaagacaacatatatggatgggaccagtcttccagatcctttccatcttggaaattgtgttcatgtttctattcttcatcttcttctgccacacaatcttatttagggagtgtttcatcttcacgaaattttgttctcctgtgaagcacatgtttgtactttttttttctttttctttttta

SEQ ID NO: 58586 - DNA, 1050 bp, Homo sapiens
cccaacccattgttttttctggcctcacctgacaacggttggcatcatggctcctcccaagatggagtaatgggtcacttgccccagtatactgaatgcagaataactgagattagcagaactgagctctggcagaaggaattattcaccactcttctcggagcaccttccataccgtgttgcctaacctttccaagtagcctgcatcctgtgcccagcctagttgcacctctttgccctcagatactgacttttggggcactgtacatcactctcattcggcatcttttacctggtggtggtagtgagagatagtcgtcttctctcttctctcctcttgtgttctgagccaaggtacgcagtttctgggtcacatctccaaccagtctcctaaagtgtgttgaccaaaggtgttgctgagtttgaacacattgcatatttaaattgcaataggacatgtgggtgagcaagttagttattttgtctctatgggacagctttgccattctccttcttgtcttcccagtggggcattctgccttttgttaagcagtgttctgggaattatagttctgaattccactgacacaatctcctcttcccaccctccgctctcctcaaacttgccctcatggggctacactaccacaaaggcacatctctccttagggctggtgggctttgctgggaaggagaacatgaaagaattgtatgtagagagttccagaagcttctagacatttcctggtcgtggtggttgtggtgggttttcttgaggtcacaaatatgttcagatttcctccatatagctctgtattttattgtttctgtattcttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagt

SEQ ID NO: 58587 - DNA, 1128 bp, Homo sapiens
gagaatggtgacggtcgtgtgtagacggatgatagatggcatttttcctgatagctcttaaagttcgtttaggtgagcgtctcttggcgtggggtttggcgtctttgctatgtgcatgtctaatagaagaagaagagttagcaagcctgagttgtagagtgcccctgtgcctacaggaggaaggagctgtctttttgcagacactctgaaatcagagatagatccggtgggcaacaattcactgtccctttcaacgagtacaggctaattgggaggtcctctttacggaatcagtactcttgaaggggggatatctgtatgggattgaaaccttatacaacgtggctgcctcccattgagagaagctctaggatgcacagtctgtgccagccagggagatgaagaggggaggagagcccaagttgtcctttccaggcaggaatgagggcgggggcaggtgagagagcaaagggtgagggatttgccggggctggggtttccaggtttccagatctggctccatggcttgagatttcgttttaggacaccagttagtagtgaaaaggggaaatgcagattaatttataagaggccaaaagacaacatgtgaggttttagtatgactatgttgtgcttttcaaaggaccccaatagagaatggaaggcaagaatagctccaagttaaagagattcacttaaggggatttgcagaaagttgacatccaccctgatgtatatttagctgctgtacctttctgtgaaccatgccagtgctcttggttacccctttgcctttgcagcgagtgagggaattaaatggcaagcatgcaagggtggacaaatgggtctttctcagatgtttgcagtgtacttctgcccgagagctgaggttcagaatagatgcctcttaagagcctcccttctgtcttcagcttttctaattatttgtgcttataccttctctacagctgaacttttatgtaggtccaggaaaggttgttcattaacatttacaacattacatccaaatttaaccttagacttagcaaccaaattgattggagccctcaggtttgcatcctctttgaatacataaaaatgaatttcaagttttgataatggtatgat

SEQ ID NO: 58588 - DNA, 1020 bp, Homo sapiens
tatggagtaggagtaccattagcttggtttttgcctaccaaactaggttttcatctctactgaaatgttgttttctgattatatcttaaaatgaattggtctgtagtttctggaaatagctttgtcagtatccatgttatgtaatttaatatagcatcttttaaaagtctgaagtggaaaagatttagtgtttgttttctcaatcttagtttatgtacttaaactgtggtttttttctccctagactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctaca

SEQ ID NO: 58589 - DNA, 1618 bp, Homo sapiens
aaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattgagatcttttgtttttcgacaaatatttttatacttactaagccagtagcagttaaaacagtgcaaaattattcttcacagtaatgttttaaaatgacagataaccaggcatggtggcttacgcctataatcctagcattttaggaggcttgggcag

SEQ ID NO: 58590 - DNA, 1026 bp, Homo sapiens
accttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcag

SEQ ID NO: 58591 - DNA, 1033 bp, Homo sapiens
ccaggctacttctccctcactgttcctgccctggggacatctccagcggggtctgagtttccccgggctccagttcccgcgggatagacctccatggttccaccttccactagggaccccagcaacgagaccccttcatcccaccagcccaggagcggtagtggcttcctgctctcactaatcttggggtgttcctgctggcttctccactttgccatcacctcgttaaattccatctctttagatactcaagtcctggttttccctgaataatcacagtttgtcagctctgaactaagccctcaccagcatttctcgagatagccctcagagactcttgttgtacagctgaggaccctgaagctcaaagatgcacagggattggtttagggtgactcggctggtgagtagttcagccggaattcagacctaggcctgtctagagcatacctgggcttctactcactcctctagttgcttctgtgagtttccgtttccccttctctgaaagaaccaacaagatctacactacagtgttgtttgaaggactagagagtgcctgtagtgtgcctccaaccctgcttcacacgcatcgggacacctccggcagggtggcctgctctgcagggagggccatcttgttttccaagtggcacccactgctgccagtgagtagtttcagtggccagtgtggagagggcacctcttctggcctgtatggtgggcagtgcctgttctgcactggccagggtgtttggttaccccaagggagggaatcaaaagttaactctttttcgtttaggtttttttttttttggtcagaattcttactggtttctgtgagtgtgggtttgaagttggcactgatagaatctgtggtttgactgtttcttgaagaatgtttaagcagcagcactgtttatttctgagtcctcatccaagaatgagctccttgtggcataaaaagcaccgaactcccactgaagccgtctttgtggtgacagagatggaaccgtccttacctcgcaaccta

SEQ ID NO: 58592 - DNA, 1045 bp, Homo sapiens
tgctccctcttccttgggacagtctcccctcgcggcttccatgatgcgccctagtctcctctgccatctttttcgtccctgtagggtgtctcagcatttggactgggtcccgttcccttttctgtctgccctctccccttatgtgagtgcgtgcagtcccgtggctgtaaagattatttctatgctcatgattcctgagttctgcatttatcccagactctttctctggctgcctaactgacctggatgactttcccactggaagctcaaacccgaccagtgcaaaaccaagctctgtaccactcccttgccatgaaacaaataaacccaacaaaaacctagcatagtcagtagtaccacaatcgagccaggtcagaaatctgggagttatccttctttttctcctagccgcctaatcaccaagccctatttagaaacagaggaataacattcaagtcactcttcttcccaccacattggctgccactgtcctggtccaggccgccatcatctctccaggcatggtagccacttcctggcagtcctgccatgtctatccctgctctctaacagcctgttctccacccagctagcttttaagaaatatgccagttcccactctttgcagtgtcccttcacactatgataaaatcccaactacttgccgtggttccatgcagctgcacacacagtgtcccgcctgcctcccatccctcgtgctgtgtagccctctgtctcctgcacactcagccaccatcggcctctcttcactgcctccagcccaccttcacatgtgccatcctctctgccaggcacatcctcctccagcacttcctggaccgagtccttcctagtttttatgcatcgtgcattcctgtatgcatttatgatcggattagggcctctcatctctctgtagtgaagggaccagtgatttggttactgttttctaatacgttgcagaccaataatacacaataaaaacagatactagataaaataaaaagacaaacacataatacaagtcccatttttaactatcaga

SEQ ID NO: 58593 - DNA, 1092 bp, Homo sapiens
tgtggctcctatcaatgcaaagaaagcaagcaacctcatcagaacacagaaacacgtgtcagcttttgatttcagcaccagccattccccgctgctgtcagaggaaatcacgggtttgcacctgctccctcacctgtgtgctcctctgtggcttccttgtggcttcgaaactaggcacacttcagatttcttatgtgaagccatttttttttttcagtgaagtttcacagttgtcatcacatgcattttgtattccttcagggacatcctaacgtagtgactcagagatggaaagcaggtgagagcccctccctcagcgctgctgggtactattgatcttaaatttgatctgtcagcacatctctgagtaggtaaacaccatgctccatcctgctcacaaacaagcaaagccccagcctcatgatcattggcttccttcagtagacacatgtgttggccttctgtgttgttacaacaaaacacaagtggaaaatgtaatgtgctgtataatgtttattgattttccctgagctaaaagcaaagtttcagacgtagtcatggagatggccaggactttggtacagagggttccgtgcaacttcctggaatcattacccaaatttagatcagactggggatggctggtgcaatggcagttttgatgattagaattcagcagaactcctgcaggcagaggttgggtggttctgtacaatatgggagcagagtccctgtcttcctgttccctctcagagccacatagacaacatgctgggctgtcttgatgcgatgcctttgcactcagtatacaggctcactggctttcctgccacttctccacgctcctcaaggccaacttgagacttgagaccgtagcattaagagtcagctttactactgagctcagctacagagtttcctcatgatctggaacagcacttcacttcccaaactgcactgtgcatgtgaatcacctgggaatcttgctgaaataaagtttctgattgagtaggtgttgctagagagtaccaatttctaataagcacttagttgatcccaaaatggacagtccatggactgcaattcatatag

SEQ ID NO: 58594 - DNA, 1062 bp, Homo sapiens
taattgtaaaaatgtttttgtagagacttggtctcgttgttttgcccaggctggtctcaaactcctggcctcaagcaatcctcccacctcggcctcccaaggtgctgggactacaggcatgaaccaccgcacccagcccgtcatctacattcttgaacagggacaaataatatttcaaatttcttcctcctgtgaacaactgactgcatggcagaaagcaccttgttcctccctgcactcctagccccggcacatgctttatattctacaagttgcagctgttataactaaaacttcttttgattcatttgacatttttggatgcctactctatgccaagcaccgtgcaggtagtttatttcatgatctctcctaacaacagtcacgagaagcaagtgtggcgccagcctatagatgaggaaactgaggttcagacagctccggtgctccttccccaaggtcactctgtccacagcaaccggcccctgtgcctcctgagcccacaccttctactgacactactcttctaggccttctaagacccagactacctgctggaaattttgatctgggttctaatcctagctctgtccatttcctcagacagaatggaaaggagttggaagggttgatcttagaggctccttcctggtggtcagattctttgattctgctcttaaccagaactcacactgttctcagagaggctgccctgtccctggctggctctggaaggcaggtggcaaaatgaaggggagaggtgctaggagagcttctccccccaatgctggctaacagagttttcctgaaattcatgtttatacagtcagcctgtgagcctggagtcatctgcaggaggagagcggcaggaaaggaagagatgtgtggtgagggtcatcttggtaacaggcacatcacctgctatctttagtcagcctctagacaactccaggtattactgtcctctattttcagataggaagcaggcctggtcacaccccttggccttagggagtaggctgcagagccaagattctaaaccagccctgacctgactcctag

SEQ ID NO: 58595 - DNA, 1574 bp, Homo sapiens
gtctctgccgcatggcacctcctctccctagcggagtggagagcactttgtgagggtcagtgtttgagtgacagctgtcacactgacatgtcaacaatctcatagttgatacctggcttcatgaaggagttgataatttggaaggaaacgctttggcagcctcaccaaaggtggcaagagtttggaagcccactacgaagatgtgggtcgcatgttttaaggcctgcactattgcactcatggatagtgggaagattctggagcgtatatgggtccccatagctgtgttgtcagataaagcacccaaaatttcaaagcattgaaccagaatgatggctgtaatgttttaaaatcaatgactgtataaaattggagctggaaggagcttcctgcatccctgtgtgtccctgtgggccctggcttgctgtgggcctgtgtgctttgccttgtctgcgtgtatcttagtgctttccactctcgggttctcttcctccctgaggccctcacctccatctgtctctttcatgtgcgtgcacacacacgcacacattgaatgcaagaaatctttaaaaactaaaaaagctctgacaataaatgtggggaatttctcattgttaagtgctaagaactcagtttatgttgtcaccagtgactattgaacacctgctaggccagagcaacaccgaattgggcactggggaattacaaagaaaggaaaggacataattccttcttttgaagagtttacagtctagagggagaacaagatggcaaagtccatttcctagagaatagcctcattacagatggcagccactacacacacagctacttttaccaaagggcacacgggggcttctgcatttagaaagggtagaaggacagtttcaggagatgatatcacaattgtaaaatgaaattttctacccaggcatttatggcatttttgtttattttccccagagaccaatagtagcatgtttctgtcttttctgtctccacttgagccttggggaaagagaaagttctgaacatctcactcctagggaaggactgtgtattttgaagtgtggtggagctcatcggtatagacgcagcctgccctagtgtgtgtgagaggctccagcacagtggtttgaagggtgggaatatggaaggatattgaggagcataacaataagtaaatgaaccaaccatgtagcacatagttgcagggatggacacagacacacacggggcagtctaggaagaagaggcactaactgcccagaatccccaagacactgtgtgcttggggctgtgagagctgctggttatgagcggttgcaggaaagggctcttctctacaggggataggaccacccacaacccgttagtatctggaacattctcttcacattcaggttttcagacagcctggaaacagcacagaggtgctgggtatccagttatagaaatttctgggggcagctctttcaacagcagagatcacagcactgtgcctctttgagacaggttgcaagggtcagaagaacagacgatggaagcaaaaacttggaatttggggtccttaa

SEQ ID NO: 58596 - DNA, 1706 bp, Homo sapiens
aggtaacacatctcattctttcggaagttgtattttgtattattaaagggaggaagaagatcagtaggaggaagagctgtgaattatgatgggcaataacttttcttctctgaatacatctttctcacttttctccagagcagagatcagctgccgtgaagccatatttacaattagatgtaaaacttgcttccctcatccttaggcttaaagaggagagcagataaaagaaaaagttgcgaacattaaaggttaaattacaaaatattgcaaagttaaatgaaatgtcttcaaaaattaattttctctgcaccaaatgggaacagattgtatcatgtcattaatcttacccctcgttttattgttgtgtcgctgtttcctccatatttccatgcactttatggcttagctgtaaatgttttgctgcaagcacacccttggatgcctgaaagcaagagctctttcctccctgtttttattaaatctctatgactatagattgtgattcacgaaagaccactaatcagtagtatgaagtagtgagaaggacagggcttccactggcggagtcaaggcagtgtctgcaggggaaaagcctgtaaacacttctgctaggcaagttggacatgctggttcagctcttgctttaactcagatcttgaaagtatgcccgaagagaacaagctccaatgtgtttctcagcatctgagtatagtgggtaggaggggtctatatggggaaagaaaaaagtgaagaaacctcaagtcaggagccgcttcaaagcctatttgcagccttgtttgggaaacaaagcaaaacaatggaatatggaaacaaatgagttcttacaagtttacagcatctctacaagtgtgcacctctgtgtgggaggaagtcagggtaggacgtgtgtcatggagggtgactattgctcagaaggatcagagacggcctctctagggatgtggagtggggttggctggagccatggaatctctttggagaaggatgggggaaggagggaagggagccagaaggccagcccttcccattggttttgtcatactcctaggctgatcattagaactcccctcactccacttcccacccatcgcaaatcccccagggaattggagcctagcctagagatgccagataaaatacaggatacacagataaatttgaatttcagataagcaaataatgttttaatatgagcatgtcgatatatgggacatacttagtataaaaaattattctttccttatctgaaattcaaatatattaataactgagtgtcttgaatttttatttcctaaatctggtcgccctagcctcaagggacaaggtcatctcttttgcttccagtgggaatagccttcctgttatctggatgctgctggtaggccgtggacctctgatggaaggggctcttccctagttctggaggcttctccctactcagataaccagacagagagggccctttaaagatatcgttgttacgattttatcaatttgaaatgcctgttttcaaatcttttcaaatttggtttaaatgtgtttcaagcagtcaggttctgataagctttattttgggacttgtaagcagtctttatggagactagagaatatgattggataggcataaaacaaaatctaaggttaaaaacagggagccgagagtggctttgggttgaaaatga

SEQ ID NO: 58597 - DNA, 1031 bp, Homo sapiens
gtctataccaccgatgtcacatagcagtgaaaaagctaaactttcagaatgtcttttttctgctttgtaaatagccatgctccctgattaggatttatgctgggcaagtagtaagggctgctgaattcatttgttatccttgccaggtaattcttagaaggctaatgaatttctggaatggtggtaataatggtaacaataataatttatcacattgttataggtcattaaagtttaaaagtgctttcagattcactatttcatttaacatgcacaacaattctataagatgagtcttattgtttcctgattaggaaactgaggttcagagaggctcactcactttgttaaggtcacacagttgatgagtaagcagcctggctggaattaatcctacaacagcattgtttttcctctacaaggttgagtctaaccttgtttatgtcacaacagccccactctaatctgttacacaagagcaccttgttacaacaaatgacatcatccaggtttggagttgaaggaactcagagaaatcacgtaattcaagccctcattccgatttagtttttgtttgacctatagagaaactgagtctcaaataaggtaagagccttcccagagttaaatgacaatttagggaaagacctgttgcagcccccgggcttgtcactgttacctggactcctttcacaccatgggtcagtcctgtctgagatgcagattttttaaaaactaagttcatatccattaaaatgctttatgacagtaaagtgctctacagaagcaaggtggtattgggcagctgttctcttgggtgcgcacagatccctttcttttattcccacctcatcctgccacatgtacagccattcccccttttcacatggcccccttattccaattcaacttgcttcttccaagtgaactaaatttatagaggtctgaatttacagaactgaatgaattcactttatggcccccaaagtctccaacctcagagatgtctgtgcttcttcaagctgcttctg

SEQ ID NO: 58598 - DNA, 1036 bp, Homo sapiens
gctcttgcttgggaaagtcattttctcttgttctttgtggtgaatgggtgaaaccataggatgaattaaacctggtttacagaacattatgtatgttgatgaagcttgatatgaattatgaattttctttccttggaatttggtagaattaccataacttccaaaattaatctccccatcactctcgatatatttctgttagaatcatgtcttttctgaatttcttctcatggctcatggggaaaaaatgatggtattatttggaaatttttattttttaatttgcttggggttattttttgtttgcttcttgtttaaataaagacctcagcacactgcaaagtttttcttttctttgggggaagacaggagagaagggatactgatgccaagctacataatgagaactggctttcgttccagtcctggctgggtatgacctaaccaaatcataagaatttccaaatgccttggtttcttcccccacttggcaaaatgaaggcagaagagtcataagcccatctcaactgcattgtggagtgggtatcagagagaaacacaagtaaagtaccccttcctggagtacggtgcattgatcttaggtaggaggtgggggaaatgtgagtacgtgtttacaaataaagaccctgctagtgagaacagcagatgcagttagagttaggctctgcctgctgcttgtacccatcagtgtccattgcctcctctttcctcattcatgaagggacctgattcagcctttaccctcccaagtgctgttgtgggtggtatctcgtccatctaaaggaagtctgcaggcccctctaagaaagtttgctgccctactagataaagctgggtatccatgaagggtcacatggaaatagatcctggaaagggagataactgcatttccagactgatcttgagagaggagaagcaaagtgcatttgtgtcttactgatccagcatctttggaggagtggtaagttctgtggaaattaatattattatgagctatgttttaagcttttaagat

SEQ ID NO: 58599 - DNA, 1079 bp, Homo sapiens
gtaggaagggggtgagggataaaagactacaagtggggttcagtgtatactgcttgggtgatgggtgcaccaaaatctcacaaatcaccactaaagaacttactcatgtaaccaaataccacctgttctccaaaaacctacggaaataaaaaattttaaaaaatttccctcataattttgaaggcattactctgtagtcttccagcttctagttttgctaataagaagtatgatgtcaccctgattctagtctttcatatgtgacccagcctctccccagattttctctttatctttggttctctgaaattccccaataaggtagatggtatggggtctcttcatttattatagccttgtcagtttggagactcatgcctttgatttctgggaatttaaaaaatattcttcgatgatttccttctcttcatttttctcttttctttctggattttctataagtaggatgctggcactcctttcctgatccttaaatgttcttatcttttctctccagttttctttctctgtgcttttttgctgtcttttctgagggatttccataactttttttccaggtttttttgttgaagcttttcagctaccatattttaatgataaggaactcttcctctgtttccttttaaaacagcattctgttcttgtttcgtagatgcattatattctcttgtatctctgaggatattaattatagtattttctttctatattgttttgtatttcctcataggttgcctttcaaattgggggcttccttgaccattgcagttaagactgagacaagcagagaagctctgtgttcatgggtgggtcttatctattcctgggcaatcctgaaaattgactgggctgagattcagccattttactgaggataggaggtaggggaatgtgggaggtggttccctaatgtccacatctatagggcttttctctaaggcttttcgttttctccgagtctggggcttccacagagtgaacctgtcctctcatgctgtggtggggaaggaggtggtcatctggaagccccagccaggagagaggacctggggtggaat

SEQ ID NO: 58600 - DNA, 1038 bp, Homo sapiens
actttgtaaactgtgtagcattatataaatgggagtattatttttatggcccattctcttcctccagtactgttaaggagtaaacaaaaaatgtatggattgcagtaatgttgcatttgggagaaattaaaatatgctcaccattagcaagctcttagaaaatgtggaggaaatttgcatggatcattttgggagctcagaactgtagggggtgcacaaggtatctggatgcaccaaatcacagtcccatccatgctgccaactagctgtcaggaagacatggatagttcctgccctttggtagtgatggaagtataggcgattacagatttttttttccatctcctatgggatccacagatatccggctttaaaatccataaacttgagccctaaaacaaacaaacaaacaaaacacagcaacaaaaaaacaaaacaaaacaaaacaaacaacccccccccccaaaaaaaaagtggaagtggggattctgagaaggtggaattgaataagtaatcctactgtaaagaaaagtgataatcaatggctcttggtcacctgtgaatgccttgttattttccaagttagactcttctttaaaggatgtaaggaaaaatcccatgcccttccacttcttttttcctcccgggcacatcattattgaaattgttgaggccctagagtggagacacctgtcaggcgtgccttctgcaattttgctctgccactggactctgtcatagacttgctgcatatccttggatgatccttttaatctctccgtgccttggcttgtgtacttactattctgagagatttaaaaaaagccatctttgaaatgaaggagtctttttcaatatccatacgtggtgtggcaggactgcttcttaattgccaattgtgattcctcatgcattattaaatgactttctcttgaagaaagtgtgtctcatcagtgggctgcaacactgaagccatcctgtgaggcccctggggtgatggacagcagattagttctcaggggtgccgcaggctgtgct

SEQ ID NO: 58601 - DNA, 1112 bp, Homo sapiens
tatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaattcagaaactttgataatctgaccataacataagggaagctctaatttctactgcttgctgatctgctgttaggcagcacagagacgtatgtgcctctcaggaagttccctgctcgaccttggccagctcctcctggggtaggtacaagca

SEQ ID NO: 58602 - DNA, 1022 bp, Homo sapiens
cgacatcttttaagattcggattcttactatattagagttgattatatgaagactttgatcatgtctaaaatgccatatttttgcattctaacatattctatatatattttttcctctgtctttccccattcggaaattcatagagaccattgtgcctccatctttttttctctgtctgctctgaattttgggtaaagaatgaagtaatgtttctagagttccttagtcattacatttgggagtaggctgaaattggacaggcatatcgttcacttttttaatatcctagacttgaacagttctttttttagttcctaagcttgcaaaagttttgtactctgagtagctcctttaagagatgcttataaagtgctaggttttagaggtgttttagagatgatagcatatagtaatgtgtcctttgtatgttcccaatacactgttgccttccactgcatgctaccccccacctcaggacattttattgtatatttaatgtagtactaacattccagcctgtacctgtttcttcccattttgtttcatatagctaaaagttgtagagtggtatactccaagttgtatattctgtgctttatcttactgtcatgattttaggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggagtaagttattctgacgcttacggtgttttcatatgtgccagagaggggctttgtaaaaactgctgtatgttatgtgtacagtgcaccaaactgccctttgttaataagacatggaatttaaacattttgatagtcttagacttaaagcctcattttcagtgattcttattatgaccaataacatctgtttgccagccctggag

SEQ ID NO: 58603 - DNA, 1064 bp, Homo sapiens
ctgcattcatttattctgtatctccagggtataattcaataagtatttttgtttggaaaaaatcttgtgttatccatagtcttgggccttgaaaatacaacagccttggtcacagataatacagcttctgtttgtatgcttagaaacagctattgtcagggacttcttcaattacaaaagacagtgttgcagcatctgacctagtggtgttaatgactttgaccatcaaaagaccctctattaaggctttagtacttatagattgatggtgtatccttgcaaataagtaaacagacccccctctcctaacaacatgatcaagagaagtgaaggatcagtttaagaacccaaatggtccaagttttcctaaaaatcaaacttgtcataaagtgaaataaaggcaacatatattttggagctgtcttttatttttttctcttttgttttcttgattttgagtttatgattctgattgctaacatcagatctgtacctagaggaaaatggacttgaagttttagatagatatatgttgattggcatttgtatatacaaggaaaattttttttgtttacaaggcttagaagttgaggtaaattttcctctttagttgggcttgagaggaattaaagaaggagggaagacagagacaaatgaggaggtcccagaactccatactgctcaagttttcagtaactcctttcccagttgattggaagacccctaagggtaaaacagacgcctctgccctctctgctgaacttttccctctgtctctaggccttttttcaggccctaggtatgaagagagaggggtcagagaaccacaaacctggagttcccttcttcatctctctcagctggtagtttttaattgctgatatttgtgattattttatttttttagaggcgaggtctcactctgtcacccaggctggagtgcagtggcatggtcattgcccactgtagccccaaactcccaggctcaggtgacccttctgcctcagtctttcaaatagctgggaccacaggcacctgccaccacacctggctaatttttaatt

SEQ ID NO: 58604 - DNA, 1003 bp, Homo sapiens
tttggggaggagggaaaaagatgaccagcccagtgaggttactcataggcatcttcttcagaatcattactcagtgtgccctcagaaaacagatgctgtttatggatccttaaaagacaatccgctgcttttttactttttaatgttattacctgtgtagctctgtttgtctctaatacttgtaataaagtgtgggtgagagttcattggggagtgtttattttggaatgttttttgtagactctatggctagattctgaaactgctcattttaaaaagtaagaaaatgtcacatcttagtttctaagtctgatcacctgagatgatttttaatactaaaggacctgtgcttctttcctaaggtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggtaaaaagtcctgcacagcctagttcttcctgtccccactattctttctcccaagtttgagtttaaaaaaaatctctctttgtattcattattcatgtttgaattctaaaaatccttttatattctttgctggtgtaatgagacgtttaaaaaattaaaattgataccctggttgtacaaggatgatttttcttaaccctaaataatacaattctattcaggaaatgaaataaaatataatatctttataaacctgaaaattgttttaaaaagttccttattgttactaaggaaattttgatattaataacttgagaacttttctttttgggtaaaaacatatgtgtttgtggtgtcatctgtataggatgtgaggttctgaatctattatgttgatgagtggtgttaaata

SEQ ID NO: 58605 - DNA, 1013 bp, Homo sapiens
gcaatttgttcagggtctcatagctaataagtggtagagctgggtttgaatctaaatgtactccaaatcttgtgcatttaaatagtttcttatgatgcttcccatttctacatgagctgctttttaaaattgttgcaacagtttatgaaaactagttcaagaattgctgcatccttgctgcataagaaccacttgggttaaaaatactgattcctggatcttatccccagaagattctagggtgggctcaggagtatctgttttgaacagacttccagtgtgattctgatggcagtgtttaggaagaaggtgagaccagaccagggttacaagtgtacctcaatctcaacatctaagtgttgcagttaggctattttgagcttagtggtgtacttacctaaaatgacatacctaatgattacttttatttttaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttggtgagttgttcctcatagatttacttttttatacatttatttgtctggtttttttgagacagggtcttactgtgttgcccaggctggtcttttgaaccgtggcctcaagtgatcctcccacctcagcctcctgagtagctggggttacaggtgcaagccaccatggttgatctgtagataactttaaagggtatcttttgaaaaaatataatttactgcagttttgatgctgcaggttcctctgaattgaattcagctgttgaatgttttatacaggatttctaagatacctttggaaaatgtagcattttttccccttaatattttttgactgagaatttgatgaaggcaaggatttttattcatataatagctccatctattacgataccattttattcaga

SEQ ID NO: 58606 - DNA, 1057 bp, Homo sapiens
cctggcagggacattggtaggtagtgctctgtgaatcgtgacagatatttaagcttttattttgtgctgggagtagtaggtggcacatgatgagaagccaggtaatttgagaggtgaaggagaggttaggaagtggaaacagtggagataggctgtcgaggggagaagtttgactatagttgtttaatgcaggtgggaaggagtcattagagcagggggttgaaactataagaaaggaaatacttgttaggcagggtccctgattaggtccttccacagccctgaggcagaaagtcctcttagacaagaggaaggatccctcttccataataacaggacagaaataaaactgtggcagatgtggctaaatttgtgcattttgtgggagtaagttgagggatttctcatctaaaaacatttgttttctctgaggtaggagtgatgatggaggtgggtgggaagctggagctgttttggagattaggagagagggcttactagggaagccagactgctgggaaccattgaggccagttgagattagagaccatgagaccatacatgatttttctccagtggtggtctacagcccaggtgggttgtaagaagagaagaaaacaaaggtgtctagacaaatttttctaggcaattgtctagaaaacccaaggtttctagacaaattcaatgggagttcagtgggacaggggagaagagggtattggcaaggtgataccttagctgggtggggaagaagtgaagacaggaggggctgtggggaaagagtagacagagttaagaggctgtgagtctcagttagatgaaagaacaggtgtgagaggaaatgagtgagacgcctgagattgaaaggaaatagtggtcaaaaaacagaaggtttgaattgaaaatttcggaggtagagggcttctagtgttgtggtcccaggtggggccctgaaatgaggctgaattagagtggagacgagaaagctagaactgagaggctagcatttgggcggtaatgtcatccagaatgaaggcaggacttggaggtggagaga

SEQ ID NO: 58607 - DNA, 1033 bp, Homo sapiens
acttgcctaaggtagtctaactaattatgaagaaatctggagtttgaactagatctcctgcctgggaatcgacaaaaatagcgtgttgctggcccagcatcgcggactgcagtacaattactaaaatcaccgcagagctaatctccatacattacaggtagaagcggggtcaactcgtacacttactgttcataccagtgttaaacctgtgggaaaagtaaccataaatagaacacatctgtcatcattcttatttttaattgtacttttaaataaatgaagctgttggttttccagaaagtaaaagatcagatctctgttaaagtgtgggtaactgtggttaaatggagcatttcctagtattttctttctataaaggacagcttaaagaatagaggatagatcagaaaaacagaattgtacctttctcatttcagtaggcaaatagatcacttatctgagtctttttcttcatttataaagagaaaataacacctgctgtttatctgagagttgatgtaagtttctgagataatgtgtctgaaagatgaagtttacagaggtaaggtgctatcttacataataggcttttatttgttgataaggtgtgtgtttagcatatactctgtatttccagtatttctgtaacttaacacctctaagcttcatatttacaatgaaaagttactattttcaaagtgataaacttcaaagcaagtttttgcatcggtagggagtatggagagggagtatttaatgctaaagtgtacattatttgtctccatcactgaatatgctgtatactttgggagcagcagacgagtgtacttctgtgctttgttaatcgttttattttttcaatgatttagtcaaggctttatgatttttgtgtaataattttgagtgctgccttgttggctaagttgaactctagaactgtgtacctttatgtagtcaaaatgtgaaaagcctgagataattagcttgagagcttttgagctcatactgggaaagtctacagtgtttttttatt

SEQ ID NO: 58608 - DNA, 1044 bp, Homo sapiens
tttatctttctgcagaggaattgtgaaacacagaaaccattcagattttcccctaatctctctacaagcataatcgcctggctattcctgtggtatttcttgtgagttgcaaaatttggggaggatttgtgtcactctttttatagattgttcatttcataattttctgtttcttcctcttaggtaaacttgaaggatttgagtttttgtaaatgaaaactctgaaggtgctgttgtagagcgtaatttccctttggtgacagggaacatcttatactcttggttcctttcttctttctgtagaacttcacatgattttctgaatcaaatgaataaatgttagcctctgactcatcttgtaaatgccctaatcagttttttttttgtatttcctcttagaaaagtctttcagattttgatctgaaataattcctctttaaaatgagtcattcttatgttgatagcataacatcatagttacagtacatacatgctctataaacacaggactcttaaaataaatctatgacccattgtttttaaatgaaaattatctgtgactttgaatttttggaagggcacatcttcatctagatatgactgacatgaattactatgcagtgtgcctgtaggtggcctggcacaacttaacacagtgttttttttttttttttatctttccttcgactttccttctcttgagatagatgactataggaggtagaaacaagttgtaatcacatttaccatttttaatgaaatattttcatgttcttttatcccagtttgtattaactatacttttaaattatacattattataaaaatattttactgttgagattttaaaaatttaaaagtgatagctatacttgcctctggtgtcgctgattttctgtgtatttcatacaggtcagtatatatatatatatatatatatatatatatatatatttttttttttttttagatggtacatatgtgtgtgcatgtgtacacacagacacacatatttttacttttttttttttttttgggagacag

SEQ ID NO: 58609 - DNA, 1049 bp, Homo sapiens
tttaactgtcctttcttaataggtatttagtaagtactaacgggtgaatgaacgaaacttcttgttgaagtcagcaagaagttaggattgaggggaaggcatagaaccaggagcttctttggcatggctggctttgataggatatgactcctataggtttctatgtagaggtccctgttacctattcatgtatatgaagtggttcttttaccagacatctatgaccagcaggctactttatgattttttccttaattaaagtaactacttcatatttgctctatcatttttttccagaatgttgactatttcagaatatgattgtgtgctccagatgatattgaatggatggtcaggatagtccatgcctgattaacatttttaacagaatattgttcaaattgatattgagacttcacgttattgatttctgaattctactaacttgctgtaagtgagcaaaggaatagtttatgaagtaaaaaaaatcctttgaatatgactttatgattttgctttaaataaactcagatgtaactgataggaactgatgggttaatgttaaaaatatgccatcatataaagtggtacacttagtgtagaagtaggtttaatatcattgagccttaatagaacatcggtatacataacttatggtaattggtgaatatttttaaaagcagtttaatggctccaagagtaaactctagagaaacagctaagaaatcatgataggcctttgtaagcagtgattctctgataactttaataaggttgggacccatcgtcagggaggtagagagtgtctctttgagggaaaggactcaaatatgtagtgtccctgtggctcctgaggaaggttccacagagacccctgtgggttgcctactcagatattggggagacgaggaaggacagctcaagctcaagctggggtagtggagcagcacacttcttgcagaagactggcagcctagctcacagctagggtgcagcatgtctgaattagggagccaagctcatgagtgcccttggtgtgcagactcagc

SEQ ID NO: 58610 - DNA, 2577 bp, Homo sapiens
agctcaaagggcttaagtaatttgtttctggtcactagtagaaatgagattcgaactgtctgcctgcaaacacatactctgttcaagatggcaaatgcttgggttagaatatttttatatgtttgacaggacaaacaatggtaatgatgttcttttggctaatggtaacttcaaaaattgcttttcaaagcataaccttactgtagttttaaagtagaaaaggaaaaatggaaaaaaaaaaaaaagaaaaaaatggagacatcgtcccttatttaaatccatactgatgagaagattggcagatagttctcttatcaactttcaaatgatgtggaggtggttacctccccctgggcaaaggaaacatctcaatagctatttcttcccacctctatctaatattaccatagagatctcagatcttccacatctgcagggaaagagaaggggtgtgataattagcttttgtatgaggggtgttgagtagtctttcctgagatgatatctgtaaatacggcttgaagttgatgatgtattaggttggtgcaaaagtaattgcggttcttaccatcacctttgatggcaaaaccacaattacttttggatcaccctaataggaaaggagcagagtaggataggcatgttgggagaagtggaggacagggacgcatagaatgtctgctgtgagatgaccagtgacattcagccatttccagttgctcgaatggtgcagcagtgactttgaagtgtccagatgggagtggagtgagtgtctccacttgcagcttcagggctgcccgtgtagtagggagcagtaattcaatgtagtcagatacctttgttggaaatagattaggggctgattttgaatgaaatcacattaaatcattgcttttcattctccctcattaaccatttaattgtttttggatggccttttggggataacatctgctcaacaaatatttagttaacatcttctgtattccaggcactgttgtaaatgccatggagacaggaaaggaagttttcagggagcttagctttctttcatagtgcttaatgggagatttgggtgggagagagagaaaataaacaaaaaagaaaaacatgagagttaaatgggatttaagaagggtaatgtgactgcgatggctactttagattggatggtcaggaagtgacatttcagctgagacctgaatgacaagaaggagctggtcctgtgaagatttgcaggtggagcatttcaagtgggcacgattcctagggactggtgcagaggccgggaggaagcactggaggctggggcaaggggagaggggcggcgggggcggggcagggcttcgtgggcagagggcagagtgacaagagccgaagcaaaagacctgtcagcatataggttttcgcgggccagagggaagggtggaggtggcatgggaagggacgtgggagccacagaagaggtttagttagcaaaagtgacaacctgattgattaggaaagctcactctgttgctgtgtggacagtggaccttagaggtgccagagtgtaagacttgggcaaggtgggaagagtaggaaagtctacagaaagctgccaaaaataaattaaagggttttaattttatttattttttattttttaccacacctaaggcccagctgacagaattggttgtgaaggcactcaagagtttgtcacttgctctaataaattgttttagtgaccctcagaagccccaggggtgagaggagaaacagtagcacttacccggggttggaagtaagaccagacaggaatggtggaagatcactcctgtatccacaagctccttcctatggggctaaagagaaaccatactttttatatcaccacagagctctgacagctacacagagcagtttaaatttaggcttgagaaaaagccttctgtcaccatgtttcttttcaactgagtagggtgtatcaggtttctcaaggaagccatagtctgtcttaaaatgctttaggacagctttacttttgaccacatgaccagagtgctctggaagcttctgatgcttcaacctaaaagttccttgaccccccgcccccccccttttttttttaattttaaaacaatagtatcttcattttcctgacacaaagtagcgagtgacctaggaaaatcaagtctgagttaactttaattctagaacggtctctttgtggcagtgttttctgcatcacaacaaaatctagataataactgcttagtttgtgatatgtaggtaattttcaaaaattttgttaatttcctgaaaagtttggggggtatctattttggataatgcatttattttaaaggtagataggatctttctctggtaggttttgcttgttgcttttagtagccacggacctgggctttcatcctgctgcttttcctctcttctgtcttctcctggagctgttgagtcaccagggcacacagatccctcttctccatttcctggggcacctgtttggcctcacccctctcctgcctggactgttgtaatgctctccttatctattttcttaccttttctgtt

SEQ ID NO: 58611 - DNA, 2186 bp, Homo sapiens
aatgatagggtactgcagaaatgggattgataattactctcactttcagatacctgccattgttagtatctctagttctatgatatttccacaacttgccgaggagaaactggttttactttcatacttgacatctttttcctgatgaaagaagagattatttgcactttgagagtttggctttttagtgatccgcatgttgtatttgattttcatgtaaagggaggcagttaccaaaagcaaaaattcttagtcgtttgaaaattacattagatatcttttattcactactttgattttgtgaagtgttatgctcaaaacaaaaatgtgttcttaagaaagagcttggctaactctaaaagctactctctgctcttttcagctgatagtttcataaaaatttttgtttgtacctgctgttgaaataataaattttaaaaaattatttacaaaactacacagtatttggtagtgccacctggaagaccagaaggcttgaatttgcctgtcacttggtcattggagatgctgtatatttggcatgaatgtccagctgtaatggaaatgctctgtatctttgctgtccagcatggcagtcaccagccacatgtggctactgcacttcaaatgtggccaagggaactgaagaactgaacctgagttaattttaattatatttaaatagccacatgcctggtggctactgtatgacaatgcagtcaaaccgatgtcatcatatagcccttatatagatggttttaagaaaataatagctgggccgggcacggtggctacgcctgtaatcccagcactttgggaggccgaggtgggtggatcacgaggtcaggagtttgagaccagcctgaccaacatggtgaaaccccatctctaccaaaaatacaaaaattagctgggcgtggtggcgtgtgcctgtaatcccagctactcaggaggctgaggcaggagaatcttgaaccctagaggcggaggttgcagtgagccgagatcgcgaatcttgaacccttgaggcggaggttgcagtgagccattgcattctagcctgggggacagagcgagactgtctcaaaaaaaaaaaaaaagaaagagaaagtaatggcttattttaaaaagctcagttgaagtgatcatagtttaattcctaagtttatggcattttatctttcagtgctgcagaggcataattatttctagttatttcatgatgctgcagaataaaatttgagcttctaattttgagggtctaggaaaaaaatgggatattacagtatctcctttagcagtttgaccacctgatcagtaggatttgtatatttctgagcataactgcaaagtgtgcagctctacagaccagtagcttaacttttgcttaaatacttgtattattatttacaaaggtctggttttatttgcacagatttgcacaaaacacaaccaaaattgtgttttgaaactaaaaatctttcaagttgtgtatttgaaacattatatttgtatgacttcaagttatgtatttggaacattttatttgtatgattatatcatggtctgaaagaattctttttgcttgagtaatagtgtagcaaattagcttagatcaggctttattccagaataaagtttagattaggtccctaaagagaggttcctatctttatagaattacagttatcaaaggctgttaaacaaataatctatttttagaaatgtgcaaaatatttcttttatttatttatttatttatttcttgagacggagtctcaccactctgtagtccaggctggagtgcagtggcgcgatctcggctcactgcagcctccgcctcctggggttaaagcagttctgtgcctcagcctcccgagtagctgggattacaggccacgctctgctaatttttgtattttttagtagagacagggtttccctgtattggccaggctgatcttgaactcctgaccccgtgatccactagcctcggcctcccaaagtgctgggattacaggcatgagccaccgcacccaggagcatctcacatttcatgtgcgttagttttgttgccttgtgacttcagctcttaaaagctgaaagacgtttgaaaatttctgtatttttacctgtttcagagaaaccagatttagactttttaaaagaaatttacacaagcatac

SEQ ID NO: 58612 - DNA, 1052 bp, Homo sapiens
aggcttttgacacggccaccaggccacagatgaacagcaggtttgagacatttcagaaatgtctctgtcattcagcgatcgcggaatggaggtttgcggtgtgttgcggtggcttctgcagacttcagtagcgagtttcttcgtggaagttgtatttgcacctctcccactgaagtggggacatcttgcaggcatcctatgcttgtggctccatttgttcagacaaagaaacaaaaagcttttacttttatgaagtctgtggaatggagtgatgacaaagtttgcagtcatacatacagagtataatatgctgttccctggccccctgcttgtgtcatggagggcgtcccaaactctcactgggtcgacttaacaattcactagaattagtaattgggtttagagggtttgggatattttgtcctgccaggattcaaggaatttgaaagtattaatagcattatgcatcttattttagtttaatgcctggttatgaaatcaggtttgtagtgtgaatacccaatattgaaataatggaccatagataagggtgatggattttgctgttaagatttttatttcctggatttacatttctttgtgttgaagtaacttgtacggattgtctgtgaatttttcctaacagtaggagcaagagaaacacgtatcagttgttgctatatggtttcttccttgttttttgtcaaggtatcctttggagataccctaccaaggtatccgttgtgtagccgaattcataaaacgttatgtggctcttgagactatattcaatttagcagtatggttcttctgattgcctttctgatgtcagaatacaatcctaacacagactcagtgtggtatgatggcacttacaccagctttgaagtcagactaacacttcagtattgctcagctactacctttagtgacgtagccacttaaaaaaaacttgtccctcagtttcatcatctgtaaaatggggataatagtactcagctcttagggtggtttgaggattagagttatgtttatgaaggaagtgtgattag

SEQ ID NO: 58613 - DNA, 1216 bp, Homo sapiens
cctgccttttgtatgccgcttccagcccccggcctgggtttggggagaaaactcagaagtaggcagatgatcccagccaggtttggtttatcttgcaagaataacgaattgttccccaccccaaccacccaagttttcttgttcgagaagattgagtagactaaggtggctcagtgaccccaaacccaggtagaggttccgaagaattcgaacgtgtttacttagcgttagccccagcgccctaattgaccactaaagtagagccttgggaaatgaccattcctgctttgcctcatcctaacgcttcccaccgtagagaagcaacttaccccttgacgggttttttctcttttgcaatttatttttaactagtgatttacgcccacccacctgctttaggagaggtttctttataccttaaaatcacaataggtcagtccatgatttttaaaaataatgaatttgccattggggttttacttcactccagaggtttgaagatgtggtgattgttagttcagttagatattttgctgcctttcaatgaaattatctttaagtggtaaagaaattgaaggaggtggacattttgaagtgattgcaaaccgattccatggagaagctaaatctgtgctgggaattgtttttaagaggacaaagatatttctgaatgtgctgtgtataacatcttcttattactcaatatgctatattgtaggcatacacctccactttcaagtggattataattacatttttaaaggaaatcataacatttttaaaagagaacttataaatattaattcaaactgatggccaattttttttctagtcaacacagcagttcaaccatgccagtctgcaggatggaaaatttcttcagctgaaaatagatatttcacaattgattgcctctgaatttccaaaacgttttcattctagaatttcatgtagaatcttaaatattccttcagatttttacaaacagtggcgtttaatcaaaattcgcgctgtacatatacagtgtttggaaaattgggcatataacatttgattgaattgaaccattcaaccagacaatggctttgtaaatcttggaatattcacagttctgttttgtaagtgttgagaaaaactgagttttatttgtttgttgatcattttactattttaaaaaaatgtagtggggaggggggaaccagcctgtcctaactag

SEQ ID NO: 58614 - DNA, 1025 bp, Homo sapiens
tgggagaccaaggcaggagatcacttgaggtcaggagttccagaccagcctaaccaacatagtgaagccccatctctattacgaaaaattagccaggtgtggtggcaggcgcctgtaatcccagctacttgggaggctgaggcaggagaatcgcttgaacccaggagatggaggtggcagtgagccgagatcacgccactgcaccccagcctgggcaacagagcaagactccctctaaaaataaataaataagtaaaataaaatatcaaatagttttaataacaaaacatagtttttatagtccccagtttttattccccagaggcaccactttcaagtcttccggctgattttcttctatttgatattatctgttaacttcctaataagttgagaagttagccctgttgccctcattcctttctttccttcaataacataaaagttttttttttccccacatgaagttcagtactggtgtttgtggtcatgtgattattcaggactggggcactggttctcaaagtgtggtccagaaaccccagagaggtttccaggatcctgtcacagggtccataagatgtaaagtatttgtgtgtgtgtgtgtgtgtatgtgtgtgtgtgtgtgtgtgtgtgtttatgtttggcacgcttattttttccacaagtatacatggagttttccagtagccacatgacgtttgatgacatgatggcatcacactgttagctaatgaaacgtgcacttgtgtgttcttgtgttttccagaattttctgaggtaagaatacctcagtcgattgaatgcagagacaggtatgaaaattgacctgtgttctgttaaaccacatatcaaaaagccttgcagaaatgtaaaataaggccaatcactaaatgttttgttttggaaaaaagttacttttcgttaaaagcagttacatatattgatatgtattgtgtttatgtctttgtttttttcagtagacactgaacaaatactgataactggtttagtttagttagaaa

SEQ ID NO: 58615 - DNA, 1032 bp, Homo sapiens
ggacaacacagtgagactccatcttaaaaaaaaaaaaaggaattttatcttcaggtctattctgaagccacagggaagaattaaggataacctcaccgagatgaaagctaatatcacaaatgcctaaggaaggttcacttactgttccagcaagagagttaggtgttctccccattacaattatcattaaaacaaaaaaggatcttctgctaccttttggtggtgacaaggaagtgacaagacttcattccaatccgtaacaagtctcagagaaacaaaacttaaagggatagagcacatgggggcagtattaaaaagagcagagaaatcaggctgagtccctgcagcttaggggaacagattcaggtttggaggattaataaaatgggtttgggcaatctccaaccctacccagctcccatacaggatttaatttcttagtttagtcctctagtgtctatagcaatttgtatacctgtttgtatcacttatgtacacacatatctccccagttacactgtgatttccttcagggttagaagctttattttattcatcctgattcctcagtcccaacatagtacctgatacataaaaggtgcttaataaatgcaagtatgaagtatgtaacaggccgggcacagtggttcacacctgtaatctttgcactttgggaggccgaggtgggtggatcctgaggtcaagagtttgagaccaacctggacaacatgatgaaacccatctctactaaaaatacaaaaaattagccacgcgtgatggcgggcaactgtaatcccagctacttaggaggctgaggcagagaattgcttgaacccaagaggcagaggttgcaatgagctgagatcgcaccactgcacccagcttgggcaacgagtgaaactctgtctcaaaaaaaaaaaaaaaaaaaaaaaaaaaagtactgtaacaagtccaaaagccatgtgttgtaaatagcaatattcatcagtggccagtacatcacttaaatcaccctacaggtctttactggaa

SEQ ID NO: 58616 - DNA, 1871 bp, Homo sapiens
aacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttggtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcgttttc

SEQ ID NO: 58617 - DNA, 1349 bp, Homo sapiens
ccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgt

SEQ ID NO: 58618 - DNA, 1389 bp, Homo sapiens
tgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatc

SEQ ID NO: 58619 - DNA, 1093 bp, Homo sapiens
ggtggaacagtttcttcctgaaaccacctcccctgaccctgtctgtggaaaaattatcttccacgaaaccagtgcctgagcctaaaaggttggggaccactgctttaaaaggaggccactgcagttagttgctacattctttaatctcttttaagcgtggaacatttcttcaggtttgacttttgacacttgtgaaggtttcaggccagttactttgtaaaattccttgagtgtggatgtgtctgatgttttccttgtgattagactcaagttatgcatctttggcagattacaaagtgacactgtgcgcttgtcatgtggcatgcgatttcagtttgtcctgttactcatgatgttcactgtgatcacttgaggtagttcttccaggtttctcacactacaaagttactctttactctttttttttcactttgtaatgtatgtgtattttatgggaagttactttgaaactctataaagtccattcctcatcaaagtcaagtattactatttttaatatattatccattattatcattatgatattcaaactgtcccagatttgactctcctttggcctctatatgtttgatgagtccctaggcaatactttgtgaagggcttgatttttgttgtgttcaactcataatttacagtgttgctcacaatatatccggaagttatatatagatgggtcgggttacctacttttctttcttcttaaatttttacttcacctcattctacaaaaatttttaggctacttttaagaatgtggaccagtcacagtggcacatgcctgtaatcctagcatgtttgggaggcctaagtgggaggatcacttgagttcaggagttcgagagcagcctgggcaacatagtgagaccccccacatctctacaaaaagaaaaaaaaatgttacaaggccaggcgtggtggcttatgcctgtaatcccagcactaggccaaggcgggcagatcgcctgaggtcgggagttcttgaccaacctggccaacatggtgaaaccccgtctctactaaaaatatgaaaattagccgggcgtggtggcaggcacctgtaatcccagctact

SEQ ID NO: 58620 - DNA, 1138 bp, Homo sapiens
agtggtgcgatcttggctcattgcaaccgccacctcccgggctcaagtgatcctcccacctaagcctccccagtgcctgggactacaggtgcatgccaccatgcccagctaatttttttgtagttttgtagatatggcatttctccatattgctgagactagtctcaaactcctgttcaagtgatccacccacctcggcctcccaaagtgctgggattataggcgtgagccactgcacctggcctagaaatatcttatataaaagctaagagctcttttctattgattgataatcaatttatttctcatctttattggtcactttttctcctgattatttaatatatgacttatatgaaaactgttttccgggtttttttctgggattttgcagtatctaagaataagtagataactattattttattgtaggggcgcagatctctctgctttggtacgagaagcttctatctgtgccctgagacaggaaatggcaagacagaagagtggaaatgaaaaaggtacaattctctccagaatctctcaattctaattatgatacttaaaaccactgttgccctggaaaatgaccattttctagtgtctattatctatgatattaaagctaacgtttttctaataagactgttagaagctgttctgaaatattaggtaacctctgttgctgacaattataataatagcaaagttatttagtacctctctaataaagagtactgtccctataggcaaatggatccattcgctgtcttcatcatgagtctgggctgcttatcaattctggaaaaacgtattcttttgctaaggtgatatctacttgcctgttaaaatgcagcctaaattggagagcttagaaaatacacaagagaagtgaaatttggaataactttccatatgttgagactttcctttcaaaatataaaatctgtgtattgtgttatgtgatgctttggggccatctcaaaagctttgcaccatccttcacatttgacagtgtctttaatgttattatttgagtgcatatgggggaaaaaaattgtctgctgggtgtggtgactcacatctgtaatcccagcactttgggaagctgcggcaggaggattgcttgagcccagga

SEQ ID NO: 58621 - DNA, 1078 bp, Homo sapiens
ccaagatcacaccattgtactccattctgggcaacaagagtgaaacttcatctcaaaaaacaaaacaaacaaacaaacaaaaaagcttagtcttggtggggtgcagcggctcacacctataatcccagcactttgggaggctgaggcaagaggattgcttgaggccaggaggtcacgaccagcctggacagcatagcaagaccccatctctaccaaagaaacgaaagctagctgtagatttgccccaagggaagtgtattgtgacggttagatctttgagtaactcgaaaacatcagaccttgggatccattcagcctgagattgagtctcatttcttcctttatctagtgatgagaacttggacaaataatccctctaagcctcactttcctcatttagactggataataataggattgctggggaggtccactgatgagaacacattttgcacagtgtctgcatatagtgacgcctcagaaaattatcattgttatctcctttgcatggggaaatgtattatttttatgtggaagaaaatgggtatttttcctttgtattgagagctgatggaaccagatttatgtctttttagacaggggcaagtgtccgagtggtgaatcagctacttacagagatggatggtctggaagcacgccagcaggtttttattatggcagccactaacaggccaggtaagaaataaaaatattgtaacacagatgaatctaaaaacttacagcatttccgtagaagagattcagataattaaaaataaaagtaaaaactagtagcatttataaacaatataattcacatgcatcctaggaaaggaagattaaatttgggcaatccatttttggttctgtgaaaggaaacttcatagttgaaataaaggcttagaaagcttttgcataagctatagtaaaaagtatagtattactgcttggatcccatgagattgcttttctgtgtcggtgcttagaaagctctttttggctgagaacagttgcagcatacacttttttttttttttttttttgagacagaatctcgctctgtcacccaggctggcat

SEQ ID NO: 58622 - DNA, 1027 bp, Homo sapiens
atcttcaggcctcacagtcatgttgaaaataagcctgagaagctgggcgcagtggctcatgcctgtaatcccagcactttgggaggctgaggcaggtggatcacctgaggtcaggagttcaagaccagcctggccaacatggtgaaaccccgactctactaaaaatacaaaaattagccagacgtggtggcatgtgcctgtagtcccagctactcacgaggctaaggtgggaggattgcttgaacccaggaggcagaagttgcagtgagccaagatagcaccactgcactctagctgggtgacagagggagactcaaaaaaaaaaaaaaaccataaaatatgtatctggaaataatttgaacctgcagtataaaatggacatgtaatggatcgccgtttgtatcattatttccaggcaccagtacgcaacccagaccagttcaaagctcttggattggtgactccagctggggtcctccttgctggtcctcctggctgtgggaagactctgctggcgaaggtatcatataagttcaattgcatgtaatttatttcttagtatcagataggataatatgaacttaactttaaatattacagtgaggtaagtcttatgcataatttttatcagaagtttattttagcaaaactgacaactttcttcattaaagtttcctacttttttaaattacaaaggcacatgattgaaaaatgtttatatcaaccataatcctatcaattttaacatgcaattattatattttctgtgtattacattttagctttttagtgagtattattccatagttttagtttttacttgacttagtttcctgctttggtattgttattatttataacttaagtattttcctctatatttcttgtaattattttctaaaattgttttttcataatagaaaataaaaataagcaaaaaggaaaagcattgtgtgtaattctctcactgccacctactactattatttcatttcattgtcaatccttcagatatttttctatgcat

SEQ ID NO: 58623 - DNA, 1027 bp, Homo sapiens
ataggaaaattgccttccctctacttagttgataaaccatcaaggaaccatattaatgaattatactacctccagcataagtgttttaatttcatcaggattcaactgtttcttgaatatttataaatgaaacatgggaaatattatggttgctgaaatgaatatttgccaacgcttatatttgctatacctagccctagtatatagaagtcattcttatatgtttaattataattataattggtatatctttacttgaccagagcatatgatccttaagaataaaatgaacttgtctcatgtcagagagaaaattattaaaatacatagacgttcaggatagcttacggaaatattacagtaataatttttacaagtagaaaatgtaacttttcaatagctgttgtggtgtttctttatttttttcccctctattgttcccttcaaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggtaggtatatcagctgccaaatattattggcatgtcatggattaaagaccagagataaagctccatgcatgtgtactaggttctgtggctaaactgacttgactataatcactgtgtctaacttgacttgaatgtagcacttctttcaagcccccaacaatggtttttcttttgtttgagatccgatttgtttatttttttaaattgatgtatcatagttgtaaatatttttgggatacatgtgatattttgatacatatattaaatgtgtattgatgaagtcagggtaattgggatattcatcacctctaatgtttatgttttctttgtgttgggaacattatactttttttcttctag

SEQ ID NO: 58624 - DNA, 1027 bp, Homo sapiens
ccattctccttcctcagcctcccgagtagctgggactacaggtgcccgccaccacgcccagctaattttttgtatctttagtagagacggggtttcaccgtgttagccaggatggtcttgatctcctgacctcgtgatctgcctgcctcggcctcccaaagtgctgggattacaaggtgtgagccactgtgcctggccatgcccagctaatttttgtatgtttagtagagacgggattttgccatgttggccaggctaatctcaaactcttgacctcaggtgatttgcctgcctcagcctcccagagtgctgggattgcaggtgtgagccaccgcacctgccctcatcttgaatatctttactgcttttaagtttttattcagtaggtcttatcagaaattgttcaagatattcctttaataacaattatctagaagtccagatgtttatagataccatgttgccagttaggttgaacaaaattttccacacatgtagtacaggggatgaacaataggtaaagataaagttggagttgtaactgtcctaatatgaaatgggaagtatatggcaagataattttcaatgatgaagataattaatggtttgtgtgtatgtgggggcttttatttctggtagatatccatttaatctactctaaaagtacccccataagttatttatcttatttcccctgtaatgttgtaaattcttaaaggcaaaatattttttaaaaattctatgtattcgtcacagcacttagcatgtttcctaacaaagcagatatttaccataatcctttctggaataagatggaacatgtaataatgacagcgtttgttgagtgactgaactatttgatcttatatagtatccattttgatacctttggcagacgtgaaggacttcaaataaatatagttggtgacttgtttttactattagatcaggaatcagaaattttttcccctgtcttttctacagaatacttcaaacattgtgcagaaaactgaggcttcctcaagct

SEQ ID NO: 58625 - DNA, 1609 bp, Homo sapiens
aaaaataaaaaaataaaaaaattagccgggcgtggtggcgggcgcctgtagtcccaggtactcgggaggctgaggcaggagaatggcatgaacctgggaggcagagcttgccatgagctgagatggtgccactgcacttcagcctgggcgacagagcgagactccgtctcaaaaaaaaaaaaagaacacactgtataaactcctcatgatttaattagcatcttactaccttcttgttacctgtgagggaaaataacctcagactccctgctgttcaatcctggttcagctgagagaaataatacttaggaaagataagatttaagtcctcagttttgtccattcctagaaatacattcctagattaagccagaacagctgaagactattttgtattcccctgctcgaattaattttatcagtctattctgagacacagactttggcatcctccccagcctccctgttgtcctgctcaccttgcctggatgtgccatgcatgcttgaccctctgtgctttcactaatactctttcttctacatagaattccattagcctatatatctgcttgttaaaattgtatttacccttcaagccttttctgaaatgttaccacctccatgaaccctcccttattcctcagttggaattcatgatgtcttttctcttattaccatggtgctttgtttatatctgttattatacttcacaaaatttgtctgatgccatttttttatttacacactcaatgtttctcaatagattgtgaactgctgaggacagagtttgtattttatttatcctcctcacaccttttacatatttgacatttaataaatgttggttttatatgtatgttgctgtcaaaatctgtaatactttatctttaaccatgaaatgattctgtaaccattattgccgtcagtgtcaagtgctttgttcactactctttctctgtctcttactagatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaaggtatattcttatagaatgaagtttgtatgccactaagtcatcttaactgaatggtttgaaagtaagaggtgagaaataccaagtagccttttctttctctctctttctttttgtaccaattaaattgatttggaaaaggagaagcccacattaagaaaatcatttatgcctgggtgcagtggctcatgcctgtaatcccaacactttgggaggccgaggcaggaggatcacttgataccaggattttgagcctgggcaacatagtgtgaccctgtctctacaaaaaataaaatcagctgtgcacacacctgtagtcctagttactcaggaggctgaagcacaggaggattgcttgagcccaggagttcaaggctgcagtaagttatgattgtgtcactgtgctccaacctgggtgacagagggaggccccacctctgtaaaaaaagaggaagaaaacaatttactcatcagtaggataattgtttcaggttgttt

SEQ ID NO: 58626 - DNA, 1065 bp, Homo sapiens
ctcttatagcaaattatagggaaagacttggagattcttacgttagtagaaaccctcataacgtttctagtgagcttgggtttgctaatttaaagtttataaacttgttgtcttaagtttttttttctgtgcatatgcttatccaaaatcattgtttctgtttcatagcatagcaaatgtatctaatttacaaaagaatttcagtagatttatcacaaaacatgcattgatgaagagactataaatgtgttaccctatctgcagtctcttactgtgtacttctaatcatcttggttctcttaagtcaggtaaaaatcagaagtaacacatgtgaactgccttctttagggttattcttttggcaaatgatccttgaccttgaagattttttttaaaatgtatatgcttaattgtgcttcagtataggggatgcatttatgattgtctttttgtgatatttttatttctagtcaaatgcaccatgtatcattttcattgatgaaattgatgctattacccccaaaagagaagtggcttcaaaagatatggaacgaagaattgtagcccaactcctaacctgcatggatggttagtttaaaataataaattcattttaagagaataaattttttaaaatagtgtaattaatacatgaagataaaaaataatattcatatagtaaatatcaaatagtgtaaaaaaaaagtcatactgggcacagtggctcatgcctgtaatcctaacactttgggaggctaaggtaggaggattgcttgagcctagtagtttgaggccagcctgggcaacatagcgagatgctacctctaaaaataaataaaaagaaatagcacttgttttgtgtacacaagaaaatttgaagtatatattttatgttccttgcattaccagattgtaggttgcttcttcttctgattgatggactgattgattgattgatgagatagagtgttgctctgtcacccaggctggaatgcagtggcacaatcacagctcaccgcagccttgacctcctgggctcaagtgatcctcccatttaagcctccc

SEQ ID NO: 58627 - DNA, 2650 bp, Homo sapiens
gaaggtatccacttaaatgtgtttgcatgaaaccgttgattttttttttttttgagatggagttttgctcttgttgcccaggctggagtgcaatggcgcgatctcggctcactacaacctccgcctcccaggttcaagcaattcttctgcctcagccttcccaagtagctgggattataggcatgcaccaccatgcatggctaatttttgtatttttagtaaaaatggggtttctccatgttggtcagggtggtctcgaactcctgacctcaggtgatccgcccacctcagcctcccaaagtagtgggattataggcctgagccaccatgcccggccaaaaccattgattttcaaatagtgtttttcactgggccaacataaaaagatgaagttcctcaggaaactagctatttaaaaaatttgaggggactggataagaaaaagtagggaaattaaaatttgaatatttggttattcttttatgtgtctgcataggaacttgacctgccaattttgaaagtggctgctccagagattgtgtctggagtatccggagagtctgagcagaagctgagagaactatttgagcaagctgtggtgagtcagttaatgactaatgccaggtggtcagacgctaccagcttatattaaagatcctgctttttctgatgctagtatttgttaacccactcactggccattcttttattaatataaacatggtaatttgctatgcatgatggctaaatatttaaagtagatttagtgataccagctgttggataaataacccttttcatttgaaatcaaacataaatgtaattggtgagaaattctgggccgtcataccctgtagtcatatgttgaaaatatattatccttatgatattttccactcacttttactttcctcaacttaagtttggccaaaaaaaacttgtaagcaatgtaaaaattgttatttaggctattataaaagcaaccataaaaataccagaataaattctgtcattccttactagtaaactagggcaataataatacccaaatctcacgtggctattgagagtattaaatgagagaattcttataaaaccttcgatatggtgccttgcacacagcacaagccctgtaaatattagctgtaagattattcacacttgaacaaatatcactgtgtttaaaactaaaaaatggtgaaaagtttatgtcattattagcaatgacaatatatagtagctgatgaatatccaatacaactgttagaagcctgtgtgaaattagaagagaaattatatttaagcagtaattgagaaaaaaaaaacattttaaataacaagaatgggtaggccatctacttagttatggtgcgggctgacgttgaaaaagctgtgggcaacactaggaggataaagagaaaaaaggtggaaagggcagagtgcagagcaaagctgaactttctcaggtgctacctgttttccaaaacgcggtggattccattgttaaattggcacgcatagccagagacaagtagtaaattttgtgcgtatggtaaacacgatgaataaggataagaggcaaatggcatctttaggttgttagttctgtgtttaaacctctcactaaaccagtactgagccagtacagtacctcacagtagatgctcagtaaatatgtggcctagcaccccgcttttcctggtcccctcttcgctaatgagaatgagtccagtaaagcatgtggatcaggaaacaaaaaggtgaaatccaatcaagtgatacttggttgaaaactatgctttctttaggccacattctgatgaccatcatttattcttttttttcccccattcaactttccaggtcactgacaagtactgatgtgcttgttttctggtgcttttggcctctgtaattttactcctttgtaactgggtaatatatctagcagtcataggcgtcttttgcaaacattgtcataaggatgattagggaagagatccagctagcgataagctaaatatctttccctttaagatgtggttgttcccatggttttgagatgccttaagcgacgctgacagccttacttagcataatcactgtcactcctaaccattgagtaactgattgagtaaaatgatttagattgtaaatctagataattttcttcaatttttttcattttaactgatccttatctcttttttgtggtaaaatatatataacagaatttaccattttaaacatttttttaagtttttgtaaattattttatgtcttccatgatgatttagagggactatcttcaaaccagtacagatatttcataaataatacctggctgttttctaaccaactgagtaatttgttgcataataagccacctcacatctttcagcaagaaatacattaaatttgaatagtaaagatattacacaatgaattaggacaacaatttaaatttgctttaaatgtttctttgcggaagaggacactacacttctactcaatgaagagaaacatttttacagtccagaggtcttttattaccacctattatgccatgaattcacagggaagaggctccagcagttcaggctccttcctattggttctcagagtgcacttctctgggtggagcatgctg

SEQ ID NO: 58628 - DNA, 1047 bp, Homo sapiens
gtgagccactgcgcccggccgagtgaagtctttttgaatagtaaatgcttgtttgtgagtcatcttattgtgaacacccatatattcttttctttttttttttttttttgagatggagtctcactctgtcacccaggctggagtgcagtggtgtgatctcggctcactgcaacttccgcctgctgggttcaagtgattctcctgcctcagcctcccaagtagctgggattacaggtgcctaccactgcgcccggctaatttttgtatttttactagagacggtgttacaccatgttggctaggctggtcttgaactcctgacctcaagtgatctgcccacctcggcctcccaaagtgctgggattacaggcataagccactgtgcccagcctaacacctatatattctgattataaatgttctgagagaagttgttaaaaaacaaaatatagaaaacttattactataggcaatacaacttttatgagtacctgttgagtaatttatgctacaattttgttttatctttctgccagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggtatttttgtaatgaaattttagccccatatcatcgaagtacatttcaaccttttagttgaatataatatcaatcagatacttgtgttttgtggaaggcataggaactttaaaatatatggagaatttgatcacattgcactgctttccattctttctatcctagtctaagccttttctcattcttgacttaattattgaaacagccttctagctggagtctgtgtcctttcttgttc

SEQ ID NO: 58629 - DNA, 1059 bp, Homo sapiens
agtcttgcagaagttgtatttggttacatgctttggtcatgttgactttgtgaatttgttactcagagtacttaattataggttgctgaaatatttcctctacctgaatctgatatccctaaatgggacccttgggcctgagggaatttgtatctcacttttatttattgctaggataaatataactataatttattttgcatttattatattttgtaaatgcataaggactttgcaagtgtttatttaatcctttaataaccctgggagacagacattacttattaaatctccgttttatagataaggaagctgacgcttagagaggttaagtaataactggttaagttggattttgaatcctagtttctctgattccagagtttggactcttaaccaccataatcttttggctgaatatatttacttgttttgggtagtcatttttttaggatatgggagagaaagtctttaaaacatttttccctccttttactgaggtatactgaaagctattctgatgatgattcaagtatggaagactacccagatccacaggtaagccaaacatttagtgggtccacttagattttttcttttttagttgttatggtacctcccttgaaaaactcagtattagctggacatggtgactcacacctctaatcccaacactttgggaggctgaggcatgcagatcacttgagcccaggaatttgagaccagcctgggcaacatggcaaaaccttgtctctataaaaagtatgaaaaaataagtctggccaacatggtgaaaccttgtctctacaaaaaatacaaaagttagccgggcatggtggcatgcacctgtggtcccagctacttggggggctgaggtgggagaatcacttgagcccaggaggtcaaggctgtagtgagctgcagtgagccgtgattgcaccactgcactccagcctgggtgacagagtgagaccctaccttttaaaaaaaaaaataaggctagctgtcgtggctcacgcctgtaatcccagcactttggaaggccaaggagggtggatc

SEQ ID NO: 58630 - DNA, 1199 bp, Homo sapiens
tccctatgttggcagggatggtctcaaactcctaggctcaagtgattctcccacctcagcctcccaaagtgctgggattacaggcatgagccactgtgcctggcctagaacttattttcaaatggttttgctctacccctccaaaagaaatctctatatgtagacagaagtaaagtaaatgtggcagtttgagaatactataggtaaagaatatacgagtgttgattacattatttctttcatatttttagtaactttgaaattttaaaataaaaatatttgaagcaaaaaaggttagtttaaaaaagggggaaaatggagaaaggtcacaatagtaaatatataaacttagaagtttgaaaatagggttatggcaagtgtctatactgtaacaatgaaatattcatgaaaatttatttgatccatttagattgaacttaatggaaaaatattggtggagactactatggtaaacttcttgttttcttttttcagtatagactatggtcgaagaaaaagaaatgcttttaggattcaggtagaaaaaggtgagtcttattgttagagctaaattatcaataaagttatacaaacgattgttttagctcatagcgtttttctttttgtttcagtatttagcataattagtagtgagaaggaacttaagaatttaacagaattagaagatgaacatttggcaaaaagggcaagacaaggtgaagaggataatgagtaagtataccaaatgcagggtttttttaaaccatgaactttatcatgttacattcctgcttgtaaaactttcagtggctcttcattgccaacaaagccctgcgtgatatttacctaacctcttcagccatattgaatgttctttattccccaaagagatcaaattctctttggctgtgcctttgtatgggtggttttattgagttagagtgtcatttccctttcacaaactcccacacagccctcaagaatcagttgaaatgttactgcctttattaggcctaagacccctttttaaatgtttccttagcttctagttacagatatttgttataatccttatcatatcatacggcattgaaattatttgcttacttgtttgcattaccaacagtactgtctcattaccttctttttctgccctaatacaatatcagatatataaaaaggtgctgattaattttgtt

SEQ ID NO: 58631 - DNA, 1070 bp, Homo sapiens
atgccactgcactccagcctgggcgacagagtgagaccctgtctcaaaaaataaaataaaatgagaaataataaaataaaattagctgggcatgtcgggaggctgaggtggaaggattgcttgagcccaggaattcgaggtcatagtgagctctatcacgccactgcactccagcctggacgacagagcaagaccccagctctttaaaagaaaagcgttgagtaaatacttgttgattaattccatttctggaaataatcggatttatgaaagaggccctgcccacctctttgatatggacttgtactaatgaactacaattcccagcatgcgtcagaattagggccgtagagttttttaaaatatggactacaactcccggcatgccacaccaggattcgaggaccacacgcctcagccagccccggcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcgtatccttgcctgaggcaggcgaacgccttgccgggggacacggctgagggtgggccagttgggcacccgggcaggtgtgtgggactagggaggcgcccggcggcgggcgtgggctccctgggagctggcctggccggggcggtggcgcgggccccggagcgggtaggagaggctggctgccctacccgacgggccctgctgccctgcacgcacttgccctgcctgggttgccggccgcccctcactcgggtccgagtgggcctctccgggcgcgccccgtctcggcctgcccgcctgctctccgctcgtccccgcggcgcccggaccagccctgcctgagccacggccgccctcgggagagaagcgtcgctgtttttctgggagaggccctgcgccgtgctcttcgtcggatattgggggtcccaagggcggtcgcttgcgacagtcgggtgccgggataagtgcgggccatttgcctcctcctgttccccacgcaac

SEQ ID NO: 58632 - DNA, 1602 bp, Homo sapiens
atctaggcttagttgttgcccaatgttgtattgcaccatccaggtttaagtaattaaatataagaaaaaacgtatgaggaactccgcatttcagcttcctttcttggaaatcacatgtacctgtttctgatcggattaaaccatttgtttgctagagcatgcgggctttaggatagtcgtacagagtatatgttcagtgcagcttcatttttcattgtggactggcatcctgttgtagtggaaagggacaaaatttggaatcagatttcctggtcagctagctctttgcttgcacattatttccctaagcctcagttttctgatctttaaaataggaaatgtttatttcctagatatgcacaatgagaatggtgctgagcaccctagcacagtgcctgccccatagctaatgttcagtaaatattgctctgccttcgtgtccccaccctccccaattgagcagcagtttttactttgatgatatctaacgacaagatttctgagttttagtaggtttggggagctgattgaaagggcagcatcacttgcctaagttttgatgacctctatgcccctcttgtgatataaggaactagagcaagcttgtccaacccacggcccacgggctgcatgtggtccaggacagctttgaatgtggcccaacacaaatttgtaaactttcttaaaacattatgattcttttttggtgatttttttttaagttcatcagctatcattagtattagtgtattttatgtgtggcccaaggcaattcttcttccagtgtggcccagggaagccaaaagattggacacccctgaactagagcttatgctcagaaatgtagctgggttttttctttttgcagtttggaaaaccaggcttgataattttaaatagccctggtttacaccaatttatgcatttagagaaatggtaggtggaatgtttgacttagacattacattaaaatacattcggggggtgttttgatgaaattcagcatattctgtattttagaatagttgcactaacttagggataggaggtggaaaatggtcacggtagacttaatataggatataagagttttcttggactttgaactgtggacaaaatctacaggaaggggaagaggtgaatattccaaatcagacactggcaagagcgaaggtgcagagacaggtatgttcgtggatttctgggctatggttaacgaatagaccatctggagcacatggttgattttggcgtcagtagaaggctaagttggaaaggcaggattacatcagattttggagggcttgaatgttaagggtgggagggaagtctttcacttttatcctgcaggcaatagagagccattgaaaatttttattttcggtagtttattaggaagatgaatctgccgagtgggttggaaacaagaaagattggaagataaaccaactggatagggtcgtctggatttcaaatagagtgctggttgtgggcaggtgaaaggagggaatatgtgagtagtatttagaagaaatgattgccaggacctacaaatgagtgattatgatatatgaaacagaaggcagagatagctttccatat

SEQ ID NO: 58633 - DNA, 1076 bp, Homo sapiens
tacattcttattattttttgtttttctctgaatatgaaatggtttcctcgggattctggagattggaaaatgtttaacgttgctattctgacttgaaaggcaacatgtgtgtggatatcagacatcccaaattagagctaggggctttggcatagatactagaataggaactaaacaatactctttttttctctagttctcattcaaatctgcttaatgaatgaacctaagcctttgcttaggataaaaagtaattgaaatttaagtgctttatttttaagttgtgccctgatatatttgcatgggatacaaagttatagcagtatgcaaatctgggacatgggagtctaaaaataatcttgaaacagtagcttgtaaattctctgtacgttcattgatttagtttcaaataacatgtacagtcaggaaggacatagcagtgagatgtaatactgtgttcttccattgcagtgggtaattccagaattgattggccataccattgtcactgtattactgctcatgtcattgcactggttcatcttccttctcaacttacctgttgccacttggaatatatatcggtgagtatagtttgtttactttggtgtcaaggtagttaaaaaaaaatttaaaaagttgtgtttttttcaagacaggatcttactctgttacccaggctggagtgcagtggtgtgatctcagctcactgcaatttctgcctcctcagtttaagcgattctcccacttcagcctcccaagtagctgggactacaggcgtgcaccaccacacctggctaatttttgtatttttactagagacagggtttcaccatgttggcccggctggtcttgaactcctgacctcaggtgatctgctggtctcggcctcccaaagggctgggattatttataggtgtgagccaaaaaaggtgtttaagagctttttttctttttttttggagatggagtctcactctgtcacccaggctggagtacagtggcttgatctcagctcactgcaacttccgcctcctgggttcaagccattctcctgcctcagcctcctgagtagc

SEQ ID NO: 58634 - DNA, 3110 bp, Homo sapiens
aggtgccctagagccaatcacaaaacctgagtaagaagttactgctttgatggagtggtgggatggggagaagaggttccaggcatagaacagtatgtatctggctagagaatttaaaggtttttttttctggacataggtgttttttgttttgttttgtttttttttaactgagctaggttgtttttgttttgttttgtttttatttttttaactatagcctaacataggttttaagttgtacttcccccaactccccacccccagtcactcttttttagtgaaaaagtttggacatgaaagatcctaatatattctttcctttgggtatgaatgattgtcttttactcaaatgattgttcctttgtgaaccttagggacgcaagtctggacaaaccaggctctgtaggaacattcctgagaaaacattagtgacattcatttcttctttccacagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatctttttttttttttttttgagatggggtcttgctgtgttgcccaggctggagtgcagtggtgtgatctcagctcactgcaacctctgctttctgggttcaagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctcccctt

SEQ ID NO: 58635 - DNA, 1003 bp, Homo sapiens
gtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaacctgattgtggtgttctattgctttttcagcaagaagtcaaactgatggcctttaagtcagagaagcagcaatggagcaacataatcaaagttgaccatctttgttttcaagacagtcacattatgaaatattctgacatgctaggctaggaaatggctataactggttcacttgagactggagaaatcagctttgctaacaggtaatactttgtcaagtagtgagaaatattatatactaggtataattagttgtccccaaaatctaaataaacttgttctaatatatggaaaagggcagcaagatagagaaggtaagtttgaaattctacaat

SEQ ID NO: 58636 - DNA, 1660 bp, Homo sapiens
ccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataattcttggtgtgttacatctcctaatatccattaatctgaatgtttaagtagtactctttttgcctaaaacatttgctgattttttatgtattttagagagagtctcactgtgttgcccagactggacttgaactgctgggctcaaaatatcctcctgactcagcctctcaaaagtgctgaaataacagacacaaaccatcatgcctggctatgatttgctgaatttgccttccatatatgtacctagagtttgtgagtgatagctaaagaagcagtggttagtctgttgggatcatctttttttttttttttttttttttttttgagacggagtcttgccctgtcgcccaggctggagtgcagtcgtgcgatctcggctcagtgcaacctctgcctcccgggttcaagtgattcttctgcctcagcttcccaagtagctgggactacaggcgcccgccaccacgcccagctaa

SEQ ID NO: 58637 - DNA, 1062 bp, Homo sapiens
aaaaaaaaaaaaaaaaagatgatcccaacagactaaccactgcttctttagctatcactcacaaactctaggtacatatatggaaggcaaattcagcaaatcatagccaggcatgatggtttgtgtctgttatttcagcacttttgagaggctgagtcaggaggatattttgagcccagcagttcaagtccagtctgggcaacacagtgagactctctctaaaatacataaaaaatcagcaaatgttttaggcaaaaagagtactacttaaacattcagattaatggatattaggagatgtaacacaccaagaattatttaggtattcattctgtttattggattgaaagaaagggaatacaaacgactggttaagtgctgcgcactgacatggaaaaagtgtctttaaaaaaaaatcccagtaaagcaaatcaaagttaatgtagtttcagttgaacaaaaatttaaagacgtttaatacattacacatttataaaataaaagtcaacaaagggtgttttgtaaataattagtaaacaagtgaaaataaatatcagagacctgaagtttttatactttaatgaataaagcaaagaaatttaaactaagtaaatataatctgagaggcagttaaaaaaacaaaaatcaaaacccaccaaaattgaagaacacaatcttttgaaacatttaatcagtccatagcaaatagttattacataccaaaagctctaagtgttaactagttccaccacaatgccatgtaaatcttgacaatttagaaatcttgagatcaacacttaagttcttttcttgatctctacagcttggtttgtaagtacatacatgcttttgtggatctattcccctcgccacacacacacattttcaaggagccaataacatttttttccatctgtgcctaaaaatgttacaattcagttctagcacattgaccctgataatgaaaatgtttaagttaaagatggggacacaatttcaatcttataaaaatataccagtattaaccaaaccttaaactcagagggcacttcacatgtgcac

SEQ ID NO: 58638 - DNA, 2411 bp, Homo sapiens
caatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctacggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaa

SEQ ID NO: 58639 - DNA, 2328 bp, Homo sapiens
gtagaattaaggttttttttttgttttttttttttttttttttgagacagagttttgctcttgttgcccaggctggagtgcaatggcgcaatctcggctcaccacaacctccgcctcctgggttcaagcaattctgcctcagcctcctgagtagctgggattacaggcatgcatcaccacgcccggctaattttgtatttttagtaaagatggggtttttccatgttggtcaggctggtcttgaactcccgacttcaggtgaagtcggcctgtcttggcctcccaaagtactgggattacaggcatgatatttttttttttaaggatgcataaaatggaatagaaggaagtaccgatgcatgctacagtatgaatggaccttgaaaacaatatgctaagtgaaagaagcaggacacaagaccacatattatgattccatttatatgaaatagtctagacagatctatagacaacatagatatagtgattacttagggcttggggaagtgtttgactgctaatgaatgttgaaaatgttctaaaattgattgttaatgattgcataattctgtgggtacactaaaaaccattgattttacacttttgttttttttgtttttgtgtttgtttctgttttgagatggagtctcactctgtcgcccaggctgaagtgcagtggtgcaatctcggctcactgcaacctccgcctcccgggttcaaagtgtacactttaaatggttgctttgtatagaatatgaattatatctcaaagctgttatacacctccccaaaaaaatggagtaggatgatactgtagaatttcaaacagagcaaccaaaaggaaaattaacaactccatagttataacacgttattctaccttagactgccagatctttctttcctctttactattgtagctatcataaaaatttatctattctgctaactatctcaaggttaattttaaaagtatgagattctgaggctaggcacggtggccagtgccttataatcccaacattttgggaggccaaggcaggcagattgcttgagctcaggagttcaagaccagcctgggcaacatggcgaaaccctgtctctacaaaaaatacaaaaagtagccaggcatggtggcatgtgcctgtagtcctggctactcaggaagcagaggtggaaggatcacttgagccaaggaggcagaggttgcagtgagcccaaattacatcaccagcctgagcagcagagtgggatcctgtctcaaaaaaataaaagcatgagattctaacatgattattcacttgggtttcttcagtattcaaaatcatgaatttagatcataatatatggtctaagacatgatacagacattgttttaatgagtatgatgaaagtttcaagaatttgctttgattttttaatgttagtataattttgtaatgtcataatgctaattttgaaactttctaactggtaatttttttctctccttcccctcttccctcccccgcccgccccccatacatttcatcttgtcttcattcagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcc

SEQ ID NO: 58640 - DNA, 1514 bp, Homo sapiens
tccatagaatttatcactatctctatcctggatttgtttatgttcaaaggccttgatttataattcttcattactcatgtattgacagaatattgcagatagtttttttgtgtgtgacttgatgagagctgatcacctttaacaggaaaaaagtgtatatttgatttaaacattttttcataaggtaacatgttaaactattcatggtatatttattttccctttaagttctagtaaagagtcctgtgtgtagtgaatgataaatttaagatcagttagttggttttattaatgtaaaacttttttctgaattactatatgttcagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaaggtaatacctttgtataatgttactatgttttgtccaaatgaaacatcactcggcttattatgaacttaaagcagttttaagcaagtttatttaaagtgtggtatatgatttctctcttttacatattgtaccctatctcaggccacagaatgagtttaagtagtgtaagagccaataatgtagtggttgttttggggggcacagtgaaaagaataagctggaatatgatacctcattgacatccagttagctatttagtagtttcactttaaaaatgttactgaaaatcttgcttcgtcatgctacctaaacgtaatattgtaggaagaattttatacacatgaaactaaccatacaaaatattaacaactttagatattaaatatcttgattatagattttactctttaaaaaaaagtaaacgtctgtttgcaccatgcatcatactaacatgagttgtgtttaatggatagggaaagagaagagagaactaaaattgatcatgtacctgtgtgccaagcagcatgctaatccctttacatatactgtcttgcataaagtcttcatagtcctataagggaagtatttttatctttatttttagaggtaaggaaactgcagcatggcaaaactaattcacttgttgagtgccatcaggtcttcaagtctaagtctgaaaggttttttccaccactttgagatacttggggatgaagaaaggccaaaatataaggctaacagttaaagccaaaaacttaattgaacatgatatatcagtactacagcaaagagataatgagaaacttcatgtaaatgactctcttaaatagagcacgtaaaatgtttggtttgcttagaaggaagcagtttatatataaacagattttttgttaagcatgtcccacctaaattttttttttttttttagtgagaaagatgactaattgctctcagttaagtgattctctgtggaggagggttatcggagtagcatgtatggtt

SEQ ID NO: 58641 - DNA, 1583 bp, Homo sapiens
ggtgcaaccacttggaaaacagtttggcagtttctcaaaatgttaaacagagttagcatacgacccagaaattccactcctatgtatatacccaagagaaatggaaacatatgtctacacaaaaactcatacatattcataacagcattattcataatagccaaaaagtagagaaacagtccaaatgttcatcacctcatgaatggataaacaaaataattatactgttaaatattattcagcaataaaaagagattaaatactaatacattctataacacggatgaaccctgaaaacatgctaactgaaagaagccaattaaaagagaccacatcatgtataagcctatttatgtgaaacgtccagaataggcaaatctatagagacagagacagaaagtagtggttgccaggggctgcagggaggggtatggcagctgctgatgggtaggaggtttctttgggaaatgatgagaatgttctaaaaattagatggtgtgatggttgcacaactctgaatatactaaaatatactgagttgtatactttaaaaggatgaattttatggtaagttatatctcaagttgtttaaaaatatgtaagagatagctcttattatacccatctgttttcagttgccttgaaagctttctaaggtcaaattcaatatatctttatacatatattaaaaatgttaatatatctttatattttcatcaagtacacaatgacttgtatatagtagatgcctaatagtgtagtagatgcttaatagatgttgcaatgtgaatgagtctttatgaagcaagctgttaaagggaaaattggtctgaaaatttcctcagattaaattatcaaagtacatctttgtagctatttaagttcttacattgggaaacaatgactttagtgataggggttaactgaattgtttattttccctcccaggatacacacctgctaaaactgcttaaaacattagaaggacatgcttatggcgtttcttatattgcatggagtccagatgacaactatcttgttgcttgtggcccagatgactgctctgagctttggctttggaatgtacaagtgagcgagttccatctttggttgagcttttaagtacagcatagtcataatgtacatattcattataactttattgatttatataatataaccattcaacctaaattactatactgtatctcttagttattcaagtggaacccaagtttccagatttatcaatttaagtattatgctcagtaatatatttttggaagaatgatcagtaagtgttttcaggatgtttggctttgtcctatggaatttatgctatttactgtggttcttcagaaagaattttataatggtttcatagtttcacaattgtacattacacctacctttgaaatgttaaaggtcagcattaaaccaaattttcgattctgatggcagttgcaccatctccttgcctatatttaatatactaagctagtttagtgaagctaactgatgttttcagtacttattcctaagggctttattgcttggtttgttcgtttgtttgtttgtttttg

SEQ ID NO: 58642 - DNA, 1014 bp, Homo sapiens
gcttgcaatgagctgagatcacaccactgcactctagcctgggcgacagagtgagacttcatctcagaaaaaaaaaaaagaaagaaaaaagcagttcagagttttacagaggaatgaaagcatcctttttcttctgaaataaccactgattagaaggtcttctctgtaatcttaaaacaaaaccttcactctatgctcctacttacctctctttctctctccccctccactttagagctgacttcttgaaatcattgcctactacacattcgcaatgtctttgtccttacttttccttcactcttcatatttctttagtattaggacctgtgtagctaacataataccagaattgtagatgttggtgagaatacctctttcacattcagtggatattttccagcctatatcttcaccttactatagcactgtactactttactttgaaacttttcctttgacttctaaaacattctagattcttagtttaactcctggctactccttaggctcttcttctttacctgtccctttaagaaatacatgttccaggccgggtgcagtggctcacgcctgtaatcccagtatttggggggccgaggcgagtggatcacgaggtcgggagatcaagaccatcctggctaaaatggtgtaaccctgtctctactaaaaatacaaaaaaaatagccgggcatggcggcacacgcctgtagtcccagctactcaggaggctgaggcaggagaatcacttgaacctgggaggcagaggttgcagtgagcagagatcacgccactgcactccagcttgggcgacagagcaagactccgtctcaaaaaaaaaaaaaaaaaaaaaaaaagaaagaaatacgtgttccagaattgtttcttccctcatccttagttatacttccatggttctaatgacaactagatacaggccagagctacagaatttatctcctgagccttagaccttaatgccacaatttgggttctcaagtacattaaacacag

SEQ ID NO: 58643 - DNA, 1134 bp, Homo sapiens
acaggctctaaaaatggctagaacaacagctattaacttatggtttgggttttttttaccatgtgtacccatgtccataatttaacttgtaagaattcaggcttctctttcgacattaggagtattttgagtaaaaatatacctactattttaatggtctctaaaattaaagtatagctttattttgttcttgatgtttttgttggtttcttttttagacacagcctctctgttgcccaggatagagtgcagtggcatgatcataggctactatatagccttaggctcaagtgatccactcacctcagccttctgagtagctaggactatataggcatgcactaccatgcctggctaattcttaagtttttttgtagagatggggtctcttgccccagctggtcttgaacttctggtctcaagcaatcgatacttctgccttggcctcccaaagcactgggattacaggcgtgagcctccatgctgggcctaaagcatagctttaattttaagatatcgaataacaaattgtgaaatatttcagacttcaagaatgaaataatttgaatctggtgaaccaaacaaaaaggagaatagagaatagctgcaatgcatgtgctcagttgcttttaccagtgatatcaaagaactaatgaaagtaacataaataaggacaaaaacatattaagtatgaggactttggaataacgaggaacttctgaataaccgtaaaaattgtctatatatgcatatctctactgtgatataaaataattttttacatgtgtataaaccacttttgtacctattgagtttttaacctcactctccctacttgaagtacaaaaataataattgtttgagatattggccttactttatcttaaaatattagattattacttggtacatatcttaaatattctacaaggaagtgattagaaattttttcccctatcccttttaaactctttaataatgttcattgacctgcttctgaggatttaaaaatctttttgtataaaattgaatagcaataggaagagataatagattaaaagactatatagtttcatggttcatagctccattcgcagatttgagaacagtgttaaaattaagacgcttgtgaac

SEQ ID NO: 58644 - DNA, 1067 bp, Homo sapiens
ttatgtgatgatgttcccccttaagattttgtttgggggaaaagtactgtgttaagagaaaaaaatatgtaaaccacagttttaagtcacaagtgctttaaagattttgttgatttcaatagtaaggtccaggtttctttaggtaaattgttttattcttccccaaccatgttatgtttattctagattgtaatgcaggtttcatttttgctgtatttttatgtaaaagatgttctctctgaaaattatatgattctataattttgatgttgaaatgacagtgacgatcctaagaatcacaaagccgtgcagttggggaggtataagggattcaaggattgcagtaggttggtatggatatcaaaacaccagttactccctgaattcacacagtatctttggcatttggagcaatttgtacttgatcttagccaaaaggccaagaggcgatttttagagcagtttgatgggaactagaacttaacctattgcaacatttgccaaaattttgctatttgttaagtggagattttacttacacctggtctcctggtacacaataatatctaatattcttttcattgttgtcttctttttcttcattttgttgttgttattcctcacttatcctccctgcccctagaaaatccacatataaagtaaacccctcccaccaaatatatccaattttatgagcagcatagctattgctgctgacaaatattcgtaaagctcacgtatcgcataacgcagaacttctctatttaaggaatagatactattggggtaggaacaagtacagcagaagatgagcaaatgtcttaaataaaagtttacagtttattattatttctcttttttaaaatatcttctattaaagcctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggtaagaggaaaacttcctatattctgaaac

SEQ ID NO: 58645 - DNA, 3209 bp, Homo sapiens
gagcaacagcagaatttacgacgtgaaactatcattcaagctatcctagtcacttaacaatttcaaatttattagatattaaaatggagaaggagatcttgctgggcccagagatggtaaaaaatcattagagaccagaaataatctcttaagagatctagttgggagttggggaaagacataaaggagagtttattttcctaatctttttttgtctttatttcttcaagattttttaaaaaatataaacattagtagagccctgtccccatctcagcaagctttaattttgtctgatttttacaatgttttcagtaaatatttaacattatttgttaattaaagggtctttgctttcttgaggttatatttacatttttgtgctttaaattttgggaggtaaaatacagttttactccccacccttatcgtatgtgtcaaatacttcaactgattttttggagaataaacattttctttcaaacagatctctagctgtgcttggccagcagcatgttagttgccatgcacaataccaggatttgatatctgtttgagaatattcttggtcttgatctggataaaatgactcatagagaaatgctcttgtgctacttttatagcattccctgtatatacagaaatatgtgtttatattggcttctctcagagttttagtcagcctttctctgctctcctgccccacctctgccccatagaaaaagagtaacatgttgtatcaagatcttggtgggaaaataagggagaaatagcgctttgggcactgtccctgcacacattggaatgggggaggggtgggcataggagcctaatgattgataccaaaaaaaataaatattaagtaaataaaaaacttgccctgaaatttttttttaagcccctcaattcccaattactaagaaaatttagtgaagaaattacatctcatgctctggccagttccatgtgacatttaaatgaaaaagttctgcaactgaataagattttcaagtttgaatttaaaaaataccacaaaatggaatgaaactttttttttttttttttttttttggagacagagttttgctctcgttgcccaggctagagtgcagtagcacaatctcggctcactgcaacctccaccttccagtttcaatcgattctcctgcctcagcctccgaagtagctgggattacaggcacccgctgccacacccagctaatttttttgtatttttttttttagtagagacggggtttcaccatgtttgtcaggctggtctcgaactgctgacctcgtgatccacccgcctcagcctcccaaagtgctgggattacaggtgtgagccaccacacccggtggaatgaaacttttaacattatattgataaatgaaaatatatgaggtcttcatttcatagttgcatttttttcagaagctaaaatggtgcgaatatccagaataacttcaaatataaaattcttttatttttagattttttttttttttgcattgtttagtttttggtttctgtgacctgatgaatgacaaagttttttcatttaacatagaaaggttaacttcaggctgtatgtacagtaatgtacttttcagagcatcttggtaattaatgtatttctgaaacattcattagtcattctaaatttatatgtaaaatttgataagtgtaattttcccagagttacaggagtgtctcagtttgaatttttttctgttccttagccgtatatttaagatgagatttgtatcaagcaaaagaaatgtatcttataaatttaaatacatgcctaacttatatgagagggtttattattgcttactttctctagaaaccacttttataagcttacagtttatatctctcttctaaatactccttgatagaaaatcttgtagagcagtttattatactgttaattctgcaaataaatggtaatttctccacagcatttcgtgacagcagtgtatttttttatggttttaaagtaagcattttgggccgggtgcggtgtctcatgcctgtaatcccagcactttgggaggccaaggtgggcagatcacttgaggtcaggagttcaagaccagcctggccaacatggcaaaaccctgtctctactaaaaatacaaaaattagctgggtgtggtggcgggtgcctgtaatcccagctacttaggaggctgaggcaggagaatcgcgtgaacccaggaggcagaggttgtagtaagccaagatcacgccactgcactctagcctgggccacagtgagactctgtctcaaaaaaaaaagaagaaaagcatcttacgaagaagaaaaattgtactttaagttttaattttaagtggacttgagatctttaccgctgtattccttggagtctctaaatatgactaacatttcctacctactgatgtctctgtttacattaattggcttgctcaagctccacaagtagcaactatgatgaaaaggtccctccaacctgtggtccttaattaggtttaaggtttaaaagaagtttcaaaatgatgtttataaatatcccttttctcttgtaaaaaactgctaagattgtgaccacgtggtttcaagttaaaagtaaaataataaagtagcatttaaaagtattaaagtcaaaaacacagttcaggaaaaaactaaatgtgaaagtgtctcacagctggaaagtggtttattggtttaggggagaaaagagcgaataataatttcctgtgcttcacttttaaatgcatcagtgatcagattgtcagaaatacacaagtacaaatattgaatctttttaaaaacctttaagttcaaccatctaacgtagacatcccttaatagccgcctagaagagagtgagtgcatcaagcttatgcttgtccacgttagttgtaggaaattcaatactttgcacaccaacttgtagtacatttgttggacagctcttaacttttgataagccaaaatatacttttctccttctcctgagtgtgtctagttctgatttctggtctacttattccctctttcacattgtgacttaaatagttcatttgctatttttttctctaatcttttcaaaacttgttgcataaaaccccccagtgccctagttataaagtcatacttcttaaaaagcaaatttcaagtacttggaatagttctaaatttttatacaagaac

SEQ ID NO: 58646 - DNA, 1219 bp, Homo sapiens
ggcttcaggtgaattaaaggtgcaaacaagcaagaataaatgcaaattcatttaaattgatgatgtagtgtattatttttattctttcattaaatacttaaaatattaaaaattttaaactactgttgactaagatgattggtaataagttaacttataaaataattctgtagtaaaattgaaaaataaaaacagaagttaaaatagttaaacatctatattcaaagggattggaaatttttcgttaactaaagtttcctcagttggtgtgtttggggtttaaaaaaaaaatacccaagtacattttattgagcagttctgcataaatttttgcttctgactgaatgagctaaaataaaaacagttagatggccaaaagaagaattaaggttgctttcccattgggcaagttagcactacttgtgtgttgacaataaagaacttgcctgtggactggtttaaaatgtgtgtgatttcttggaggttgtttaagcttcgcccaaattatatctgtaatttagtagtaaaaaatttaataggcttacttcctatttttttcttatttgtttatagtaatttgagagttctgtattggatttcgattatgactatctcattagaaaccttcattagaggcagcatgtaaactgaagaaaggtagttatagataataaggaggaatcctttctttttacagcctgttcagtctgtagaacattctaggatctaataaaagatgaagattaaatctctggctgagcctcatgccatcaaactgtttaggtatttataaaaagaaaagggttccaacttttatctcactttaagcattgatgaatcaattgcttttaaagattaatttcagcattttttgaagttgctcttcacctctctaattgtgtttaaatttacttttctcatccatcccatctccagaagaagagaatctaatataagcttaaatttgtaataatatcttagaagacaactattagggtttctttaaacgtaattattttaattgtatacccagacacatttgatggcttagtctagactaaaattgtactttattttttaagcctgaatgttttcattgacccaatccactctctctacagcctactccctttgttttttttgtctgtttgtttgttttgtttttttttttttgagatggagtctcgctctgtcgcccaggctggagtgcagtggcgcg

SEQ ID NO: 58647 - DNA, 1033 bp, Homo sapiens
gacttctccccacgcaccttcagagcttaattgtctgtcaataaagacagatgcgggagtgtgtttctgtatgtgttgggggaggggtggattagagctggtggaaataatgaaccttggaggatttgtttttcaagtgtatcttggaggcatctttgtgggacacctccccacccccaaccgtggcagacaacaacccaagcaaactaccaatcaggaaagacaatcacctacaagtgtttatgggaacggaggggctgggatcatttggaaagaggttgttgaataaatctgatgcgaataatgaagatacagtgttgatgtcgtttaaaggcccttgtgtgtgtgtacaagaggcctaaccctaactagtctgaaatctcagtttaataccaagaagatgatcgcctctgaaaaggggacatctgatctggtgaaccatttgttttcaaatacaatttaggtggccttgtatacctaacatagggtgaaggtagacagcgaccttggacaaaaaccaccgttttgtatacacacaaagaaaaactaagggggtggaaggtaggattggtgggagtgcctgatgaaggaggtgcaagagacggagtcagaatgaaatgaaggggggaggacgtgcagcagcagtcagtttcctacattcagagtgtagattaagctctcaggctagccgatgtgtacttttgcatttatggatttcttggggagtggggaggagaacagaactttttaaaagtggcacaagtatttcggttttcaggcagatcattgcactgtttagctaaaaattaagttttaaagctgaataagaaagcattgaaacataagcacaaaaaatagactgataaatgaaggttcttagataccagaatacatgagggaagaaaatacagttgatgaatcttttaagtgctcaaagacaaatatgtggtaggaagaattcactttattccctagggaaaaggattagtatgaaaacagattttgtaaatgctaacagaacatattactgaga

SEQ ID NO: 58648 - DNA, 1058 bp, Homo sapiens
aaaaagaaatcaagtgtgtattttgatacttgattcatttgtatttgcttctgtactgttttaaatagagacctgttaaaaacgggtctctatttgacccatcttgtgttaggttccaaataagaggtaacttcttgtccttgaaatagcaaacaagcctttttcacatttctcaccttttttcagggatgctgtagaatcaaatatcgagtaggtagtggaactaattgacctccaggcctttccaactgtaagaggtctgtgaactgtatgagactcccaactaatgtataaattccttgagggcacgatctgtgtattgttcatataagccagtatttttcagcttttgggttgtgacccatttgtaagtcatggaatccatttagtgggccataatttgtatttttaaaaataaggtggcaaagtataaaagcatagaagatatccaagtgaatcactcaaaagaggggtgattattattttgtgaaatttttgtttcaatgacagacacatgtctatgctttacaaagtaaaatatatttcttctgtaggccattgtcaaaaaagtttgaaaaacgttcctataagccagtccagactagactagaaggcaactcaagaaataggtgttggatatataattaacaaatcactagtactgcccacggcaactattttttttttttttggagacagagtttcgctctgtcgcccaggctggagtgcagtggcgcgatcttggctcactgcaagctccgcctcctgggttcacgccattctcctgcttcagcctcccgagtagctgggactacaggcaaccaccaccacacccggctaattttttgtattattattattatttttagtagagacggggtttcaccgtgttagccaagatggtctcgatctcctgacctcgtgatctgcccacctcagcctcccaaaatgctgggattacaggtgtgagccaccatgctggccttttttttttttttaaatacagacacagtctcattatgttgcccaggctggtctcaaactcttgagctcgagca

SEQ ID NO: 58649 - DNA, 1076 bp, Homo sapiens
ataaaacataaaaccaacatttctcacaagtctttgtaactagtagagactgtagttgttctgtccagatataagtgtggtatatcaacttggcacttagcaacattgatatttaatttgttaaatttttgttaggaagaggtgttttcagatctcaggtgtctttgggaaggaatatttttatatttatatctccagcttcattcctagcttttctttggaacactaaaattgtccagctggacttgttgggcctgggtgggattgggagaattcaggagagcacagttcttgggccagaacagttggtcagctgattgactctaggcaagtcatttaactttcgcagcccctcaggcatgtcatgtttaagtggggataatgacattggcatacctgcttgctagagttaatgtgtgggtcatgagataacgaatataacaaatatttggaaaagtactatgttgaaatattttaaaataaaatttaaatccctcttcatttagaaaggatttgaggcagctaaatgcagaggtgtaagatggttttttggttaggattgtttctgagctgtgactctgtagtcactttcttactcagccctgccactcagctgtattcctctgtagctctgggcagacgactctgaacacggcttcatattggccttccatgagtgggtgaagggcatagtcatctggcagttttacctgctgttctatgcatgtctctccagcgcttgcttattttccccttctgcaaacattccattcatgccatgggcattcagtacagtcctgtaagcaagggtaggggcggcacaccaggtggatttaagcgcaaagacaggacgactgctttgccacaggcgcctttacagccagcagtgaacagttagacatattcaccttcctctaggtggaaaacagtcctcttctcagtagccctctcatgttcttgagacccatttgatataaataacaatgttgcaggaaatttcctgaaggaactgaaatgaaccatagaaacgagatcattcttttcctaccacacagctgggattagactgcttagtt

SEQ ID NO: 58650 - DNA, 1042 bp, Homo sapiens
gaattttacagctgtatacagtattaagttttttttttttttttgagacggagtctcgctctgtcacccaggctggagtgcagtggcacgatctcggctcactgcaagctctgcctcccgggttcacaccattctcctgcctcagcctcccgagtagctgggactacaggcgtccgccaccatgcccggctaattttttgtatttttagtagagacagggtttcaccgtgttagccaggatggtctcaatctcctgacctcatgatccgcccccctcggcctcccaaagtgttaggattacaggcgtgagccaccgtgcccggccagtatgaagtatttttaaaaagtgccaaggggttatttgggttgtgagattgtatataatttttctttcttttttattaatgttatgcttctaaagcacacgtttttaaaagaacactcaaaaaacatcaaaatgttcataataaaaacatgccagataaggcaatgttattaagtatatttgacagtaagtatttgtttttctaaatctccttctcattacccatacctcttatattctcacactgccatctctgcacacacccaccccatctctcatttggttaagttcttctggggaataaagggcaaaaaggcattcctatttattaactttgaaaagtagataaataattaatagccccaggagtccctgcatagactctaacaacaggccctttgggcagtcttccttcttctcagtttcgaatgtgttgttcatccctctgacattatgataatcacaataatcaatggtaaaacacaattatgactgttaacaacaaattctaattatcataagaaaatgtttctgaatatgtgtatgcatcccctgtagatgtaatggaccaataactaggcatttaaaacagaaaaattttaaagactgtagtagattattcataaagtttaaaaacttattgaagggatctcgaggcttcttcagttaattgttattttttaaaattatgctctttactaaataatactaaatgta

SEQ ID NO: 58651 - DNA, 1033 bp, Homo sapiens
ttcttaaggactactttctgggtagtttggacaatgtgcattttcccccatgccttggcactttgaaactttggaagctaattattgcaaagaagactggccattgccatggggtatagggcccttcttgatgatagtggagctggttctctttcagaggagcagattggggagaagcactggctatccctggagagaacaccttctggaaaatgtaatgtctggattgatgcatggcaccttatcattgtttgcgttgcttgccgctttatccttgtttgcattgcaataactctccctgaaaaagaaagcttacgtcatcattgtatttccactgcagtcatgttagagaggagaggagagaagtgtgcagaattcacaggtcacctaaaacaatcaggaaccagccccaatcccaactgtttggtgaggtttcaaggcctcactggggttggatgttagagacactaaagtaacttgtctttgacttttgagttactgaacaaacattaaaggcagtgaatgttgtgaggctcttgccaggcaattggagctcttgcctatactggccctgaagctgtgcccaggcccttgcctcactctagcccctctggctacctggtgcttttcccttctgtatatccacatggctctgcgctttgccctctggacttgttttctgctgtggacctctctcccagtaagtctgcaaacaggttcctctggggccttattcttcagtagctgtgctatctggatggtgcctttgccaccatcatctgactcactcctatgggcccctccactgggcaccactgaggacttggctcctggtcactgtcctgtccttgctgtcctgcaaggtgctgggtgctgttggttatctgacctcccctctagtgaccacttccatctttgtggtccctgagccccctgacctgccctggacctgcctctgcagtgagctccctgttctctactcccgcactctgctgccccaggggctcttggccctcctttgactgtggctttt

SEQ ID NO: 58652 - DNA, 1043 bp, Homo sapiens
caccaatccccagacattgaatcagagaaaggtactgtatcagtaaaggtttttagctgcaaataaaagaaatgaatttaggctaatgtaaaataaaaaataacatactgatttatttaaaaatctctaggagggccagaactaggcttgcaagctatccagctgggaacaatggccaaaatcatctacagaactggtcttatgaaaacatgtctgccatcatcaatggatccagatagcagtgactgtcataccaatacatgactgatgctggcactggaactgctcactgcctctgctatttctggtaaatggctatagctactgccactgctgtcaccctcagcaaaatggactctgtgaatattcttttttcactagattcaggttcagattctaatgcagctgtgtctgacttgccaaggttgtgtgtcaaagccacagttacaagagagtttggaaaatcaagtatatggcataacaaatattcactaaagtaacataacctcagctctagtcaatcagtgtatggcagtcacttggacacggtgactcaagggtagacaagcgacgagtccactcgagtaaagttcaggcctttagttcagtaatatggacagccccagttattattagaaggtgtcctgccaccaaaaatgaagccagcctgaaatcaagccagtgtatggaggactgcagtactgagaatatctcagacaaattaaactgaaaccttaatcaaagcaatcacaccctgccccatctctggattttctgattggataaaacaacagttccctctactatttaagccaaattgagttttctgttaattttaacaaaagcatactaatataagttatactacatatgttactctataataacaatatttcatatactaaacactacagtatatattgtatatattaaacatgtaatcaaaagaaaaaaaagtaactacacatgctatgataccatattagagatagaaaggaagaaaactgtttcctgcaaaggtgtccaaacatttatcatttctt

SEQ ID NO: 58653 - DNA, 1091 bp, Homo sapiens
atgtgatatttcatcagcactcatgctggagagtgtgaactaatttgtgtgctgcaggcaagtataggcctgacatttacataagcagcaacctcaatagcagcattttgctaatgtggggtcagggtctaattttattaagttttcgttaacaaggtcaggtggggcatgatagatccaataacagttcattttagagcagttgaggtagtctgtgaatataataatgaggctaaagagaatcatatcagtgctcagaaagctaatcttgttctgtttcaaggagaggctgttcactcctggggtcagcagatcctaggaggtttctgagagtccttagattgagatttttgttggtcagcagttaaattaaggatgatgtcaacagtctgagaaaattggccagatgccctacaggcaagcgtcaagagagtttaatgaatcttcctctcactcctaacctcctgggatctaaggtgtcccctccccatcatccagggttgttgctctccattcacagccatgtaatcagtatgaccagtccctatcacagtcattcaccccttttccattcctcctcatgtcttacccacaacacagctctagatcactcagtagtttcttccttacataccttgtactatcctagaacatctcccaccccctaatgcgtgggccatgccaggacaatcttaagagctatcaccttatatgcataatcattattatcaacatccataactgcttatatccagcaagcatatctcggtggcaaaagacaggttacagtccaccactgcccggctcttctttgctacttggaaatttcagtagtccagtttcccaggggtagatatggggggagaaaaagcaagaagggttaattatatggtttgggtctcttacagcctatctggttctctttcccaccccgaaacttataattaaatattctgtttaaatgagaggtacccttatggggaattagtacatttaaagcccaatttgcctgtcttaagtgtgctccagtgggagctgaacctcagatgcccagttctcattattagtttttcctttgagtccattttatt

SEQ ID NO: 58654 - DNA, 1046 bp, Homo sapiens
atcgcctgaggtcacatggctccttactttgtcatcacactgttttgactgtaaagttgattttctccttagaattcaacccaggtagcttcaaataattcaaaaggtcaaaaggtgtcaaaaatcaagcttaccttcagagggcaaagatttgctaccactaaggaaattacattgaatatgatagatgtttggattaagtcccacagacaagtctctaataagcaaaggcagcaagactgggataattatagcctctcaaagtgaccaaagggacattaataagcatatctagtatgtttattaaaagcatttccttataatatgttggtatcttaaatatttgtaatgtttaagagaattgggcctcgtaataccttgtgttagattggggtcagtcttgtgaccccaattaaaagagataattgagaaactgatttatgattttaggttgaaatcttgttagattgatataaaatattagggaacaagaaaatttaagattcaccatatttatttgattattagatttataaaagttactcaaagatttgagaaggtctggaagacaaattgaagtacattaactttataatgaatattaatatatttgaaaatgtttaagcttataaatggggtcaaacattcaaatatcttttaaaagtgttaaaatttgttagacgtacaaattgaaaaattagaacttaaatacataaggaactcattgaagtagaatttagtttctttaccatgtagactatacttttctatatatctcttcaaatgaattttttttttagacagggtctcagcctcgcaagttactgggactacaggtgctcaccactacactcagctaatttttgtattatttgtagagacagggtttcaccatgttgctcagagtggtctcgaactcctgagctcaagcaatctgtccacctcagcctcccaaggtgctgggattacaggcatgagctgccagacccagcctgataatttttgaccaacaatttttcctagcgagttcttacctgatcatgagg

SEQ ID NO: 58655 - DNA, 1027 bp, Homo sapiens
ccaaagatctattctacatgtgtatatttagtttattgtatataattttataaaccacttttaccaaaaagttcataaaggcatgccctgatatcctgccaggtgctgtggtttttactgttaggagagtcaaatttgctgtattccgggttgtgctgacctgtactagagcccaaccacagggacattgcacagtcaggtctcatgtacttagaataaaaagcagctgcaagattcccctctgtgttgaagttttcatgtacaaatgaaatagactgcacctgcccagtctggctgaacacacaaatattttataaagggtgttgactacatgtgaatgtcttgaaacatgtaagtctgattagagtcaaaaattaaaatggtttgatatggacatttatttttcattcttctcacaaagcaatgcaacccgcattgtgatccagtgactaggaggtttcttcgttgataaatacactgatgttaaaaagtttgttggtaaaccggtagttgccaaaattcttgacctctcaggtgtctggtaaactgggcattcaaaagcatagagttctgaatctgtctggttggaagcatttggtgttttggtagaaatctttaaaaaaaaaaaaaatccagtagtcaaattgcatagttcaagtgaatcagtagctcacattttctgtatgctaggcttgagggatttgttatgaattagatacatttaaggttaaatggttaatgtaacagcatgtggaaattatacctggagaatttaaagagtattatggctttatagtacatattattgagaacatgggatgtaagtatagcatctactttagattttagtaatattttgggagatttaaaatctttgttgtctgagtatattatcacatctcccttgcaaaattgtagggaatgggaataagagtggtttgtatattactgaagcaacgctcagaggtttaggacttcaggataatagcagggtgattacctttgttggcaaaaagtatatgtcggg

SEQ ID NO: 58656 - DNA, 4101 bp, Homo sapiens
tggtgctgattctaagctagtgtttgataataaaatgtttgtgccatggccagtaggtataactaacagatgatatagcttgtaattttgattacactgaactctagtattgattttattgtaatgtaggctatcttagattttatctctttcatggatgtaactatatttgttttgccttcagagcgtttcctaggtggatgattaaagtagtgtgatagatttcggacgggttaccatctttttacatagtgggatttagaggttttgagttgttcttaagaatcaggccaggtgcggtggctcatgcctgtaatcccagcactttgggaggctgaagcaggaggatctcttgagcctaggagtctgctttggaaatttcctcagagcatagaaatcatttttaagagaaattacagatgctattaagcattagagtataactaagttattaacataggaaaatattttaaaattgcagtttgtggttatgtaatcttccgaggtgcaaattctcagaaaaatgcattccggaaaaatcccagtgatccaaagcttgcacgtaagtattgatttatgtttatattatatatattacatgaaggttttatttttctttttgtctcgacatcattaaaaatgtacttttatttttatatagatttaaaaaccattcatacttcaacgggaaaaaatcttctagtttctggatggtggggctttgttcgccaccccaattacttgggtgatctcatcatggccttggcgtggtccctcccatgtggtaagcatttcagaagagtgctagtttgacccttttagccgccagaaagatgtgtgtgtgtgtcctttgtgtgggacagtgtggccaaggtgggtgtgagtctttttgtcgcccttttctactgtgaggttggcctctgtagaagctcctctggcttctgaggggaattgggaattcacagagcctgaagttttactttaagcctaaaagcactattttaagttttcagctgtgcctgatagcttttttctaagtagaatatatagaaattaattcagcttcttaattcatgattcagtgtacatagattgggaaaaactttggtttttaagaagagaaagagattctgtttttctttttgtgtgtctggcctcgtggggagctgggaaagcaggggagcagggagagctgtgggagctggaggtgcttggggagctggggtgtcagggggagctggaggtactggtggagccaggggagctgggggaactgggggagcagggggatcttgggaagctgggggagctgggggaactgggggagcagggggatccaggggagctggtggaggtggaggagctggcccgtgcctgctgcctgtttggtggcccagcctgtggtggaagacagcagtttttcttctttgctgggggaagaagggcgagaaatgaagagatgtgtattaactatgaggacagatgttttgattgtgatggattgttagaatggattcatcagtctttgagtagcttctaatttagatacgaccttctgccactttccagtgggattttacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcactttggagccttttttttttccctttcttgcttgaaactgagatttttgggaccaagacaggagcccttagattcccacccctgcccagcctcctgttttcctaggatcatctgtttgggacccctggccaactgctgtttaaaactctcagaatgttggaactcaaaggggttagttgggaatcctaactcccagaaaatggtcatgtgtttagtatttgctgtttgagaaaatacagaaatgctaaaactattgtagatccagtcatactttcaaatgcatttgtatgaatcacagaagcatctgtgcatttgaaagacagtacgtgtgtgagagacacacgagacacacacatgtactgtgcctgctgaccgtgctttagtgcttgtttggatttccagttgactctaagcc

SEQ ID NO: 58657 - DNA, 2057 bp, Homo sapiens
atgaaatgccagattatgaacagaaattagattggtccatgtggaattgaaacaaaaagagttggtgatcttattccttcagcaagcatattttgaacacttctctccatggcgggcactgtgctaggtactggggtggcaaaggtgaaaacacacagcctctgtcttttagaggcttttagtgtagtgaagagtgactagacaagtacagtaacccaattactgcagcctactggtgggtggtgatatctgagaagtgcccaggtctgagcagcaggtcaggagggcagcagagggtgtagggcctatgtggaggttggaggaggggttgtcagcagaggggagggcctgggcatgggggcatgggagatgctttagagatctgttatctccagagcatgagcgagaggctggcgtgacgggagaatgtgacagcagaaagacctagcaggccaggggaaccagatctctctcccctttaacaaaaaaatgttgattgtggacccgcccatagcactttttacatttgcctgtaaactagtactttatttgaatactttaaacacagaagctccttctccctttccccgtctgtatccttataggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaacgtgagtattaattttagtctcagtttaatttattaaatattatgtactgaggcttttatgccctgctgtctacatacttgaaacatgccattttgaatggccagcattagctcagtttgaagccatttatcatgagtaataaaaaatctgcattttgcaaagagaatggatggttcgtacttgggttctcagtagtacttgaaacagattattttaaaccatcttgcttttaaatttaataaatttaagttgttttaattcgttttggtaaccatacgtcttttctcttgagtgcctgctttttctggtaggcatcttataaagtaagaagatttgtcttgccttcatagagctcacattctaacaggagaaataagacattcctgccttgctgtgaggtgtgtgagtgagcactaagaggggcttagatgacgggtgttaaagatagagagaacttctctctggggagcgttagtgtgaacttatcggaggatatggtgttcgattggagttttagaggggaaaatgggatggggagatcgaaaagtcaggcactgggaacagctcagcaagggtgtgtggtggggaagtgtgagatgaggttgggaaagactgagaagtccagtttggctgcagctgcggtccaccagggtcagtcatggattttacttcaggatgaattttcattgttcttacactgttcactaaacacttatactagaggttgggcagggaaaattagcagtgaactgcaaatacagatagttttgctacacaagttagtatctgtggtagaagaagttcaaaccattggttaaaattaagatttagtttcaccagtggtttggatgtccatgtcatccattttattattcaagacagtgtattttatagttcagctaaaaatggggaatgtcttagtttgttttgtgctgctcgaacagaatagctgagactaggtaatttgtcatgaaatttatttggctcatggttctggaggccaggaagtcaaagagcatggtgctggaatctggcaagaccccttctgctgcagcatcccagggtggaaggtggaaggacaagagagagtgagggagggcaagagagagtgaggaagagcaagaggggctgaacatacttttataacaaacccactcgagatactgagcccactcctgtgatagccacattaatctgtccatgagggcagaaccctcatgacctaatcatctcttaaaggtgctacctctccacactgttgcattgaggattacgtttccaac

SEQ ID NO: 58658 - DNA, 2088 bp, Homo sapiens
ggttgcagtgagccgagactgtgccactgcactgtagcctgggccacagagcgaggctccatctcaaaacaaaacaaacaaaaaacaagagaaacgagaggttacaaattggttgatgctgacctgaagtatttcaatataaaaaaatgtcgcctatctaaaaaaaatggagtgtaaagtcctttgggggggcccccatgattttggttaacttttttaagaaacctgggcccccggctcccccaaaggctggagcaactgccttttcagtcgggcaggcatctcctggttccgctcgtctgtgccgtcctgtctgcctctcaccaccagagccctgctcagggtcttgcaggcagtggaattgtgagcctggatagtgggcggcagtgccgttgtaaagcctcctgactgggtttggaatgctgtttgggtaaacacttttcctttctcaggaaatgctgtctatgatttcttcattggccgtgaattaaaccctcgaattggtacttttgatctcaaatacttttgtgaattgcgccccggattgattggatgggtatgtctggttttttttcttctaaatttcaattcaataggtctaattaactgctagaaagaaatgtagaccattcaaaaataagcagtgggtggtatatttttagggataattatggctttccataaatctatcaaaatactttcttgtaagtattttccagaggtttaagatgccctgttacaggttatgacaaattaaataacttttctttgctttatttttattatatcagtttatatttatgtaggaaagtgatagtgtggatgaattaatgtaagaaaaaatgcattttcctcctttttaaattttacctagttttaggcttggagttgcagatagagagcaaagagttcccttccacccttcattctgtttctcacaacattaaccttggaggaaaccgtagtgtagtgatgaagaacagcagattaacatagtgacagcattggttaccaagtccacaggcctcagtcgagttcaccagtttttccgctgttgtcctttttctgttccaggaacctcgacaggactccacaatacatttagttgttattccttcttagtcttctctagtctaatagttgtttaggctttccttgtctctcatgaccttgatactttttggaaggtactggttggttattttgtaagtgtccctcagtttgggtcattccagtgttctctttgattgcggtaaagttacccactgtgacaggaacacagaaatgatagctgtgtccttctcagtgcattgggtccaggggcccatggtgctgagatgtcttattcctggtggcgggtaggagttacggtggcgtctgccaggtgtctcagctgtgaagctcactcatgcctttgtagtgctaaggtctctggggaggtgctttgaggctatatactttccccttttgtttcaggtggttattaacttggtgatgcttttggctgaaatgaaaatacaggaccgcgctgttccatccttggccatgattttagttaatagtttccagcttctctatgtggtggatgctctctggaatgaggtaattaattttaagagccgaggccttggagtcagatggctttgagtgggtgagtgacctgtcagagcctcggcttcttgcacacaaagtgaggggagcatggcctgcctccaaggctgcttgagaggaggacgaggccatccatgtgaagctgacgagggagcactgacaggtgggaagtttctaggcatttgggagtgcttcagtgtttatcagctgttcttgtgtttaaaagtaatattctaaatatttaagattggtggatcttggttttgtttttgtgggtggtggtaattatggtatcacatgaaaatggatggattattactaaattagaatggtgtttcttggactgtcaagagtcacctagtttttaaataatgggggagatgttttattgttaatgttttaaaatacaaagactagctctaattagatgaatgtaaaatcagaaatcaagatgcattgaggaaaccagttgaaata

SEQ ID NO: 58659 - DNA, 1544 bp, Homo sapiens
ttttgcttttgaccgtttatccaaatggatttgatgactttttaggatcacagctctttgaggcactcagctcctttgaaagcaaaactatttctttagccaaaagaaaaaaattggatcttccagtgagcctttctgtgtggctgcaggactagcccggaacgagagttctgtggagcgtcacagggcgggtgctttttaacttggcattgcacgtgaatgtccccgcctgctgtccctaccccccaggtactcgcagtcccctgcctagcctcgggcatttgtgttgtggcatcttttctgcgggtggcatgttaagatctctgttctggatgatagagttttactagaatcttttgaaaccattattggcaacttggttaagtataaatatttataattttgtaactaccaacctggctcggtgcctgacccctggtaggtgcataataccctccccttaggtaatggcattagactttaaaatatgtgtttggcccagctctgttaataattagccatttgactttgtgcctgagagtttggattgtgggaattttcaggttgcacttcttgtctgttttcccttaattaaaagcaaataatgaccatttgaactgaaaaagaatcaatatgttaaactatttggaaagttctacaagagataatggtatgtatattgaaaattatacctcagacattgcttatttgcatatttgtgtgtatttagtctgaataatgaaattaagactttaaaaatgaacattgcattgtttcatagtggcgtaagtttcatgtgagccttgggttaatattaattttccacttccttttttttttttttttaaaggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggtgagcagtgatgaattgcatgttggatgaatgcgtcccagagccctccagcagccatttccagatttgaatagattgctttttttctaacttcatttttgggaaatgaagagaagtaagaaaaaatgaaaagatgaagaaaaacgttaaagagatatgaatttaaaggaagaaaatatttttgttttaccttcatactttcttactcatttcttttttttgcagttgcttgatgacagtaagacgtttagtaaacttacaggcattttgacttatgacaaatattatttctttgtccaaaatagtaaacactctttaaaaaacaaaaaacaacagaggttactggccgggtgaggtggctcatgcctgtaatcccagcacttcgggaggccaaggcgggtggatcacctgaggtcaggagtttgagaccagcctggccaatatggtgaaaccccatctctactaaaaatacaaaaatcagctgggcgtggtggtgcacacc

SEQ ID NO: 58660 - DNA, 1043 bp, Homo sapiens
atgcgtcatcaaatagcacttgggtcatagtagagtggataaacagggtagagcccaattgaaaaggaccccacaaatggaagacaatggaatcatactgttactttgtaagagtatggtagccattggtagatgtttgagctagggatccactagatataaaggtatttaagcacatttagtcttgaggtggtggtacacaggagtgtggcagggagcgtggctgttgcagttgcttggtcctacactaggaagtcattactgaatttgtatttaagataaattcctgaaggtggaattgcgtcattaaagggcttgccactagggtttttgaaacatattactaaatttccatgttacaagatatcttccttcttgggcgtgttgaaaattaagtgatactagaatatatatatgtgtgtgtgtatatatgtatatatgatggtgatgtgcttagtaaatttgtaaattttttttcttttaaggttgtagaaggaacgcctcttattgatggaagaagactcaagtatagattaaatggtgattttctttttttaagactcaaattgatgatttgatagcttaaacttctaagtgttaaactctttgttaaagctgattagaccagagtagtaagtgataaattatttcttagtagttggaagagcaactgtttatacctgtagccaacttgtataaattatgccattaaagtaacatagcctcttagtcactcttgtccactctccagttttattttcttaatagtgctcatcactgttagaaatcattgcacttgtctaggattttatcacctgaggtgttacacggatgtgggcatccaggccactcctgctgcgtgagctgctcttgtccttgctcatgtcctctgggttgtcccttgaatattcgtcacacacacttcctgggcctttgcctggagaacttacccccaaacgtctgacacctgcatcttcacctccatctgtcttctgctgagagaagccttcaggtccctttctctcccctgctctgttttgttt

SEQ ID NO: 58661 - DNA, 1039 bp, Homo sapiens
aacacttgcttattaggaggaacttaaaaaaaaatctgattgagatttcttgtgtaacttttcaaaccaaatagaaaagaataggctattttgcaaagtagccgactctcagtggaggttgctatggaaaaaaaattcactcttagtatgtgtcatttcagatgcagcattttaaatgattaattgataggctactgggctcgatggactttagtctacatcttttactttaaaaaagtatgaaaagtttctaattttcatctctttcagaagcttgttgtcaagaacattttacgttgttttcagattcctgcaatatctttaaaatttgtctctccattgctaagtgtagttttttcttctttcagtagaatcctttacttggatatatttaaagaaacatgagattccctaagtaataaataatttatttaaagatcttattcttagggctttgcaagtttgccaactgtctgtaaaccaaaggatcggttttactggtgaatgccagtgataggagggtagagctgcaggcttaatactgtggagtgagaccataactttagtggctctagcaaggatttttgtgataaagaccttcagtcatttctacagtaagcctctacagttaaattcagattcatttagggtaaggtgatttcagagtatcaaggaaagcagttttggtgtttaaagtcatatatgtatatactcatagactaaagtgactaaaagcatatatattaaaatatatattaatattatgcagtcatcccttgatatccttggggagtggttccaggacctcctgtacataccaaaatctgaggatgctgaaggccctgataagaaatagtatagtatttgcatataacctgtgtgcatcttccttgtatactttgttgcctttaggttgcttataatacctaatacaacgtaagtgccatgtaaatagttatcatactgtattagggaataaggacaagaaaaagaagtctgtacatattcagctcagatgcaattttttccgaaatatttt

SEQ ID NO: 58662 - DNA, 1987 bp, Homo sapiens
gcccggcaacagacttttaataaactttaaaaactggattatatacatactgctcagtagtcagctttaagacattttaaaatattgggataacctttcagagtgtatttttctacatcatttttgttgttgtattctatagtatggatatatggtaaattgtatacatgtaacttaatcgttaaagtcagctctgtcaatgatagacatttagtgtttttccttccatattttcactattacaaacaagtatttttatgtaacatctgattatttccttaggatggattcttacaagtggaactgctaggtcagctgtatggtgcagatttgaggcttttaatacatattgccagattgcatcaagaaagtttatagtagtatcagtgtatgaatgctcagtttctcattctgagtattataatttttttttttttttttggagaatgtggctgtcagacattttcaacttactgttctaacttatattttgaattagaacattttaactattagtggctctctttaccaccccgggactccaggaacagatgctgtgtgatactttgttatcctttcatttttaatatttagtgactgctatatttttacagtgtaatcttacagtcctggtgtcacaagaaccacagaagctttgcctcttacctggtagtgccttgggcctactgtgtgttgcataagtacccactatttcttagttttccattatgggctattttggagcagtgaatgtctttttgaatgtcttttgttttttatccagttaatgaactaatttaccaatttttactttctctgcctttcatagtaaatacccctaaaatctatcaatgaaattatgacattcagtctgattacgtgaaagatcaaagttgttttttttttttttgaggcggagtttcattcttgttgcccaggctggagtgcaatggcgcggtcttggctcaatgcaacctccgtctccgggttcaagagattttcctgcctcagcttccgaagtagctggaattacaggtgcccgctaccgtgcgtggctaatttttttgtatttttagtagagacagggtttcaccatgttggccaggctggtcttgaactcctgacctcaggtgatccacccgccttggcctcccaaagtgctgggattacaggtgtgagccaccgtgcctggccagatgaaagattttatgtagaaatctatccaatatttcagagactgggaaattctagtcagttttattccttttcatttttaacaaaatgagggttaaattcgtcagaattaaggctgtgaaaaatctgttttattgcttgattccaaaacagtaagtttttaccatcatgtttctttttaataagttacagttcttttgattaaatgtttatattcttcaatttagaagccatttggaaatagcatcagcagatataatggggagcctgagcatattgagagaaatgacgcacctcataaaaatacacaggtgggaaagtgttccctttcatcttggttgtttttttttttcttttttttggttaaaagtgactctcccttgagaagcacattgaaaattgtaatattttataacctgttctaaaattctgtccttaaattaagactgaatataatttcacaaatttattcttactagtgtatagctgtattgagatgctgaaatagttaatgcagtagcattaatggtaattgttcactgcagatatttaatttttaaatttttcatttaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtaggcctcagagctgggcccagagagggc

SEQ ID NO: 58663 - DNA, 1034 bp, Homo sapiens
taggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctggtacttgtgtttatccttatacagccttttgtcttccgctttatgtatatatttactcaagttacttgcagttaataatattaaaatgtcactgaaacatcaaatctaagttgatgactttgggagttttcatataaaacaaatgtttggaatagaaagttttaaatatcaatggaaaagaatgtccttcagttaccagaaatgctatttaatattttagtttttaaaaaagcagcgttcaaatttgaaatagatgtagcttgtagattgaactgcgtaaggtttttacagtgtataaaagttcatatcatgtatgaaatggtaagacaaacctgtattacggaaacattcttactcttagcatcattatactttatcactttacctattcaaagatgattttagtggaattactttcaagatgtaagctttgaaatatcagggtgcatggagcctgtagatcttgtacaaatagtattttagatagtagaccaaagacaaagtatgttaagtaaaaagaataaaagtaatcttctattcacttaatgttaacctcttttctggatagaaggcacacagactttgagacagagtcttgctctgtcacccaggctggagcgcagtggcgcaatctcagctcactgcaagctccgcctcctgggttcacgccattctcctgcctcagcctaccgagtagctgggactacaggcgcccaccaccatgcctggctgattttttgtatttttagtagagacagggtttcaccgtgttagccaggatggtctcgatttcctgacctcgtgatccacccgcctcggcctcccaaagtgctgggattacaggcgt

SEQ ID NO: 58664 - DNA, 2062 bp, Homo sapiens
agcccaaacccattcattaccccagtgatgcccaatctcaggtaggtgtagggaagaaagctgcctctcttacctaatgtgttaattgactgacatcctctaatcaccagataagtacttgtgttttctttcatctaccaacctagctgccatctctgtaaactagtagagcttgttaagttttttcacagacgattaacagtgaaaaaatgtggtggttaagaaaggcctccctcaccccgcctccccccccactctcccactactcccttggggtaggtaattcaactttctccttaattccagagtcttcaaaggttcctaaatgttgcttttattgtatcatcagctcttaacaggagccagtgaggaatgtacattgataggcttggacaatacatcaagaagtgcttagttggtgaaatgaaggtgatttgggagacagctcatatctgtcctactggctgccccttggacgtggccccagctagttcatgtggtactggggaaggtcggcagccctggttttgttgtgtggaaatgtgattccgctggtcagccgatggagcggcattactgtctggcagctggaagtacccagctatcaattgatatttcaaaaagggtggcagacaggcctcacgtaagtggcagttcttgcagattgcttgtggattcctagagtattgtggggcttgtgggccatgttttgaatcagaggaaaagaatgttataattgggggttgatggctgctgtaggcttgagagaagtgagcttggatgaaggcaaccaccctggcttaggtgggtggttggcagagttacttggtatgcatttgtactttagctgtaagagttgaaagctaaataacccccaaatttattcattacagacttggaattatttttcttcctattgttgggttatagtcatgttaattgtacatccttgattttcccagtctggtttatagtttgctgtttttaataaaggcaatttgttaaaaatacaattaaatgcatttttaaagccattgtaaattgatacgcaaatttacaaatgagaaaatgtgttctttgtgagattgtgcctcattttttgattagcgagaactgtgatcacggtaggtgggtaacattttacatagtgtgaacttatggcgcctatatacattgttataattaatctttagtgtcacatagataacgcagtggctaaatcatcctctcaaatgattccaaatgagattgaatgtagcctttctggccctaaaatcctgaccagtcaattctggaaagttgtattttagtgatcagcctgtggaaaaagacgaatacataaatgtgtatgtattgactcaaatttttttctttaaaactattcaggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaaggtaagagctcctttggtttatcagagtgtgtttacagtaagtgggaaataactctaagtatggtttctaagctcaggatagtcagttcagctcggtttgaaggcagaggattgagctcttgctttgggtcacatactgtttttggctctgggaatgtatgaatgaggcatagtccttgttcccaagaagctcacacttactgggaaagacagccatttgcatctgttggtcccctgggtttactacgttctgtgtctggagtttgctgtgggtggtgttgagtgtatcaagggtagagaagagccctgggcttcaggggaggctttcagaggcagtgacacctagccaagtgctgagaacaaacaggaaaaacagcagttgatggggctgtttctgcagagagggcagtatgccaaagtcaggggtctgggggacacagtcagccaagtgctggaagggggtggtaggggagggctaagcaggagccaggctggggg

SEQ ID NO: 58665 - DNA, 2391 bp, Homo sapiens
acgctttcgagctcggatctttggtgatcacttcaagaatgtattagttttctttgtagcttaaaaaaaaatctcgttcgccaagccacctggcaccccaaacactgctgcgagcgctgggagggaaagggcgggagcgcgcgggctccgtgtgctgcgagggcgcctgggcggctgagataaggcggtggcaaacgtcgcgctccgggccgccccgccagactcggtttcccccgctcaccggcctccccgcccccaggcagggtggggcggggcggacgcgccacggcgcgcgaccaatcgacagcgccggggatgattcaaaaggtcgaggagccaatgggagccccgggcggcctcgccggtggggaggggaggcgaggggaggggagaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggtgagtgcttccacccccgccctgctcccagctccccgcggcgcgttcttcgaggggccgctgggggaggaagcccgaggccggcgcagcggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagcgcccgtctgacagatgagcaggcggccccgcggtcctgcagtaggaggctgacagggcgcggcggcctggcgggacggggaagggtctgcggccgaggtgggcttagattcgcgctgcttgtcactggctttgagggtcgtggtcgtcgcggtttggtgattctccaggcacactgcatggctgctcgctcctatgcgttgaattccttcgcccggacagtctcaaaaatcgggtatttaggcgggtgtgcgtgttcctgctaaagcacggtcctgctttttcacctttttgagggttcagaaaaatgttctaatgacagccagcctcgcactgccagtagcctcaaggggcacttagtaaagcacttgctttcggagggctttgttgaaggcgctttcccagagtgattacggggcccggtcgggtgttcacacgagggcgcggtagataccgtggtccgcgcgtggacacctgcagcgcgaggcgcggcgcctgggcagtgccagggtgaacaggcccccggggaccttgcacgtaaacacgtgtagatctgtagttacgcattgtagtaactggtgtgtgggagaagatggagctacggagaagagcagagggatcctaatttagattaggcaacaagtccagtttaagttttgtttctcaggctgcctgggaagagggagaagaacgagcaggaggggaatgatgagctgcccaaggatgtttatggggaagaaggcgcttctgcctttacagccaggaaggtggcctttctgttgcttcatgaagcaaagggcgcggagcaaggcccggggttcctgtttgcattttgcctagtggggctaccggggctcaggtgtgaaaaggaagctgtccaacgtcattcgagcgtcttgctctatgccacgtttagatgaatttggagaagtgaaggaaagatggctggagacccctgtaatgttaatgagcagagaattgttgtgttcacaaacagtaacataccggagctggaatgtgtgaggattgcagtgccagttgactctgaagttagcgggcatctggcttaatagagaaaaacctgagggtctccgtgtttttcctgtttatggcgaatgaggacattgggtgcagtgaacaaaatttttctttacaaacacacttgcctaaaacatctcttgtaagaaaatcctgtgtgtatcttgactcctgtaggtgagtgcatagtgagtgacacgaacaaatgtggggcttttgtgtgccatcctggctatttcactcctgtgggggaatatattaggatgtgattgcactgtatcctcacgtttgacaattgtgtgtggatcttgtgtaaagtgggggtgcacatcatgttgttggcttcatcttttggaacatttgtgtataagataatggtcttctaagaagaatgccggttcattttgtttgttt

SEQ ID NO: 58666 - DNA, 2793 bp, Homo sapiens
aaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaatgagatttgtatttattttaccagttgctcttaatttaccaaaggtatacgacatgaaaagagttgcattcttttgtcttggttgtgattctgaccttaaaatacgctcagttctaaaagcttgaggagcgttctatactggtccttctgcatttcagcctgtcaccaaggggagtgttttgcgat

SEQ ID NO: 58667 - DNA, 1148 bp, Homo sapiens
caacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagag

SEQ ID NO: 58668 - DNA, 5676 bp, Homo sapiens
atctggtgtgtgttttgcacttcacagcacatctcatttcagattagcctcatttcaggggctcagcagctgcatatgattcgtgcctgccgtattggacagcatgggtcaaccagggcctcatccaccttcctgcctacccattagggcaatccctgaggtcccttcagggaaatcctagactccttgaaatatggtttggcagctatggtgattcctgagaaatctccatacatacttcagacaaaaggacagatttgccaagagccagtttttcagtttactgtaatatcttcctcctctaaacttcctttgcatcacctctcagactgttcccagaggactagattaaaagcacagctgttatcatttctagaaactatctgactcatacgtttcactggatgacagagtaattatcttaattttaggaagcattctatttcacatattgctaggctagaataagccaggattgggaagggcagaatattaaaacaaaattcaccaaggctagtcttccaagaaatagaattgtggctctggaaacaaaaaaaactacacatcatatttcatgacattcttaaaattttatgagtaagaatctctttagtggtaattttgttctgtatttctggtatttttctctaatattttaggacattttagatgaaatgagaaaagaattaacaaagctaaaagaagagctcattgatggtaagtgtctggacaaatttactattcctataaaacaatgtttaagattgaccatttttaagaaaatgcaaataaggaaatacccagctgattagttgagggcaatgacttccatagtcctgcccttttaggattagggttttggggaggaggtttctccttcatataatggaaattatttttataaatagggattaaacaatatccctaagtttcaggtgttgtcttttcttagatggaaaaccacatgaacagatctttctctaggttacctctactcacctatcccagtgtcctcttgtttttgagcccacataatcagtgttttcattttgtatacaaaaggagaaaataaatatatagaaattagtatcatctttctaatattaaagatgtgtgcaatgaaagatgcaaagttaatcttcttattactgtgagtttgagcacaatccttaaagtttcttaggaatgaatcactcatttatcttactttatcattatatttattttcaatacttgttcttttccatccagcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggta

SEQ ID NO: 58669 - DNA, 1735 bp, Homo sapiens
aacagcagcaacaacaacaacaaaaagcagattaactcagtgtttaatcttcaggaaccatgcctatgggtttaaagtattttatgtcttataagaattataaattataactttgaaaaatttattatgccttttgggtcttgcttcagattgctaacattggtactctgcaaaattgggaatatatgatttgcctgatggttttaaattgcatttatttgtggctcataaaggagggcatttactagactaaaccagaacccggaggagtgcccatttaaaactctaggttttccactggggactcttttattgccggacttggagagggcgccatgactggtttatttggtgttgaaacttgtttaaaatatacctaatcattgacttattaagaattataatagaaactaaacttttgaaagtgcaataataattgacaatctgcttctgtctggcatatcctttttatttaataaaataaatttatggaagtagttagcctgaaacacaccattcaaatgacgtctccataaaaatttcacaaggaaatagtcacatagtctaatctaataaacatttttaaaacattttttattttgatgcttgaaatggaataatatgtataaagcaaatcatgctcactaaaaatgttttcttcctgcaatccaaggcatcagctttgtaagctgatttatgttagtgtaaaacattcaagtctttatgtttctcctttcactggtttgtccaggtatttaagtagataatgtaaaagttcaaaagaaagacaaaacaagattgtgttatttgagcctcagatgtttcagctggcctcttcatcactgttttggtcaacgtgccacgttacctggttacctcatgcccaaagaatactgtcttctactcttttctgaagaagtctcaccatcttgtcacctttttctagttcctttataaataagaaatactgagaaaagtgaaaaaatgttgttttatgttctaatcagccctacaattttgataattttttaagaaaatggcttttttaaagaaatgtatttaaatctggtgttgggttggtaaatttgcaattatttatgaactcattaagtattaagaatgttgtttacctgtcctggaaatctcatttatacagaccaaaatccacacccttatcacagcccagtgccaatggagtccagacggaaggacttgactatgacaggctgaagcaggtgggtgctcagtggcagctttcctttatttgtacttgtttctttttaaaaaatatcccatatgcatatctttgacatggatcctgaatgtacttagaaagacgatagagctattgttatacaaattaaacagtggcattagtagtactgcatttttgcaaatctacacttccggttcattgagtttgcatgaaggtccagaggtagtggagggtggggttgtggttcagtgataacagcataaggtgtaaatgtaagtgcatggtacgcagttgtaaagaaaacaatgggcttttacttttcagtgactgtcttggcaaaattgaacccaacaaatctgattttggcaagagtgcaaggaaacaggcactcttctatacttctgctttctaaaaagcagtttggaaaaacagaatcaaaagcctgaaaaataaatgtcttaccttgaattctgtgatatgaattccaggaatttatttaaagaaaatattatggaagta

SEQ ID NO: 58670 - DNA, 1049 bp, Homo sapiens
gctagtacatagaaaagtagcatttaacaatgagatttttaaggctgggtgccatggctcatgcctataatcccagcactttgggaggccgaggcaggaggatcacttgagtccaggagtttgagactagcctaggcaatgtggttaaaccctgtctctacaaaacatacaaaaattagctgggcatggttgcatgtgcctgtgggaggctgaggtgggaagaagacttgaggccaggaggtcaaggctgcggtgagctgagatcatgcacactgcagcctgggtgacagaatgagaccctgtgtccaaaaatacatatattttttaaatgtagtaaatctgctcagttatcttgctgctttcacacatagtaccccctgggataatgttattgataaacttttttggtaaaagttaagaaaaaaagtggtgattacatctttccttcagtatgaaaagttcccccctttagttaattatcatggtggtggtggtggtgatggattgcatgttagcatgaattaaatttttaaaaatttgcatgtttccacaattgtttattacataacaataatttttgcattgcctagtaaatatggatatattcataacatacttgcccaattaaatagcaggctgtagttcatgtgaatttcagaggtattcattatataacttgagaaaataactagctaaatgggccacttaaatgggaaatgtaaaagaaaagcagagtatgaattatagtttaattctagagaacaggaataggtagcatgagtgaatatatgaaataacatcctaaactttaagaatatttgccagaagtgactctgcattttatggatctaagtaaatcttaagtgaccttggaatttagtagtcttccctagcaaagtaagaaggtgtagcctcacaagaggaaaggaaatatttcatataaatattattccctacagtgcctagctcagtgcttattgaatgaaattttctggaagttatttttccccctattcatataagcagatacctaataaagtaaaattgga

SEQ ID NO: 58671 - DNA, 1906 bp, Homo sapiens
tatagatgagttgaatcttgattcttaatatccagtagtgcaccataatcatgttccaattctgttaggtggttttccttccctttcccaaaatagaaattctggaactcctgattatttcctgaccactcatatatcttttgatagatttgatccaactactgatatataggttttaaaatttcaccaaaagctgttttaaaccataaaggatttttaaaatatgtttaaaagagtaagaactatattgcttttcttcctaagttatctctcctgttccttcggaaagcaagtgtattaagtatgtcttatccttgcattgtagtgaaggtccccatttctctttggaatagctttgtcaaaattacgttagtggtaagatggattaatgtcccataatatgcatgagatattgcatattgctgtatttgttaagtgaatatgtcagagtaaaagcaagactgtttggttaaaaatgctttaaactatgactggattataacgtttgggaagttggtgcattcatctgtggttattaagaccttacagatcttgtattcaagatgggaaaactagtcctttacatgcctcctgagaagagttaattttgtatacttttatatacttactgtgcctacaacctatataaaaagtagccattgtgtaatgatttttaaaattttctgtaactggtatcttcacataactaaaagtaatcttaaaatatcttttattggggaaaaattggttattttaaggttaatagactcaattcttgttttgtttgctattaacaacctataaaacagtaacataatgagaattattttttaaagttctattgtgtatccctttcaatggttttccccttcatagacgggattctccaaggaaaaatcagattgtttttgacaacaggtcctatgattcattacacaggtatcatcctgctgtgacgttgtgatttgagacttttaaataacatgttcaggatagggctgagctttttctacctggattggtaatcaccacaagggagatttttttttctttattttgaataccttttaaaaattctgccatcacttcacagttggattcaaggataaatacaaatggtaaacatattagaaatactagactgggaatctaaggccacatgtattatctaggccatttgtagcttaagcgttttcttttaaaggctgttcgccttatgattataagacaaggtttcaaaaaagttgaatagaagatccttttccatctgttactggaacatggactaatattaaagccatggttgtggataattgattatttgaggaaaatctctgtttcctagatactttgtagtaaattatcttggacagtttaacatctaacaccctgagtagattgttttctaggatgagccctattataccattttttaattaagaagacttaagaactagttttttcttaattaaaaaaattgacagctaaaaataatcctgcaatgcttttcagttacttacacaattaatttgacagaatagggacttaaatatagtagtacagtcattttataggcagatgtttaaaggcaacgctctcatcataaaaaaataaaaactgacccagcacctggtggttcacacctatagtttcagcaccttgggaggccaaggctggaggatcatttggggcccggagttcaagaccagcctgggaaacatagcgagaccccatctttacaaaaaataaaaaaaaattagctgggcctggtggcttgtgcctatagtctcagctactcaggaggctaagacaggaggatatcttgtgcataggagttagaggctgcagtgagccatgataacaccactgcaccctagcctgggtgacagagtgagaccctctttta

SEQ ID NO: 58672 - DNA, 2196 bp, Homo sapiens
ttaaaatggcacttgtgattttcccattgaaactagggaggattaagataggcagaccaattaggaagctctatacgcatgccagtaaagatcctctgaagggaacccagccttgcccctcctgaaacacacccgagctccttagagagaagaggcccttgcttctcagcttccacagggccagctgaaccagatgagcccttttaagactaaaagatagttctggtttggctgattgagaaaggacctcagccagctgttaaaaggtagcacttgctacatcttaaccactttggaattactccctcatccttccacccgccgcctctttagtgacagtgtccgatgaccgttcccttccctgtcccggtgtccctcagtttcattcaggacttcccttttttcacctgcttgggctggtgtcacttggatatgtttctgattcggcctgtcccaaaccccatccgattatttgatcttcctggtcaagtgtggaacttgacaccactgtggcggtcattgagaggctgtgttagctgttagaatacaaaagaaggaatataaaaaagaaggaatttagttgatgaggagtaaagcaagatcaataatgactttaaggtttcacatctaatgccttcatgcaacaagaaatccagaaccaaaagcagggcttcatggaagagtgtgagtttatttttgcgttaagtgtactttgaagagacggtaagctacctgagaatgtgcaaaagccagctgaggagctgcattggaactcagagcagttttagttaaaactatacaatgagatcacaattcatgaatagacttcattctcctgtggcccaaattctttcctccatgagaagattccacttctgattttacccagtcatgtagtgaggccagtgacagcatcagtgagtcagcccagattagaaaaacaattcaagcacaatagacagccaactagtgagtcactgactacatagtgtcttttgtaataagagcttagagcgagcttgtttatatttaactggaataatcggctaaggcccaagaattaattgtttaagaatcaaggaagtacaatagaatttcaggattctgatatttattttgagttgttcctatttttttccccaagagggactatttggatttagattaaatgttgaaatacatgaacatattataagttatacttactgtttttatcattggcactaaaaaataatttaaaacagtgtcggtaatactattccattttaattaattgaactatcctaattttaaaattatcctactttattcttactgtcctttctttgttagagaaactccttactatcctaaggttatagaatcataatattttagacttaacaatgtaagttttccttggaaacttactgtactagcttataatttcttctcattttaaggtctggcattgtgcaaattagagtccttacagatttcaattaaagtttagaatttaaatttttatttatattactactatgtaaacaggtataatgagatttagtattttgttatttgttttataataactctggaagcatttatttatttaatagcttttgttttttatttttaaagaaccaacaagaaaaccttgggaaagaacaaatacaatgaatggcagcaagtcacctgttatctccaggtatcaatttttttctctaagttttatattttatttgtataaaaaaaaattaatgcattcttagtgtagaaaaaaattgaatggtaagaaattatacagaggagcccataaaactctcgtgatcctcctagtattggacaaccaccaagcctcattatatattactcatctacattactagtgattgataaattctaccctacatttattaaccagatgatctgagattttaagatagctttctttttcccaatttgtattttgaaaaattcaaaactacagaaaaattaaaaggatagtacagtgaatatgcgtatacccatttcctaggtttaacagttgtcaacattttgccccacttgtcttaaatatctacctatccacacttttttcccctctgattagtttgaaagcaattcacaaataagaactgtttcaccctaaatacttcagtgttttttggaagaaccaggacatctgctatgtaaccacaataccattattactct

SEQ ID NO: 58673 - DNA, 2135 bp, Homo sapiens
atcatttattgcatttagttataatgtctctttgatatactttatgacagttcctcaatctttcataatactggcatttttgaagactgtaggacaattattttgcctgttatccttcactttggcttatctgatttttcctcaagattagattctagttatgcaggggttgttttagcaggaatattatcagagcaaagtcatgcccttttcatggcagcacaggaagagatacatgatactgtttcattgcattcttggtgatagtagttttgataaactcttgttgatatataaagtcatgctaagaatctattggttcttaaagcttaaaaaataatatttaggttttttaaaattaatgctgatgtttccttctgttttagatgtaatatattaataaaaatatggttgtctaacataggagttgattatgtctgtatattctcattaagatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggtaaggaatttcattataatggacatgcccagaattgagaggattttaattgtattccaaatacaactaactagatgcacttctttcctcgtagagaagtggtttttatactgaatcagataatatttttaaaaatcggatttgccttctttgtaggagaagaattgctgaaaagggatcaacaatagaaacagaacaaaaagaggacaaaggtgtaagttaataaagatagtctaccataccttaaaatatggaattcaggcacagctcattcaggaaatagtgtcagcatttatttaatttgggcttaattagtttgaacttatatttgctaatttttaactatgcatgtgaagtggcttgttttgactgttatttataaatttttaatggcagtcttagtaaagtgagttgaatatgtgaaattatgggaaaagcattgaagttcaaacctgtggagtttaattctgttccttaaatgagtgaatgacatttcactacttttttcatctcttagaatctcagttcccttgcattaatttaaaaggaaggaattcgcctaaattcatatgtttcccttaggagcttgatggttattggctgtgccccttcagagtgtaaccttcatgccctcctccctgattcagctgggcaaactctgctttgtctgtgctgtatattggtgtgcaacaaataatatgttccccctgctccatctggccaccttagatgccattcctcaaatctgtctctcgtgtctggctttgtagcattggctagtgaaagttctcaaggagaacacatgaggaaaggagctgtggggagggttgaagggaagatggttgaagacaggagaagaaagtctaagctgaaatgaaagggagagaagaccgatgaaagagaaagtggggagtggcagaaagaatattagaagtgttcgtgtaaaacactaaatgtatatagcaacaggggactggtagatgtgatattaatatatatctgtatatttaggaagattcagagcctgtaacttctaaggcctcttcaacaagtacacctggtaagttcaagataaatattttaacctttataaactttctctaaatattaatactccccagttaaaaattccccctttccccatatttggaccaagtgactggacactaaaatgccagagttctttgttcccacctgaaagcattcacttttttcctcctggaagctgctgttactttcttgaggttacttactaaaacaaggaaaatattaatgtactattagatgacaagagtatttttcataattgtttttctagaggtaaaaataaagtgagcatgttagttagtactacagtctgcttcagaacattctcaaattgagaaggatgtcctagccattcatttgggtgatattgataattaagggaataaagtttctgatttgtaaacttaaaaagtctccttaaaattttggggaagtgttcttgaattcagtgaaatttctgacattgagaattcttgagcatctgata

SEQ ID NO: 58674 - DNA, 2291 bp, Homo sapiens
gtttcctttggaacagttctgatcttgggccctgtttccttcttgcctttcctatattagatgccccatgttggacttccaggataggtgtcaccctaacccttggagcattatgactttgcaggaggagtagagaggatggcagggttcatatatgccctaaagggttccaaggtccaaaattacaataagtagtggcttgaaggggtaatcaagagagaatagcatcctctgtagttattctccccgtccctaccttattgttatggtaacagggaaggcaggatgtaatctctaagtggattatttgtaagtagaaaaggacctggttctgtaagtaaataagaagatgcttggcaaccctagtttttaaaatatgatttaaggaggactacagaaagaaaactgaaaacaaatttgtacttaaacattgcaaggcttgttattgctgtatatgtatatattttgttgttgttgacttacaaatttgcttaaaaggttagtcagaattctaagacgttcagtttggtttcaccatgacagttatactgtacaaaatgggcacagtcagcctgacaaagtgacctgctgtaccctcagaactcttaacaacccctacagaagggacagactatttctagatgcttcttttaacaattgatgttttctgcttgtgtaactgctcaagctgaaaaagttagcaattaccacccagtgtgcaaaatagcattttattcgttctgaaaacacccctcttaaaccttaactaaaagagcacctactgtttcaggattctgttattaaataaattcttgttcactccctttgtgattttataacatttgaacatttctcttcttgccccccattttgtgggataaaaacaactctacttcaaatcctatggtatttaattatttccgagcgttattttgaggttttactttgtactagtaaattcctttacttcagtgattctcagccttggctatccattgaatttaaatgtgaagtattttttaaaatgctgaagctgggacttactcctccttcatgtttttaatacagccactttgactgtaaacaattaaatgtatgtgttcactgttactgaatttactgtctcaacacttaaggttaatgtggattattttgggtctgatatttcaagtagtactaactgccatcctatatactagtttgttttttcagggacgcttacctctcttccaaattttataagtatttattttgcttatttaccaaatccccatgaaaaaaaaaagtcttaattagatgatctgttgcatagttctattactaaagctctaacctaaagtaagtagttatatatacttggaccttacatttcagtatctttcaaaaactgatctagacttttacaactatgataaattggactcattaagtaaatacatgagtcagtttaatttagcatggcattctgcgtaccttcccacataaaataatatcactcagctctattgttgatggtcttacttaacatttctctctctcaggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacgggtaaatacctttctgaaaaatttttttaatatgtcttattcttcctaaatatctaaaatgttgaatttattgtattctaattttatgaaatgttatgaacttcattgatttaaaaaattgaaataatttaccctggcgcaatggctcatacctgtataatccctgcactttgggaggctggggtgggcggatcacctgaggtcaggagttcgagaccaggctggccaacatgttaaaaccctatctcactaaaaatacaaaacttagccagatgtgtgacacatgcctataatcccagctgctcgggaggctgaggcagaagaatcgcttgaacccgggaggtggaggttgcagtgagccgagatcatgccactgcgctctagcctgggtgacagagtaagactttgtctcaaaaaataaaataaataaaaattaaaaattgaca

SEQ ID NO: 58675 - DNA, 2009 bp, Homo sapiens
atatggctgaaagtttgagatattttaacgtttattaaaattaacattcattataggatttaagaatattccttatggcctaattaaaaagtcttaatgtggtttgattaaacagtggttggttggttggtttattaagttaatttatgtatttttagctacctaattattttctggagttatggccaacaaaacaaaacttttccacaagttagcattgaataggagcattgaacccttcatattaaatgttttgccagctttactagttttgctatttgttgtttttaaaaaaacaactaaatttattcttctgtttatggtcctattcatgtgattttaatgtcctttttcttgtagactaaataaaaattaagactaatactagctttttcttgtaaaagaaattagtcaattaaatttattaatccacttattagataaaaggaaacttatttcatccccttctgaatctcaaaatgtatttacaagttaaaatattcttgggtgaaaatagttatttgcgtttgtgcctaattctctgatactaactgtagtctacatttatacattgtgtctgaatgctggttttgtggcttcactagctccctttttctctctccttttttatcctgtcttttgctgctgctttccaccttctgtccagctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgactctgtaacatatccagtgtctccaccgcctacctcagggccagcagctcctccgccgccgcctccactgccttccctcgcatcactctcacactgtggatctcaagcttctcctcctccaagcacccctattgcctcaactccctcatccaagcctagtgttctcccttctccctctgcagctgcccctgcctctgttgagactcctctaaactctgtgctgggagactcttctgcttctgagccaggcttgcaggcagcctctcagccggccgagactccatcccaacagggtaaggctttcattattgctactaacagctaatcacttgaaaatgttatatagcagtgactttaattgcctgaatggatgggtaggatggttttgatccttgaacatttatatgccataatgccatgctttttttttttttaattaaaaaaattaaagtagaaaaatgtttttcctgttggattaattgcatttggaggaatttccttattgaactaggttttgatatcttttatagtatcgcagttaaagatgttttctagtatttaagagcccctcataatacatttctttatttttttcttttttttttttgtttttttgagacagagtcttgctgtgttgcccaggctggagtagagtggcacgatctcagctcactgcaacctccacctcccgggttccagcaattctcctgccttagccagctgagtagcaggagttacaggcacatgccaccacgcctggctaatttttgtatttttagtagagacagggttttgtcatgttggccaggctggtcttgaactcctgacctcatgtgatct

SEQ ID NO: 58676 - DNA, 1314 bp, Homo sapiens
cccaagtagctgggattataggcgcacgctaccatgcccggctaattttttatatttttggtagagatggggtttcaccatgttggccaggccagtctcgaactcctgacctcaagtgatgcacctgcctcggcctcccaaagtgctgggattacaggtgtgagtcactacacctggcccattcagtaaatatttattgagctattgctgtggccagtcattgtattttctgaaatattatttgtacaattaaatttgatattaaggatattacaattacaaatgttttcactaaataattaaaataatgacttggttattaaagtggtatgttatttggaaaattcatttacttgcaacactactcatgaaaagtacagaataaaatgaaatgttagtgcaatgtgctgaagcattcagccaatatgatgctaataggagaaatgattttcatttgtatgaaacagtctctatccaaggtagccttcatgtgggaggagagatgtttgcatgctctacattgcttttatttgactcagaaatagtttacataggtgaaaagaatcgctttttcatgatgagtagccatagatgcatgtttttacttttttttttttttttccagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactactttaacattttctttttatttctctctgtattgcttttattgcttggagacttaaagaaagctcttggaaatttttattctgccattctaattcttctaacaccctataaaatggctataaagtgtaagtgtgtttttatgggaaattttttatactggatgaacttcaaat

SEQ ID NO: 58677 - DNA, 1030 bp, Homo sapiens
tgctatgaaatacgtatgtgtaagataaagatacttttttttttttttttttggagacagggtcttactctgtcacccaggctggggtacaggggcatagtctcagctcacagccacctccattccccgggttcaagtgatcctcctgcctcagcctcccaagtagctgggattacaggcgcacaccaccacgcccagctaatttttgtaattttagtagagacagggttccaccatgttggccaagctagtctcaaactcctgacctcggcctcccaaagtgctgggattacaggcatgagccaccgtgcctggcaaagataactttttttttagggaaggttaattgacacaacttttcctaaagacaatttggaaccatgtatcaaaaatcttaaattcataccttttcacctagcaaaatttatgtccttattgatcctatagaaacagaaaaagattcaaagatgaagacaaatgttattgcagtattgccaatagtgttaggataacttaatatcctactgtaggagactgcttagactgtggacagcaaaataatcgaatattattatgcactcatggaaaataaagatgctgaactaagtgccttaggataactctgtgtgtgtgtgcgcgcgcgtgcgtgtgtccatccagagttgtacacacaggcaggttctcatcccagatatcctcagttttactaacttatgtctccctccctccctccctccctccctccctccctccctccctccctccctcccttcctcccttccttcccttctttttcttccttccccgcttcctcctttcttttctttcattgtttttggagacaaggtgtcattctgttgcctgggctgatgtgtgatgatgcaatcttatcttactgtagcctcagactcctaggcccaagcaatccttctccctcagcctcccaagtagctgggaatacaggtgcatggcaccatgcctggctgattttaaaattttttgtagagatgggtcttgctttgttgtgcag

SEQ ID NO: 58678 - DNA, 1796 bp, Homo sapiens
aactgtatctgtgtagttttattttctgagaaatgtcaataataacagtgttactaaatattaccaactcagaacatttttcctagactgttcctacttcattttgttaaaattgaaatcattcttatttacctagtaacactattcattataggtaaagctgggtgaaatgtattttgaactgatgttacttaacattttacttgcttcaagaaatgtctttgagtcaacataaactaaataatgaatatatatttaaaaagctattaatctcaatgtgggctgatgctttgtgcatctatttacatttggggatagctgttttggagagaaataggtatttgggtggtggaggaactgtgtctgatattttttaaatgcttaaaaaataatattggtgatttgcactataattgtttctgaaaaaaatttatattctcagaaactttcaaattattgtagaatatatatgcctagcttaaaagaaaaattaaagtagtccgtcaggatttttcatggttcagaattaaggcactctttctttgaaaaaagtcctcagacgattctattaatgactgaagaaaacagttggagagagaactctaggaagaggagccatgtgcatttccagtatgtgaattggcagcgataattctgaggaaaagcaaagtttataaatttggaaactcctcctagaaagctacacaaatgtcttgctttagaggtcaaaacatgagagtcaaatttataaaccatccaatttaggtgggaattattcatgccacacaagattcggaagccagagattttctgcttgaatcactattttgggaaatccgtttagatgggcatcttttcagcaagcaagctaaaaattagcttaaagtgttcaacactttcttttcttaccttcagaacaagaaaatagtaagaatctcctgcagctatatgaattgcctgcttgaatcatctgtctgtgaacttagaaatattctccagcattgtgtccttttcctatatcagtagacactccttatcttttatagcctgaaaaccctggaatatgatgacatgtggaacaaacttcttaagtcaatacaacctagctgtaaatgctgttaccaataattctttcagattcacctcacccatgcctggccttctgcttgtgacttaagcttactttttgtgtgttaaaagcattgtattgcttagagaaacagccattaacttggtggttaaaaaaaaacccaactactaagaacttgaatgagaaatgaaatgtagtcatagaatactatttggttcagctgtgagcagtatttacattatcatgttaataatgtaagctgtgaatattgattttccatattgggagaagcatgagtgtagtgagggagttgtagaaggcatcttcctgttagaaagtagatagcaaaagctaaaatgtaagaaacagctgcaagagtaggaaacgggtgggagggttgaggcagtgaactactgatttttgttataaactttaaaaactatatatttatgttgttttggtaaaatagaagaagtaacaaatgctcaaagatctaaaaacttagatcttttcatcatagatttcttgggacagctactgtgctcttaaatgtttctctttagcttctgtatttaaatttgttctaattagaataatatgggtgtatcttttgccctttgggcccaacagattgcttagagcattatatgtaaaatggcccatattttttgatgtaggttgaattatctgaaatttaatacaggct

SEQ ID NO: 58679 - DNA, 1652 bp, Homo sapiens
ggagaacaaaaacgtgaagaaattgaatttgcaaataaataacaagaaaatttgctggaactcattgatcgtctagatcaaaggtccgcaaactttttctgggaagggccatctgtgtcatttgctagactcttcctttgtagctcgccatagacaaaacggaaataaatggttgtagccagatttggccctagggctgtatacagtttgctagcttctggtttaggtcaaaaaagctcaccaaaagtccagcccagtaagtggggaaaaaaacaaagacctcccaccaagacctctcactatggtattttagaatgttgtcctagaataagtaagatttcaaatgcttggtaaggggtggtgggagtgacaaggtgggggagcttcaaaatcctaagagaatctctttccagtctaaaatctcctcttctgcacaacttcctaagaagctattggaagatgtgttctgttaagatgagggagtaaagcaagaatgatgaacccatgacagcatccaggagacaaggaatccaacttaggaaagagataggtaattcccgcacgactaaggtcaaagcaaaacctagggaatagcccatccggttgggggcgctgggagggctgaaggctcccgacgggtagtttctgagggaaagcaaaacaaaagaatagaaaaacctgaccgtggttctgctatgttggaccatgttgatagggattacagttctaatggagagtttggggtgaagtagggacaggtatatagaaaaagaatcaaatttttaaaagtactactttttagcaccaaagtaagaaaaaaattgttctagaaagtaaatgtgatcagcagtgaattatgtgatatgtgaatattggtgtatccaaagtggtggtatgagtttattgggaaaatggagaagaaaaagttttggggagctagagatataggaattaaatcatttgtatagtaggaagtcagtagataacatctaaatatgaaaagtctagaagtaatagttctaaatgaattactgtatttagaaacatgtgataagtaccagagtattgaaaataattgcttctggggagcaaaatcagaagtggtgagcgttagtaagaggattactgttctaagtcttataatataatttggctttttaagttatttattactactgttatgtttaattttttatttttaataaatgtagagtcaatagagcacatgtctaagtgttcattcttattagtccaataccctttattattatatcatttattaaatagtttttggttcctactcatataattaatatttggcttggccatgatgaggaaacatattctaagaaacatgagtcagtcctatgttagtctccacatagaaccttaatatagttaatatctataaatagttcgcaaatcaccagtactatctgaaagttataaaaggggaataataattgcggcacagaactgagcagttggaacaatgttggaacaatgagagtgtatagccctcctattggccttcggaggccggatggaccaaaagttgaccgccttctcttgtgagtatcaactcttgcctcagcggctttgtaatattaaaacttagctgtcttattacattttatccattttttatttgt

SEQ ID NO: 58680 - DNA, 1561 bp, Homo sapiens
tattatatattaggtccagtatttatctcattttgtgacagatttgatttttatatccaatgacattaagatgtcccataattcagtggcattctatctaagatgcaaaaaacaggtctgcattgtacatgatatgtgggaatggatggtcattagtgtctcatgacagaaccatgttgtatgaatgcaagtttttttttcttcttaccctaaatgaaaacttaaaattacctgttacattaaaaattcagttcagtaggttaattactatatggaagtttagcaaatgtttgttttcaccagtgctggaaatgctaggctattagacaaaaatggcagcttaaattgggcaaatttgataaatgctttagcatactggagtctagtaataaggttctcatgctctctctctctcctgtttttcatttccagtgttctatttaggtgagtttttgaattctgatttttcatttaagttctccctctccacttcatgaataattaccccaaagagaatgtctcattgtcttagaaactgtcaagcttaggtgcctcttcagatgctcatcgaacacttgttttactcaagctcttcatatataaatgtttctttttccttattgttgatgttttccatttgtttcaagtaagccttctggagatgatgacagtattatgttgcagtctttcatttgctctgtgttatgtaaagcttatattttattttgctagacaaaaagaagacacgtttgtaaatatgtgatggttttatgttattctcatgattttatctcctctgtccagctagatatgaaaataatgttcatctgtaatgttttctccctctgtagggccaacattgcctagacaaaactcacaactacctgctcaagttcaaaatggcccatcccaagaagaattggaaattcaaagaaggtaaattttcaagttattgtttgtactttttctttatgcttcagaagacaaaactgaacatcctgtgtttaaagtagattatgtcttatcagctgtttaagagtcacaacttttattcttacattagtaagttttgtgactgtcattagtaagttaccagatacttgttatgctggacatgagatgttataaaatttcatatgtgtttttttttgtaaaaattatacttaaggtatgtttaaaatattgtaaatacgcttaacagaattcaaaatcttcttatggttcaagaagtcttacttttgtaattataaagtgatctgtgagtactatgattttcatgtgacaaatttaactaaaaagttgaaatattgttggctgtttctgtaacacattgatcttcagatattactatagggtttagtagtagaatacaaaatcattctctactgggcagcattcttccatgactaggagttctctgaaagtggtcagagtacgtaggctgacaggctaacctttggagtaccaggatggtgagcaggcaggcctcagaaccgcacaaacgctgagctactaaaagttccactggaagccccaactcatctgaggcagcttgttcagt

SEQ ID NO: 58681 - DNA, 6052 bp, Homo sapiens
atgaatgcagagtctactgtagtaattatatacagtaataaaatacagtcatgccaatcaaatctaaacagcctgtcgttttccactactgctaacttacccagcgtttctacatttccctgcttgtacaaaacgcctaatggtaaagtatgttaaaggcaggggtaagcctgaaggatggctgtttgacaactgcattagcgataaagggacagccgtgaaaaaaaaaaaaaagtcaataggcctaacttaaagagaaatgtcctttcataggtaaaacgtaaggtttatgtaacatcagtgctagtgttaaaaagtatgctgaaaacatcgtattactgaatttactcaacctggacaataagtgttctttcccttattctgctctgttgccctgactgaatgaagaaagagttaatggtatcagtattaagcaggaagttctgttaggcttatgcatatgatggcatgaataatttagcatcttcaggaaatgcaaactgcagtagaatttaagcaacctatcagaatttagatcaatattttacatgatagtatgaaattaaagtcagtggaaagaagatgcttaaagataccaagtgaagaatgttaatagtttaaactgtgagaaagactgggaattttttattggaaatgttttgtcttacgcagcaataatggtttacctgcattctgacacttgtcagatgactttttgccaacatgattggtaatgggatgtggcagtatctttgctgtcaaagaagagataatttctcaggtttttcttgtaagttttaaaaattgtccttatgggtttttttttctctttaaatatggaataaaggaactgaagggtaaaacctgaagactagtcatgtttctttaataaaggttttatagaagtagccatttgcaaacgtcggtaagacagatttttaaaaaaacagtttaaacttataattattgaaaatattctaaattgtttatctcctgtggaatgatctcattagcttggtagacattttatgtgtacgcctgtggtctttctatatcttatgtcattactgtaaataaatattgtgcatgcaactttaatagattgggtggttggaagtacttagcaaaggtgacatttatcaatcttattttgtgtttgcaaaaaaaatacagtgtatgtaatattttcaaagcaagacaattggattatgttaaataatttctaaaaatgatgaaaaattctcttttatttaagacattaccatttttagatgtgtgttatttaattataaattggtttggttctgatttttctaaaacttttagttagcatgagttgtatgttttaaataataacagtcttaggggagatctaaaacactgtcttgtttgcctttatgtgggctttcctaagccccagtgcattttaaccactaattgtttcttggttaataccaacggaaaaagaaaatctttcccatgctgaaaataatttcttcaggattttacagaaaattattgatgtaaagttttggatgtcactaaagtaatagtaaaaaaaaaaatttacttttgtttgtctcatctcaattttgagtgtcactttgatttcatataaacccttccccttttcatagatcatcaccttctcattgagttttttctcctaaagagaatttacttcattgacacttaagctaaaatttaatgtaaatagcctaaataaatggctgtttgatctggccacacatttttaataagacattttgtcaagtatgtatatatatattgagaaaaaaaatagtaacatgtggcttggtaaaaaatgaatagctgacttttagcaaaccaaagatattcttattttgtatcagtgaatataaaactctttattgcagtgtgccgtttataatggctttggtctctttccaactagtaggaatgagttaatcttaagcacttccaagcttaaatttttttcagattcaattctcctaaatgagaatatagatcttgtgaaattaacactaatagccacagatcttggcttcctctaccttatcttcattgactttaaaaatatataaccctaaaatgctggttgcactctttgaccgtataacttaggaaataactaagttataagtgcatcatttgatctatggctgcttacagggtttttccaccaaaaaacgattgcataaatttttttaagagcctatgttaaagaggatgcgtttttattaaattacagagcttccaggatgaggatctagataggacgtatgtataaatacattttgaacatttcaaagcaccttttagtttatgtgaagttcttcagatggccccgttgtccttcgaagcttctaacaccaaggtgtctgttgcagcccagagcaaggttactgctacccaggacagcactaatttgcgatgtattttctgtggtaagcaacattatgtttacattactttttcaagctgtggtacatgctacttgcgcatttccataacttttgttttcttaggccatagtctggtttgtgatatttgggatatatagcaagctattgtttttatgttgtgatatttgttgtggttcatgtaggtgatttggtcagctttgagttggcttgttagcgagcattagaattagttagaattaggatcttaaaacacttcttgtccacctcttccaacacaaatgagaggggtttttgtttgtttgtacttttttgtttttaattattttgtttgggagcaaatttttgatttagaatttaaggaaaaaatttatgtccatcttaatatgatttgaggaacgtaaatgtgccttgtgcaaaggaaacttttgcttaacttgaattaattttaggtgtgcatgttgtgaggcagatgtaagctattacttgctttaataggttgatttctgattgacagcctcctttattcagtaggttagaaatctgtgacttaagagtgaatttaggcttattgagtgttttctttcactctcactctcatatacacatgtgtgcacatatatgtattgtttgcatggacaaaccaggtatgtcacttagccaccccaaattagagagaataagatatatatctaaggatacgtatctatctataaacacagatagatacatatccttgtctaaattctttttatttccatttgtttctgaaactttgttttaaaaacccaagttccaaagagttacttttaattacttgagctttgaaaagaaacctcatatatgcctttttgattcatgtgtaccttgctagccagattattttatgagagagataaagttattaaatgatatacagtattgctccaattttacataaagtgttcagctctgtgtatgtactttatgtgactcagaatttttaatgtgactcctcaatactaatgatactgtttttttttacctatgaagagaattattttaaaatgtatgtactttctggtttaggcaaagaagtacgtgttgcaaatttctttaaaataaaaaaaagaaaaaaggaaagaaaagaaaaggctaatgtatttgttagtcacttaaagttatattttaggattgttccagaggacacagttacagcagtgagcctattgtgtggctgttcataaatccctcctctccctcccagatcccacaatgaaacactgcagattaagtgtgtaatcagtaactttttctcctcatttttctgcctcctcctgggggtttttccgggctatcttttgaactagtcatgagtgattattgatatttgtgttattaggactctctttagctcattttgaaaacccatccaatgttgtatgcctttctatttaatatgttgaggtccatacgcagaataatggatactttacccaattgcagagaaaatattgatttgacctaagtgaaggtgaatctttaaagttgtaaaataatgtgttaaaaagtagatttccccccattattacctttaatttaactgtgtgcaaacaatataattaacacgttgctaagtttaaacttgattgtattgtgtatataataacaccgatttgtcttttagtcctgtgtttttaaatagtctgtggctaattgtgaaaatagatttgtgaaaattaaaatgtgacagtaagtggaatgtgctttaaccaaaactcaatattgaaggcaagactgacatacagttcctattatagagtctcctgatctgattttaatcatttatagggtactgtatcagtgacattgccacatttctctgttacaaacagtaactcacagactttgctatataccttcttcttgtagccaggacaaattaagatcagccactatctttggctgtgagggagagaacaaactctcaaacagctgctattctttatgataacatagaaagagcaaagcaggttcactagtttcttaaccttggttgttcttccctctttttcccctccccaaagggctgttaaccaccacatgatgctcataaaatattgtcattttcccactgaaatggttatgaaagtacctattttgcattttatgagaacacactcatttaggaatgtgacctgtgtaaagtaatgtttatattcctgaacatacagcggcagctgacagactttgcctgatcctagttgctgcttcatgtcatgtggggtgcctttggtattacttaccaattttatagcccattagaatgtttgacaagaaggaaaaatgtaattgtgtaccttaaatttatatttacctggaacttttaatgtttatagtatgtttgtattaatttttaaatgcacataaatttcaatgtgctagttactgcaacctgacaatttgaagaagaaacaaacagaacaaccagattaaatgtagatgtgaaaaagtgccaaagggagtgattccatgcacggacacacacacacacccaatttaaaggatgtctggaaagacaaaaagcccaaaaatccattatcatcacaaagaaccatgtagaaaagaattgttaagagttgttctaggatcaaaattctccccattttaaaaggaacttccttgaagcttttcatctcagctgcaggaataaactgtagtaaattttttttataattatgataacagccacaaaatattacccacattttaaaaatctcctttctgaacagatttgcttagtaagcttttaaaaagctttaaaaaaatattccaaagcaggttctgtaaattgctaaaagattttcttttctcagcttttgtgagttacattaaacttgtgttagttttttaaaaacctgttaaataaaataaataggattgagttgaaattttgacgtcttttttgaatctatatatttgaattaaaactgagattttaattggcaaatttaatccattaatattacctttgatatataacacctgtcctaggtgtgtgactggtataattgcattcttctttgaggtagatgccaaacaggtctaacctactcacattcagctgtttcattatttaagcagcctgaggctttcaacttaaatactcaagtaaacattattttaaaaaatagttaaaacataatggtcttgtgagttgcccatgctaaatgctcacatttagtactttggatatataaagtacattccctaaataatttcatgctacctcagatttacccgcccctccccacacttgtgtgtccccagaagagaggtcttttctctgtaaagtattaaacatttgtgtatagcctaataggagagtctgtttttacatcattattttaatttcccaagaaaagaattctagtctgtttactagacagcaatcatgtattttcatttatacaaacatttacgtgtgtatttaatttcaaaagttttgtttttttttgttattgattacatgggattaatttttttttataatatttatttggttctcaaaatagcagactcttaggaaatctaatgaaatatatcactgcagttgtcatcaatttgtctttagaggacaaataaag

SEQ ID NO: 58682 - DNA, 1414 bp, Homo sapiens
gtatttatcttaagagcagtgggcagcaattgaagagcttttactaagagcgatgatttgggttaattattaaagtatcactggctactgtggggaaggggacagataccacgattggaatgggcaacttaattagatgatgctaatgtaattgtctaggttggtggtctctcagtttttgagcttatcccctcatacatgtgtgtttatcatttatatatatgtactttgttgttgacaagttgagtacattataagacgttaaaaaacagtaaaatggatgagaaaaattaatgaatggaagtgctactatttttttccctgccccaactgatgtatgttaagcttctgggatacttgttgccccaccctgaacatgactaagcaagggatcatggaacaagaacagtagcaatggagagagtttggagagagaaattaggaggttgcattaacaggacttgaaaattggttaaataggagtaaaagaaaaggtagtggatttctggtttgtgtaactgaacagataagagctctgattaaagagtcaaccaacactctgatagatgctaattgtgttaaagtagcattctgccagaatgtggtggtttctctgagcatatactcaataatgcccttagtaacaaatggtaggagggcatttgatgggcaagtcttgatctgtgttcaggaagaggaagcagagcaatgaacctgaggacacaggttactcttgcctttggaggcattagggtatgacagcattggtaaatgataggcccctcaacttccagttgcctcttcaagtgtctttagctagaggcagggccattcatttcacgactaaaaataaacggcttacaaaacatggtggactgaggaacatattaagactattgccagtgcagacaaataatttttcagcaagttatcaactgatagaagtgattttcatattggcttagaagggaataaaatgcattcgggtcataagttgggagaggattgcaagaaataaaggatgggaaaaaaacccaatcatatatacagttttgccttaaggttgagtgaaaaaaaaaaggcgggggggaagatgtttatgatggtacattttcatgtgtagctatatatgcacgatgctccatttcctgagatatagaaaagtttttttatcacattttaaaacaaaatttgaaataatatttttgaaaatgtttcaaaatgccactttaaaaatgcattgctttgaataaaatttactgtttgtaatccttatgcctcctagcacagtgccctgcaatgtggtaacttttttttttaatgcagcaactgtaccactgcagtatctgcctcccttctattctagatacctttgagcaaacgtaaactcatttgctttcattctgtctcaaaa

SEQ ID NO: 58683 - DNA, 1002 bp, Homo sapiens
cgcccatgtgcatattttggggcattgcctctgagttaacattgggcattcctgttttcataatctaggtaaggtagaaaaattctaaggagtcttttgaagatggtgttgaatagcagtatctttgaagttagttggtatttcatatatgaaaaatattgtgacattatttcattaatacataaaaaattcctaaggggtagatgctgttctaatctaagagaagaaatgctgtagttaactggaattatttgtattcctgttaaggtactatgttacatgagatgagagaaacaaataattcaaaatttttggtcttaaggaggctgttaattgtgtagatagtataagtcatggtcaaaaatatccacaaggcagtgtaagtaacatgaatggtgcagaatggtagttaggaaacaaatatagaatgctactcatgtaaaggtaccaaaaataattcttacaaggtagacctgctatttatgtgagcttttgtaatttctgaaatgattcacatgagaaaacaaatgacttctgtgttctggaaaatttcaagagtatttggctattacattgtcattcatgtaggaagaaatacattttttatgaaggagtttattttgcaaatattatcctgctctttgctgtggtaatattgtaacaaagagaattccttttcctattcagaaatactcactggtttcccattgatttaaagttttcctcaagccttgaaatcagtcccactttgaagactggatgaatgatatgggtgcctaggaaatgtgtctccagtctcttctgcagataactaatggaattagccttatattgctaggaagatggtagagtgggtttttgcataactattgtagtatgcagcaataaccctgcaatggcttcctatcaatcttagaataaagtacagaacttttttttttttttttaagagagagtcttgctctgttgcccaatctggagtgcagtggtgcgatcataact

SEQ ID NO: 58684 - DNA, 1025 bp, Homo sapiens
agaagtgggactttgcaagtcacagaagtggcaaaaattattcctaattgctgttatcatctgtcaatgaaagggaaaatgtaggtctgatggcctttttgatgcttaatatataaaaattgcccagcaattagctttgtaaccaccatctatttaatagcagtaactgttgttactagctgtttctagctctgtctcagtcagtacatttgtgatttttctttttgtgattttttttgtgattttttcataattatatctgaattacatattcatatatgtggatttataaattgttcatactaaattacaataaatacattttaatatattaacttctatgacttttaagttcttgttcactaactgtctgggaaagctgctttagcttatgaagcctcatttttcatgagcgcagcttttagtcttacgttgtgggacttaagacatcttgtcctgccccaaggtgggaatgattaaatggctaaaaagaggcagatactatttttgtgataaatatgggtttcatgtctcatagcaagttattttagcctggagtttgttgtcatacagacactatattctgtctgcctttcattcccttttctctacttccttgtttctctggcagttaggcaccttataatctattgtctgatgcatgtccagctagtgacttcagttcttccaggcttattttacaataggcttgatctttattcagtggtgctacaatgacctgaggatgtcatctgtgattatttgcatgctttcttacatgaggatagtaatttgcatgtaattactttatctttattcatgaatttttatcctttattgctcataaattgaagaagcattttgctggatgttaaatagtcaaaaattgtgatacctctgtgtggaacattttcctcttaaaacaagaataaagagaggctttaatagtctgtcttgttttccactgatgataagagatgaattgcaggaaccacttccactctgatgagaccattcacaacaca

SEQ ID NO: 58685 - DNA, 1696 bp, Homo sapiens
acaaataatagatgtctccgggaaagtatcatatatgtttgaatataatgtgtgtgacacctaaaattatttctactgtatgaagaaaatcagtactttgggagaaacaggtaaaaatgaaaatgtaattcagcatcagtttgagtttcactgtgagcctcagtccaggttttagaaagaaaggtacgtagacacaattctggctttaaatagttcacaatgtggcaaaagaaacttcattaatttcttaagattaatgataaatacagtttctttgggcagattgactctaaatattgagttcaagggggttaattacagtataaaagggtttctagctgttgaaaaggttgggagctactgaattaggcctccagatcctgtggcctacctgttatacctcaaagcctcaattttcagccgcttccttagcctttctcaaccagggctgtgagacagttaagctctaaggaaaattgtttgagtaactaatatcagttctcccaaggactgtatttaggtattctttacctaccatggatgtgttagggccagactctcttggaaggatgcttctcttctgttctcttcccttgccctctccctctctttatgcttctgttttgtgatcccccatttacacacaggaacaacctcaaagttctgggttggaattgggaccagaaaatgactatagctttatcttctaatatttgtgttgattaatgcttgaaattatatctaataattcatagtcactaaaaagaaaatttgagtgaatatttgatagtagcttatcctcttaaagtttacagacctcaggccaggctgattctcattagggccaggcatgctggctcaggcctgtaatctcagtgctttgggaagatctcttgaggtcaggagtttcagaccagcctgggcaacatagtgagagcctgtctttaaaaatacatatattaaaaattaggtgggcatgatggcgtacatctatagccctagcttcttgggaggctgaggcaggaggatcacttgagcctgggagtttgagtttacagtgagctatgatcacgccactgcaccactccagcctgggctacagtgaggccctgtgtctttaaaaaaaaaaaaaaaaaaaaaaaaaaagtttacagatgtcctaatcattagagctaataaggcctaaattactatgtacttgctggttctccatgttttaattttcctttgggctaaatcaggtgtaaaattgggaatcttgaatttaaacctctaactcagggattcaaaaagtgtggtccatggcaactcttgagggtccccttctggaccgtttcaaggatcttcttcattatacttcagccagaacagcatgccacagcacactgaatacaaaagcaattgaaataatctagctgtctggattattatttaatatttagtgttaaatgctaaagagatttgtaaaaccatggcattctaatcacttaatatttttgttctgagaaatagttatttttcattaaaatgttattttaaatataactgctttttagttgttttaaaagtgaattcctaaaagttaaaacatgtaatttagttatttagtacagtaaataatgatagatgtaacccacataagcaaaagctctttagggtctttaataattgttaggaatataagtggatcctagga

SEQ ID NO: 58686 - DNA, 1851 bp, Homo sapiens
tgccaattattggtttgactttataaagaattattattttttaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacaggtaaggtgcccatggtttatttgtattttctttctttttccagagacaaagcaaaactgaagatttacttgtattcttgaactgaagtgccatgtgtatgttaaaacaaatgtttgttaacttttagatcttgtatatatttgaagtagtttttgaatttttattttctatagaaatgtgaactttttattgatgataaatgtataatctagaaagataatcctgtgagtttagttctttttaattctgtaacccttttatttgaagtatttagatgggtttcatcctgctttagaaacacttccgttgcaagtacatgaagcccagagaatatgcagtggataggaattatgcttatttatcatctttgtgtaaagaaacacatgttttctgaaagacatttttcaaagcatggacttgaagtaggactgggtctccttcccagtaggtaaaaatgtgattctcggtttttttaaagattttaggagtgccctcaggtggtatcagtcatgaattgcatctcctctgatagtgcatattggttagaaatatatatagaaatcactttttaaaaaaatctcaatttttaaaaactgtacatatgtcaaggataagctcagttttgtcttggtttaaaaaatagaaaaatgtaccagtgtgtggttatttctttgaagagagagattttataatcaggaaataattgttatacatgaaaacacaaatatgattactcttgcctatattgtatatttagtaatgattttaatgatataaatgtactgtaaacaatatatattttaagaggaaagagttgcagtcagatgaaaatttgatactttgttgaaagtgtagaatatcaaaatctgttcaaaatctgttataaatacattaaacaatgtatatgttgccttatactaaaaagggttgaagcatctagctggtgtgttagtctgtcaaatactaatttcagagcaagaagacattttgggatcttgcagaaacttaaagttgttatgcctttagatgttttgtatcagatcttcttttgaggaaattaatatcaatacataacttatacataggttgcatattttgtctagtttgagaaaataaaccactagaacttggcctggtgtgtctctaagtccagaaaatagcataggaaagtctgtatagtcttgtatgtaggtcatttctctaagtctctgtacttctctcctaggtgtcagtattttattggcatgctatcataggtatagaattgcttttcatttactgtagttttaccatagggaagaagctagaattgtgattctttttttttttttcttaatatcttgttggataggtcagttatgtgataaataattaaggtaccaaagtttggagagtagacatttgactatcccgtgttttagaacaaactagcattatttttatttctaaactttcaaaagtgtatccgttgatattagaaactaaatgttactgatattaggaacttatattggaaactaaatgttccttttttaaaagtagttaaaattttattattcctcttgtcattgacttttgatttttagtttttagccaaatggaaaggattgtttctctcaatgagtagtc

SEQ ID NO: 58687 - DNA, 2640 bp, Homo sapiens
cctgaggataaaagtaattttctcagtaaagaaggtgttatcacagacaggtcatcagtatactaaacatgtatgcaattaagcaaataatgattaatttacacttgtattaggttggtgcaaaagtaattgcagtttttgccattaaaatagcaaaaagtgcaattacttttgaaccaacataatagttgtattcagtttagtgaatgaattagatactcaaatttagaagaaaccatttcttgtgttgcttatctaagtgttcttcgtggatcctgctctccttttggtcttttaattatactttattttttttggtttgtcttcaccattagactgtacacataaagacaggaagcctctgtcttgtccattattgtttccagcacccaataacagcactgatcgttgactgactcctaggtttgtgtggctatgtggaacacttagcatattttaaatattgcaagtttgaatattttattttattttttacagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtaaggctttactacaattgttgttaaaaatgatttagtattacaaaaggacttggcatattccgtaaaataaagtagttttaaaactgtaatcaaaatagtctctctctgggaaaaactgaatataaaattgtctctccaccctttctaccttttatgaagcctgaacttaaacgaagatttagaacaagttgtacaaaaatagaaatacaagttcttttatgatgaattttcattagattttctggccttcaattagtttttgaaatctaaagcaaattaaggacaaacaaacaaaactctacttaagtggcagattgtatgtttatggaattaatttcctgccaatgtttgggatatggggttagaggagggagttgaaagtatagatagtttcagaaaatactgttaaattcacatgtgatagaaaaatagtaggtattgaggttgctggaatagtttggcttttgcagttcatgtctggggcgacagctaagcttttactaattcctcgctctggatttcttagaaagtagctggattatctgattacttgatttcttgggccttaacagatcaacagcagtagatagaggaaaaggcagataagctcttactagcattaactatatactaatagtaagaacttttataaagagtagatttacaaaatactttgggaaaaaatatttaccaaagatgttggaatcaactgactttaaaaatcatcctgctacacatgcggaaagaatgtaacaaattttcttcttcattgcccagctgagctcttatgaagaaaggtaagttcctaggtttcccctacattgtgtggtagtgtggtgtaaacagatgctgcattagccctgggttttaggatggtgattatggattggtaagatttgtcatgtatgcatataggggctgtgggcctacgagaggttgggctgtgaaactggtattttggcaaaacaaacaaacaaacaaaaaaacacacaaaaaaactagcaatcttagaggggctacaccccgtagaaagaagacaagagaaatccttctatcagcacagggaagcaaaggagtgtgttgctttcttagctggcttagaagctcccccgagaaatgagaaactccttcacttaagcaacttaagccaagaaattaggaaacactggttgtagagcactgaaactgttggggcacgtggtaaaaacaaatgtggtgcctgcgtggagatgaactttcacagctctgagtcaatctgtggaaagagcaattctctgaatttaccagatttatccatttatacagacggtttcggcctgcctctctttctgccctctctggctcccttctgtctgtctctcccctgtgccccgccctcttcttttccctccttagtcttcctgcgttttcctctaggctccagtttccttgttgtgttgcacagcctttttctggtctcccaggctttttaccaagagccccctttgtcccatttgtagtccaggttctggggagcactgtctcatctttgtctttgttccagcagcgacttagtccagagataaatcaaatacaccccaagatgttattatggggaaaaaaaaagaaaactggacaattaaaattttgtagaaattgttgaaccttcttaatacaacattccaaactaatagctgtaaagaaactacgtttttggtaaatttagtgaattggttatttgaaagtactgatgaacaatcctacatttagagaaacaaaaaagaatatttgaagataatcagaaagaaattcttttttttttttattatttgagacagagttttgctcttgtcgcccagggtggagtgcaatggcgtgattgtggctcactgcaacctctccttcccgggttcaagcgattctcctgcctcagcctccagagtagctgggattacaggcatgtgccaccatgcctggctaattttgtattttta

SEQ ID NO: 58688 - DNA, 1047 bp, Homo sapiens
ataactcactacagactaggctctgtgctgcacataggggattcaagaagggatgacatattttccattttcaaagatgatgaagacatgtttctgaataagtgagttgggccatgactttcagtggtggtacattttaatactttacagcatatcacatactaactgggagtatcattaaaatgctaggtgcatccataatttttttcctccttttgattgcctcctcttttgcatcctgtctatctacagatcctttcttctgtacttgcaacatacatccccagtgctttcctctccctcctttttttctcgtctggtatttgtgcttctgttcttgattttgctgccactttcttgaattttttctctacatagtagctacagttatctttaaaatgtaggccgtgttctgcttaaagcccttcagtggcttcccagtatacacttggagtaaaactcaagtctttcccatggcttaaatattgcctcctcagagagtcttgtttgttgagagattaatgaatactctgagaactcggaggaaggagcaattagttctggctttgggaaccacagagagaattaataagaggaatagtatttgatccaggtcttgatgagtaggattttgttagattacagtaagtgctgaaaaagcatttaaagagtgcctactgtgtgctacatattgtcatattcatgctttctttgacaagtaatgattaataagtgatatctttgaaaagaaattgatatttgttaacaacttggttttactgcaatctcaataaatagtatatacaagactagcctagcaatccttagtctgcttaaataccaggaagcgcttcattcactggtacctgtgagaatagaacttggcaagcgttctcatcacatatacctgctcagtcaatttgacaatattcagaaatgaactacctgacaaaactacaaaattgtaatttggtgtcttggtttttagaccttttttcccttcttttaaaccagctatctctagccttttaatgccatattttattt

SEQ ID NO: 58689 - DNA, 1948 bp, Homo sapiens
cagagtgctgggattgcaggttagagccactgtatccagcctgttaatgtttctttttatttttttcggtctccagagcttttgtaagttttacaagtttctctgtctctcttatggttctaagaatatggaaattgtgcattctaattgtctttattattctctgtctccaggtatgttgcagatagggacaggttctttttaccgcctgagtcacatttattgaattttgcagattctatacttaagtaagaggaattcatgattgaagtcaaatagtaccataagaattattgagaaaagattactccctaaaaagattactccctattgaaaaaaagattactcctaagcacacatgactacatgtggtaggtacattctctaaagtactttttctacatactattgtatttaacctttaacgttttcccctattttaagagattttttcatcctgcagaatgacccaatagatttgctgaaatgttttcttttaaatcatgccatcttgcttttgatggtcatttagactgaccattttctttggtgaatctggatcagttatactagactgcatttgtactttgcacatgaatataggtgttgtaggacaaagagtttaatagtgccatattgatgtttttaccttttatttattattctatttctcagaaagatgaatgaaacataagtgtggtctttagaggaagttttgcctttctgcatatttggtgctgctgcattccagatggttttcttgccttgcagaaaataactttgtaggctgccgttatttgcatctgctgtttgtcagtggcattcacagtgtttttgttgtattcctcaatctctcagccattgtggcagaaccgaattgtaactagcaagcaaattttttctcctgattcttagcaagattttttctttctttttttaatggaatggcaaaggagataagtttctaatttggtctactggtgatagtggttagttagttgaaatcaagtttggtatccttaaaaatgacatataactttaaatatttatttttcatttatttttggaagcttaaacagatttttaagttttttaaaaagttttttgagatggggtcttaactctgtcacccaggttggagtgcagtggcacaatcttggcccaaggctccagtaatcctcccacctcagcctcctgaatagctgggactacacgtgcctgccaccctgcccagctaagttttgcactttttgtagaggtggggttttgttatgttgcccaggctggtcttgaactcctgggctccagcaatccacctgcctcagcctcccaaagtgctgggattacaggtgtgagccactgtgcctggcccagaaatttactttctcacagctctgaaaagtctgagcttgatgtgctggcagggctggtgctggtttcctctgaggcctgtctccttggcttgcagatggccgccctcttgctgcctcttcatatggatgttcctctgtgtgcttgctcctatggtgcctctcactctttaaatactctagtctctgttatatgtgttaattctctagtcttttgctgtaaagctttttctttagtgttagtctggtgatgagaactctatattgtttttcttcctaaagcatgccccagcagataatgacgtttcagctttggtttctttgaagtggagagagaacttagacatatgcaaagcattctgaatacagaattctgttagacttgtatgatctttttagtgacctaccttgataaagacttttcaaaacatttaacttaatttttatagtatttctgtatactcacatatcaatttatataatatttagattgcagacttacaagtacaattataatgaatacatttggtcacagacagctgattctttttgttttttgggttttttttttttttttt

SEQ ID NO: 58690 - DNA, 1082 bp, Homo sapiens
tgagccaccgcgcctggcctgaagctttgttgaggtatagaatgtgtgagaaaaaaatgtatagtccatgtgccaatgattctgataacacaaaatatgcttagcaacaattctataataaaatcatcattgtcatctggtcttaacttaaaaagtgttatagcattaataagctgtctttaatagttcacctgaaaataagaccaatgaagccaatggaaaagtaaatgtattttataaaagattctaattgaactattcctaactagattctcctttgcagaaattgtaggatattatattttctaggtaatatttagatgcttattcttgctcaggaagtagattatggggcttctaggtggagaggctggcggtagaaaggctgttttggaggctgttgtaatctaggaaagaaagaatgcattaatgtagtggcacagtggaacagagtggaggaggtgttagtagagatgtttgggtggtagaattgacagggctggagactgacatagggatgttggcagaggagtcatctagggcactccagtttctagctcgggccagacagtatggttttggtatccttcatctgggaaagggaatgggggggagaaaaataggttgtattttgaggtatgtatgatatctaagtagaaacacataataggcagctgtttatgtgagtttgttgctcaggagagaagtatggactgtaaatacctatttgccttttttcttttttcttttttctttttttttgagacaggctagagtgcagtggtgcgatctcagctcactggaacctccacctcccgggctcaagtgatttttgagcctcagcctcctgagtaggtgtgcgccatcatgcccgggtaatttttgtattttttagttgagacagcgtctcaccatgttggctgagcaggtgtcgaactcctggcctcaagtgattcggtctcccaaagtgctgggattataggcgtgagccaccacgcctggcccctgtttggcactttttaacaggtattagttgaaatggtgaatttggaatctgtgtttaaaccttggtgctgtgtgtg

SEQ ID NO: 58691 - DNA, 5280 bp, Homo sapiens
atttagagcaatgtatatatgctaaatcactcttttcaggcttaataattggagaagaatatttctagtcttttattattgtttcataatttaaatgctatttgaggagtatagttaaacttgaacagagtactttggaagccagtttttttcccttcctccttcttaatcagaagctgtttagttttactatggctatatgtggtcctcctagttttgtaataaggctggtgtaatttcaggaacctttttgtttaagagatcaggacattgaaaaccagagagggctaaactcaacttgagtcctgactctttgctgattaagtgctagttctgactcgtagaaggatcagtcatgtgggtttgcctggcaggcttaccctaagtaaaatataaattcctggttatcactaaggggggaaaatatctgaaaattcggtttttcaatgaagagtactttgtgttagacatagctgtctgtctcactagcaatgggatttccagggtagagtattaaagatatcatgagtcttttgcagctaagcagcttatgaggtcagtcaaggaataaaaaaataagccagcttcagaagagtctttctttgttattagaaaaattgtgagaggctatagaattatgtcaagatgctgagaaaactatagtttctaaatttttaaccaaaagggtatcctctttagtagtaaggaaataataatgagaaaaaatgcttaagttcagttgcagacattgcatatcttgaggaaaaaagaggacacttctaaaattaaaatatagcccataacatttttattttttatgaattggattactcattttgaatgttgccttctgctaagttactcctttagcatgaattaactgtattctttttcagtcatattcctaaatgttagatgaaattcatttaatgttttgaactttatatttttagctatactataaagattacacagctgttgcttggagatgtatgtgaattacttggagcagtaggatcatgatttgggtcctatgccagctgatagtcagctgctacaaatgaagagatcctaacacatgggaataaaaattcttaaagggtatgaatatcatattttaaaatgttctgggtagtgcctgcccttgttttaggcacctaactatttgtcatgacataccacatttcatgattaggagactggctttaggttttctgttggagagctgagagtattctcccctcattttgatagcaattagagtaactgggaccagctactcctgtcaagataaattgcattaccaacttcagcttttgtatttcatttgataattttttttttttttgagacagagtctcgctctgttgcccaggctagagtgcaatggcgtaatctcagctcactgcaacctccgcctcccgtgttcaagcgattctcctgcctcagcctcctgagtagctgggatcacaggtgcgtgccaccatgcctggctaatttttgtatttttagtagagccggggtttcaccatgttggtcaggctggtctcgaactcctgaccttgtgatccacctgccttggcctcccaaagtgctgggattgcaggcttgagccaccgcgcctgggctgattaaaatttacctaaatacttagattcttcatgccatggttgatttagtagtgttaagattgagttgctcccaagctacaattaaatagctctgatactgtctgtgttttctgtatacctattttttcttgattgtattaattctgtgtttattgagagcatatgtagtttctaaccttcattgattatgctcttagcaaagctgtctataaagtattttgtacttatagcaaagatgtcataaagagaaacttcaaatgcagaattgcgtattattttcattgaaagtgatctctactaaagaaagtttaaaaagattaaaatagtggttatccatggttcctgctgggcattatgttccatttactaatttgacattcagcagatgcttgaatatgcttcagatattaatattgtagatagaggtgatgcagttctctacactggtaagtgtatagtctaatcaacaaatcatcgtaatagagtgaggatcatgccgtggtaggagtatccctgcagttctgtggcgcttggagacctccctcctagagggatgtttttggaagaaggcagtctgagtagactacttggatgtgaactgggagatacaattgagcagtaacaattaagaaggtgatggaggaaaggaaggattttcttatttgacaatcaggaatagcatgattaaatgagtgaagagaagagagactgttgccccagtgggaatgataggatttaatagattgttgtaatgatgtaatttcattgaaatttccccaaaactgagactttgcgcagtgtttgaagatgtccttactcaaattagaagtaaaatatattgcatgtgcctgtcactttcacatccatttaagaacagtttgtccttaaactttgaatctagcagtgttccagagaagcaatgtgaatggttctcaagataacaagatcatctctgaatttctagcctcatgccaacatttatggcaggcacactcgtttcaccttcttcctaaggcagattgaaaagggaatttttatagctgaaaatcatgtaagaataccaagtgtaatctcaaggcccatcaatttggttacttcttcagtaggttccagtagtctttgcaagcaactgttgattgttaataactacactttattgatattatcagaaaagcacaacattaaggccttctagtcaagcagctttaaaaaattgtaataattactattctaccttgttttaaccttttgtagaagcacaggacaataagttccagaatcttttgaatgtcatgcggttcgtaattagctgaagacgaatgataaaagtgggctgctgtttttcagattacggccagtaattctctttggttatggctgtgctaaaattactttctgaacacattgccaaagtgtgtgaacaaaacatcatatgctagtgattcccaaatcactcttagctttcatcatatttgttctgttggtagtgtcaactgcgtgacactgcattctatacttacttttccacccctctcaaagcataaagttttggtatttaccttaacattcagtcttcctcttgtcacaaagactctttggtacttctgggttctcatactagggcaccccccacccccccccccccccccacacacacacaggggcaggctgcagtgtgcaagcatatggagcacactgtagatgacaaaagtggcatatctacctggaagataattctactgaaagatttatggagagaacattatattaagataggcagtgtagtggggtgaattataaaatactcattcaattttaatgtgaactatgaaactcctgagaaatctgtttgctcttcagggtggctagacgtctttagtctgtgtgtggggggaaggtctactatgtgccatctcttatcaatcttttctggcatttttgttatatgatagttatagctatatggtagttatagctagtctagtccttggaactaaactattttgaacttcgtttgatatagcaaatttgtgccaggggtcatctggcatgtcatgtttaggggccgtattcctcatctgtgtggaggaactagatgtggagagagaaagagaaataaatatgtttccccagctgtagtggacaggctgtttttcaggacagaattttacaacttttataaagtagttgtgagcagaagttggcagctggcaaatgtatgtatttgccaaactataaatatctggtctgcagccacaaatgtccaagaaaggctcttggaaaattaagggtttccttaggataatagtaaaaccaggctttcctcaagttgttatatttaagcataagaagcagcagttcataattggtttagttatattcatttatgttttatttcaagttgacttttaatccaaatactaaaatataacaaaagacaatttctgaggacttgaaaagtacataaaccttaagtcacatatagtagcagttaacttaaattgaaacaagaagttagaattgtatttcagttcatagagatgtactaaacatcgcggattctcagattgacagataaccactttggcctagaatacccaccacataaaatgagtatccagggaagagtaaaaatgaagagagcctcattgggatgcacttcataggaagttcaccaggctcacttgctggatagggaattggtcacgttcactccccacatatcagactggcagaatgggaagtttagattcttgtattggtcagaggatggctcgaggcatgtgggtctttgggattgtttgttaacacatcaaatgttaaaggtgtactgtttggtagtgttgagctcacttgtggttctagcagatagctagatttatttatttgcaatctccatttaccaaaatactgttgctgctcacagtaatagtaatgagtaacatcgctgagtacctaacatgtgccagatacttgaatgcttcatgtacatggttttattctcacaacagatccatgaggtattactgttattattatactctagaaatcagggaacagaggcttaatgaggctaaataaaaacttgtttaaggtgacgcaactaggaaatgacagagccagaattgtaattcacttaggtttaacttcagattgcctcctcttaatccccatgctctggtgcttctaaagagaccaacactctgccctgaataatttagtactgatgttaaacatttcagaaagacttttgaagcccttttttttttttttttttttttttttgagacggagtctgtctctgtcgcccaggctggagtgcagtgacgcgatctcggctcactgcagcctccgcctcccgggttcaggcagttctcctgcctcagcctcccaagtagctgggactacaggcgcctgccatcatgcctggctaatttttgtatttttagtagagacagggtttcaccatgttggccaggatggtcttgatctcctgacctcgtgatccgcccaccttggactcccaaagttctgggattccgggcatgagccaccacacccgactgttttttttttttttttaaacgtagtttcgctcttgtcgcccaggctggagtgcaatggcgcagtctcggctcactgcaacctc

SEQ ID NO: 58692 - DNA, 1026 bp, Homo sapiens
ataaggaattttggtttttatgtctgccactgaaagtagcttgtttaaatttgagtttaattagtagaatgacagtgttattactcatagtgtgtagtgttattaaagattctttggcatacatgcaagtttttgcttattagaagtttctagttgaaattatagcactcacaaaaagttttgaataaataagatttagaatgagtgacccctgaaaacctggtatgcaaaaggctactgggtaataatttcattaattttataccacatgtgtgatttcaccatactttttttgttccttgtggttgattctaagtgatcagcaatttttattttgaccatttaaacccatagccattagctacttaaatttgtgaaattctttgtagtgatttcagttttacaagtttgtatcttggctgatggtctaattttgaaaactttacatttggtagataccaatgtttttcttaatgtactttttcacagtccttctgattgatttcaaagtgttgtctttgaaaataaacatgactcatagcacttgggtagccagagcatgcctgtaatgaatgcctctgtacattttgaggctgtggtagaataaacatagcagttcctttcctttttgaaatggaagtttgatactagtactgaatttaaagatgaacagagcttagttttggagaaagagaaaagcacggttatatttgcaggtacacttttttctaactttcattgactatttttgagtgttaatgtgtaattattaaattaataaaagtaattttatagaagctgcaaattaccatatttcaatttatttcaggggttattcttttaataatttaggagctttaaagtatgtatctcaagcgctatataataaagagccatcggtgtagttaaacttttgagcttttaagaagttatacatataattctaaatatttgcttaattatttatttttacttagggagaatgactgcttaaaggttgagtcttcacattttggatagccaaga

SEQ ID NO: 58693 - DNA, 2561 bp, Homo sapiens
aatcccggcacctcgggaggccgaggcaggcagatcactcgcggtcaggagctggagaccagtcgggccaacacggcgaaaccccgtctccaccgaaaaaatacaaaaaccagtcaggcgtggcggcgcgcgcctgcaatcccaggcactccgcaggctgaggcaggagaatcaggcagggaggttgcagtgagccgagatggcggcagcacagtccagcctccgctcggcatcagagggagaccgtggagagagagggagagggagagggagagggagaccggggagagggcatcagagggagaccgtggagggagagggagaccggggagagggagagggagaaaagtattactcttaaggatttgtgtatggagaagggtattgaggttgtggaatagaggtaggattggtgttggaggaagggttacttaccttatggaatcggaaatttgagacaggtttctgagtgaaaataggtaaatgtggtattgtaatataataagaaatacatatttggtctctgttcctggttcctggcacacagctcttaaaacccttggactgaccaaagtactgtaataaatgtctttttgtatgctaatgagatgactggtggctggggctcctggatagcttcagggtgggggagctggttgctaggagaagcaaccaacctatctcctgggaggggaaggggaagagcctgaaggatgagttgataaccagtggccagtgatttaatcagtcatgtctacataatgaagcctctatacaaacccaaaggatagagtctggagagcttccagatggatgagcaagaacacatccaagtgcagcgattgggggtacatcccaggtacaggagatcagaaactcttgctcttaggacccttccagaccttccccatgtgtctcttcgtctggctattcatttgtatcctttaaaatattagtattggctgggcacagtggctcacacctgtaatcccagcactttgggaggccgaggtgggtggatcacctgaggtcaggagttcgagaccatccttgccaacatggggaaaccccgtctctactaaaaatacaaaaattagctgtgcatggtggtgggcgcctgtaatcccagctacttaggaggctgaggcaggagaatcacttgaacccagtaggtggaggttgcagtgagccgagattgtgccattgcactccagcctgggcgacagaatgagactccatctcaaaaaaaaaaaaaaatctttctaataaatgggtaaacataagtaaagtgttttcctgagttctgtgagctgctctagcaaattaaactctggggagagcttatgggaaccctgatttagagctattgggccagaagcacaggtcacaacctggggcatgagattggcattagaagttggggtggtcttctgggactgatcccttaacctatgggatgtgatgttatttccacatagtgtcagaattgagttaaatcataactcacttagtgtctgccagagaatctggtgtcaggagtgtgttgtgtgagagtagaaaaaacactgtttttttccccatctttaataataaaatatgctataaggtgtagtagagcattatcccttattaggaagagtttataattagttatttttgttgttatggctgaaccagacctttgctttgttctcagaaaatatctagcaaagttacacattttctttggttcaataagtgttgtttgttgatctagttgtatatttaaaaatagtgttaaaaataaaatatgtgcttattacacataaaattgacaaactgaaaaagtagaaggaacaagttaatcaacaaatatttattatcttcacaaatatttattattaccaccaggcactgttctctgccctggggaaatggtgttaaacaagtcatgtacccagggggcttacattctggtagctgaatggaggagaaggatgtaccaataagtctgttattctcagtaagtgtgaaaaagataaaatgtgtagtgagaaaagatgggtggtgaaggcaaggcctaacttggttggggtggtcacggaaggcttcttagggagggacgtttgagttgctctgaaagatgaggaggcagtcattggagagcagggaaaagagtactctaagcagaagaggtccaaaggccttgcaatgaaaatgagcttgctttgttcaagggacagaaagtaggaagaaaatagtgtccgtagcaaaaccataggacacatactgagtctttgtagatgtatactttggcttgtatttttagaatttgtattctgctgttttaatatttgcttcataatataaacattcttcatttcataccttagtaaacatttttagtgttgacacaattaattttgtaaatgtatcgtggttgacttacccattccccaatagtttggcatttagatccctcctcccccccttttttttgcattattgtaagtattacagtgagcactttggatataaaacttttttgcttcttacggttggtcctcagaaggcaaaatata

SEQ ID NO: 58694 - DNA, 1991 bp, Homo sapiens
ctttaaccttttgccctcctattgtgggccagaaagtaggccttctctctctccactggtgccatcaaactcctctgaactctggctcatgtctttcctttacctgcatgtaacgcaatgtaatttagtatagagtagaatcctttggaatttttttaaaggtgattcctggtagttgctggtataaaggtggttaaaaacagaaaacctaaagcacagagatagtgttctcatttaagtgttttaagtagaacatgaaactttctaagttgagtttttgtagagtgatcactgagaattcatctatatttcagaggaaaacaagaaagactggtaggtaggcacttgatagatttgtggaatgggtggagacagttctgagcacctgtctaggatcagtgaactacgtattagtgaatatgaagcagaagttgatagtaggaacagagaggtgattatcttcccctttttttctgtgctgtactatcttggagaggtgaggagaaaaaggttccaaattggccactagatgattgaaagaagtccctgtggccaattttgtatctggatgaccattcttttttaagtgagatgcgtgaacctttcatataaagagctgctggcaggatattgttttattaggttttagggatattggcccatggttcactttttctttctccccagtttttggaaaagttgattgctagtaaggctgattgctttcagggaattgtcattttcctccgggggatgtttggatgagaatggagaccagtttggcaagggcaacagctgttgaacaatctgtttgggattaggtgcaagttggtatgtagtggaaatctgcctcctggttcctgaaattatgttcctttgcctcaaggataaatgttttcctgctcattccagttacattcacttagttctggctggtaatgcttctgactgataactttcctcttttaagagagcttccttgaaagaataattgatagctacgatgaacaattaaaaatgttatgccttcccttaagattttgctcaggatttaatcataggttggtggtaacagaacctttcagttcaaaattagctgtatattatctaaccattttggtaaggggagagacttaaggtgctttctgatggtttagatggcagtatcacatgagatttattcatattgtgtgttggaatgtaaattctaatgacctttggaagcattagtagtaaaatttacttagctggctattcctaagcttactagtgagttggagttgcatgcgtgaatcatacctctgaccagttgtgatgatacaaattaagttgagtttaaggaagagactaaattaattgccatcctgtcaccacactgtccacttagcactgtacagctaagatcctttcagttttttaaaaaatacttttttaataccacagatataagaacctgcaatgggtgcttttaatttgggtttatgctgacctttatgtatcagataatgtgtctaaatcctgagccaggatcctagtaaccccaatttctatctaagcatagtctaaaagctgtcactcagtactagaacgtcttttgtggtatgaaaggataatgtatagggcctggaagtacacttacatatttgcttatttggttaggttgttattttgtgaatagaatttaaattcacttttagaagtaatgtcatagttgtcagtggacatgtatatttcaactaactataaggaagacagatggaaatgtccttttctttttcgtgtctgataatgcatttgcatttgttgatctgaggtcagcacttaagttggacatcttcaaatctttttttttttttaattgagatggagccttgctgtgttgccccggctggagtgcagtggcatgatcttggctcactgcaacctctgcctcccaggttcaagcgattctcctgcctcaacctcccgagtagctgggattacaggtgcct

SEQ ID NO: 58695 - DNA, 1983 bp, Homo sapiens
ctctagtcagtttgcttttcatatctgttcacagttgcaccatcttttttttttttttttgagacggagtttcgctcttgttgcccaggttggagtgcaatgacgcgatctccactcaccacaacctccgcctcccaggttcaagcagttctctgcttcagcctcccgagtagctgggattacaggcatgcaccaccacgcccggctatttttgtatttttagtagagatggggtttttccatgttgaggctggtctcgaactcctgacctcaggtgatctgcccaccttggcctcccaaagtgctgggattccaggcgtgagccactgtgcccggcctagttgcaccatcttttaaaaaaatgttcttcttttatttttgtgcatttatatatgtgtgattatacttgatacattttttgccttgttcatttgatatgttttgcattttctatgttttttaaaaacttagaattttattagttgcatatttcactgtaatttacttacttcctttaaaatggctatttatgtggtttacagggattttgtgtaatgaataatgctttcatgaacccaaaggtttttttcccctcctaattgcagactaattccttaagatggatttccagaaatagtattagatccctgaaggaatagaaacgattttaaaagctcttgaatcttattgccaaaatgctttccaaaagtgttgtaccagttttcatgccagccagcaaatatatggagtgtccatttcacctcagccagcaataggagggaatgttttgatgctgacctttaaatctaagaagaattgatttacagctctgctgagcttctatcctgaattacacccagaattataatcgtggttgagattggattagaaagaaggaaagcctggtttaccagtttctgccccttcagctgcttatattctgttttgcccagttaaggtgaattcttttggaaacatgaagtaactgcccttttctgcttttcagcccccttaattattttgataagttggtgggggacaaaacagtgtatgtttataagttggtaggggacaaaacagtgtatgtttcacatgacatttcccttgagagctggggtaggtttggctctcttctccactccaccactgggcttggtgtgtctggaggcgtctgaaagttacattcagtagccaccttgtccaggggtgctaattagatgtagcctgagtcactgctacttctttagctaggaaatcattaacaactctggaggtaaagtagcttttccctaagaacttgttagataatttagtattaagtatggaaaattttctccctgaatagaaggagggtcaggggacaccattcctactgaaagttgataacagggaggtcttatctggtctcctctggcctcataacagcactcagcacagttgaccattctggcctcgagccactttgcagtgattttaagctcccttggttctctccttatctcattggctgtatcttgttcctttcctcccttttcattttcttctccccatcagtcttcccctcctccacaatgttactccctgggctttacaacctgtgtgctgcttattcctagatttattttttacctggctcttgctcctgagccctagataaataagctggcatcttaattctctttgtataactaataggcactttaaataccacgtgtccaaatcagggtgttgtgatattttcatacaagtttatacttaggtgtttcagtaacatttttcccaaagtttcagacataaaaataacgcagggggctaaattataaataatatcaatttaagacacattgtattaaaactgtctttctcattttgtaaactgtagagcccataatttttcttttgataggccagaagaaagtttacctatttccttcccaatgactgagaacaaaaattctcactagaggattttatttgtgtgtt

SEQ ID NO: 58696 - DNA, 2373 bp, Homo sapiens
ttttgagagatggtgtcttgctctgtcactcaggctggagtgtagtggtgcgatctcagctcaccgcaacctccgccttccaagttcaagtgattctcttgcctcagcttcccaagtagctgggactacaggcgtgtgccaccacgtccagccaatttttttttttttttatagtagagacagtttcactatatgttggtcaggctggtctcaaactcctgacctcaggtgatccatgcgcctcccaaagtgctgggattacaggcatgagccaaagtccctggcctttgtacagatttgttttgcatacttctcagccttggtggggttaattgtggcttggcaaatcaagaaaaggagttctgtgctgttttcagactgcagaatcttgttgctatgcaacaaaaattgtcagtcagtatagggtatagtaaattggtattctctgtcccttttcaccacatgctcattttgtaatctgagagaagtggtttggggctagtttgcaaggttttattttaaaacaagcatttaaaaaattttgttgctatttgtaattggttatatttaaggtcggtgaagtctttctgtacttactagaagatacaataaaatgctagtgttcaaagggtttatagatctgtttccaagttgtttcaggttagagcagtgtatttttgttttgttgctgtaacaggggtaatattgccaacttccaaagagtaaattttagcttgagaattcaagttgtataatttgaacatcagaagtttattgtaagcacatcatattatttttaaatttatttatgaaaaacatgaacccaaaaaacccttttattgataaagttttttaaataggaaccctaaacttgtatgaagtctcatgtatgataatttattttctgccaggagaaattaaaatgcctttatagcaaatgggtgatggctaatagccttctaaaaattgtgataaaatatatataacacaaaatttacaattttaaccatttcgagtgtttcacatagttgtgcaaatatcaactgttcatctcctggataacaaccttttgcatcccatttagtaacttagtccagactgtcttctaaatcctttaattcgtttaatcttcgtaagaaccctatatgtacgagaagtacttttgttccaaatgagaagagtgaggcacaaaaaggaacacaaaagtagtaattagtggagccggaattcaaacaccaacagtccaactcttctgtgctctcaactattatgctatgttaccctcttttggaattactttcttttttgtttagtggttaagagcattgatttaaaaaaaaaattactttctgtagcttttccaagtaaagttaatacagtttaacagcattttggactgttaacaaatttagtttggctataaatccctgcaatcttctagacattttttttctaaatatttcaaaaggatgcagtttatgttattttatattgtgttatttgtatatgaaattatacatattatggttaattatatagaaaggacttactttcctttttcagtttgtttctggaccatttttcatgccattccttccaatagagaatgcaaatcattttctggtcatttaatgtaaataggaaggtacacttgctgttagagaattttaatatgatgccatccaaagactaaagccagttggcattggatcatccacttagtattctctaaatttatgatcttctttttcacgaataatctggagttaattgtagtattggcagtttagaataaagagcaatagggaggagtaaaaagggagaaaaacattgcaaggagtcattaacttccaattgatgaatagggatgagtttttgcagactctgctttttttctgccatgtaatatctctactaccattcttaagcatccttaaggagcttactttcctttgattttttttccccaccttctacttttttttttttttctgggacagtgtctcactctgttgcccaggctggagtgcagtggcatgatctcggctcactgcaacctccgcttcccagattcaagcaattctcctacctcagcctcccgagtagctgggattacaggtgcactccactaccacctggctgatttttgcatttttagtagaggtggggtttcaccatgttggccaggctggtcacgaattcctgacctcaaatgatccacctgccttggcctcccaaagtgctgggattataggcgtgagccacagcgcccagcctttccctgccttcttttctttcttccgagatggagtcttgctctgtcacccaggctgaagtgcagtggcgtgatctcggctcactgcaacctctgcc

SEQ ID NO: 58697 - DNA, 1087 bp, Homo sapiens
aggcaagaattgatgttgcatcttgagtctgaaatttgcagagcaagtcagtaagctggaaactcaaaacaggaggatttctgtattacagttttgaggcagaattgctttctctggcttgggtttgctggcagtctttggcattcctgggcttctaggtccatcacttcagtctcatgcttctgcagtcacatggctgtcttttcctgtctgtcttcagttgatgttttcttcctcttataaagacaccagccatattggattaaggggtccactctactctggtgtgacctcatcttaactaattacatctgcaaagaccctgcttgtaaaagaggtcacattgtgatatactgagggttaggacttcaacatcaacttcttgcctgagtttcctctttgagtatggaccacagtggtctcattcatctctctcattagtcagatgaactaattgtctcaggtgacagatacagagggagacatgcatgtacacaataaaaataaatatatgcaaagattccacagtaaagcagctggagctaatgaacgacttcagcaaagttgcagggtacaagatcgtcacacaaaaatcagttatttctatacacctacgataaacaactgaaaaaaattaaaccagtttcaggctaggtgtggtggcttgtgcctataattcccagcaatttgggaggctatgatgggaggatcacttgaggccaggaatttgagaccagcctgggcaacatagactgtttctttaaaaataaattttatataaaaacaatttcacttacagtagcatctaaagaaataaacacctaggaataaatttaaccaaggaagtaaaagacttgtacactgaaactataaaatattgttgaaagaaaagacttcaataaataaaaagactttgtcttcataaatttgatattgacttgataattgttaagatgtgatagttgataagacttgatattgttaaggtgacagtactacttaaattgatatgcagacacaacgtaatccttatcaaaatcccaatggcgttttttgcaaaaataattcatatggaatttcaagggac

SEQ ID NO: 58698 - DNA, 5579 bp, Homo sapiens
agcgatcctcccatctcagcctcctgagtagctgagactacagatgtgcgccaccacaccctctaattgttaagatttttgtgcagagacaaggtctcgctatgttgcccaggctggtcttgaactcctggcctcaagtcatcctcccacttcagcctcccaaagcactcggattacaggcatgagctgctgtgtccagccagtaattcttgttcctaactatatagctacataactttaagtgactgcataatattccattgctttggatggatgactttgtctacttaaatcttaaagatggacttttagatttgttccattatttttgttattataaaaaacactgctgtgaacatctttggttatatgtctttgtgtacatatctgatactgttttaggatacattcctagaagtaaaatcaagaagtagtgctgtgttttgtttttttttttattttttgtttctttacctttctgtatccagtctatcattgtcctaccaggtcaccttcacttgcttctgtccatctcactgcctcaagtccaggccactgttatctcttacctgaactattagtgtttcctcatttccattcatgtcccctgttcttcatgcatcactcagaatactcttaaagtggaaatcagatattgttatttcccatgtaaagccttcagcggcatcttagactaaaacccaaatttgtcataaaaccaaaattattaaggtcttgcgtgacctggctctgcattccaagttcccagcacaggcctctgtgagtatgcataagtatttgagtgaataataaacaaaatgactaaagggagttgtatcagtttttgatacacgttaccagataagcaagagtagatgagatttctagttaccccacattctggccagctcaggccattatcggtcttttaatctttgccaatgtgataggtaaaaggtgttacctcattggtttaatttgtatttctttgattacctgtagggtctctttgtttgtttattggacagctttatttttgtgtggatgtctgttcatgtgctttttctgttttcccaatgagatgtgtagtttttcttctaatgatttataataatgaggatattaactcttcatagtgcatatacatatatcgtatccgatattactgctgtttaacaaagcatctcaaagcctagtaaagctgttacccgggctggagtgcagtggtacaatcatagcttactgcaacctcgaactcctgggctcaagtgatcctcccacctcagcttcctgagtagctgagactgcagatgtgctacggattggctgggcagctcttcttacctggactcattcgtgtgttttccttcacttaggttcatctggtgtgtctatcccatccctctgcctcatcgctcacttaacaatagcagcctcctcatgacaacatgccctagtatgaaagctcttaccagacctcagcttgcatcctgtttgcttatgtttctttggccaaaacaagtcatatggtcaagcccaaagtcagtgggggaggtgattacacaaggacagatcaagaggtgcgattcattggtggtcataatgtaaactttactatatgtatcttctttttttttttttttttcctgagatggagtctcactctttctcacccaggctggagtgtgtgcagtcatgcgatttcggctcactgcaacctctgcctcctgggttcaaacagtcctcccatttcagtctcctgagtagctaggattacaggtgtgcgtcaccatgcctggctaatttttttgtatttgttcttatttttatttttgagatggagtcttgctgtgtcccccaggccggagtgcagtggtgcagtcttggctcactgcaacctctgcttcccgggttcaagtgattctcctgcctcagcctcccaagtagctggaattacagatgcacgagaccacgcccaggtaatttttgtatttttagtagagacagggtttcaccatgttggccgggctggtcttgaactcctgacctcaggtgatctgcctgcctcggcctcccaaagtgctgggattacaggtgtgagccacggcgtccagctttttttgtgtttttagtagagatggggtttcatcatgttggccaggctggtctcgaactccggacctcacgtgatctgcccgcctcagcctcctaaagtgctaggattacaaacatgagccaccatgttcagccttgtatcttcggtaatactgagttttccattctttttttcatctgtatattaagatttaaaattttatctttagtgaagtgtgcggcaactcattggttttttttaattaaaaacttttttttttttttttttttagagatggagtcttgctgtgttgctcaagttagtcttcaactcttggccttgagtgatctgtttgccttgacctcccaaagtgctgggattactgaaccacagtgcttggcttagtttctagtttaatgggttcgacatggtacctttaaaaaaacatgtttagaaggaaaatgcataattttttactatatagacatcatataaaagcatatataatatgcttttagctttcttttttatcgttaagtacatttgttctcatttttctttgtcttaattttatttaaaatgtgtgtacttgtatttggccgggcgcggtggctcatgcctgtaatcccagcactttgggaggctgaggcgggtggatcacgaggtcaggatattgagaccatcctggctaacacggtgaaaccctgtctctactaaaaatacaaaaaattagtcaggcgtggtggcgggcgcctgtagtcccagctactcgggaggcggagcttgcagtgagccgagatcgcgccattgcactccagcctgggcaacagaacgagactctgtctcaaaaaaaaaaaaaaaaaaaagtatgtacttgtatttaaaccataaagcttgtgtttttaaaaatgtttttcctttgctaattaacttaatttcagtgttggcatttatattcttcagttttcttagagtttaaaaaaaatgtaatcgctgttattgagtacttactgtatgaaacctttattaactcatttaacactgatagaactgttatctccattttatagatgaggaaattaagccacagagagttaagtgacttgcccagggtcacccagttagtagagagtggaactgggattccatctcaggcagtcaggttccagagcccatggtttttaaccagtaagctctcatacataactgtttgtaatggttaacttttgaactgaagcttatatttgaattttccaaatgttaatgtgtgagtgagtaatttatttttccttgtgatttcattgtttagggggtctttactttctgaaaataattggcgtaagaacaagatcttgtaggatgaattgacctagaacatttcagagataatagtacatagttggggtggggagaaaaggctttatttgggtttaatcttgaaaaatgaaacaaaactatgaaaacattcatgttatggttgcaactatgtgttaaattattagaatgaaagaagaatgaatcaagtgttggttgcttaaaaaattttacataatttttctgagaaaattgtaagatcacatgaaactatccatgttatgatggacttttgcagtatgatcataaagacagtcctttttgccaaaatattcaagggcttcattagttttcctaactttgattttcagattttcttttgacctcctggtaatctcatctttgttagttctccagttattaatttacaatctgttaaaatgctttcagctccaagtaactgtttaagacttaaagtgcttaaatattgagaaaatttatcccatataattagaggtccagaggtaaggtagactccacacatactacagtcagtgggtcactgatgtctttgaggacacgggtacattttgccatctttggtgttcagtcatctttatattggtaacaagtggaccatagggcttccaggattcacattgagacccagtaattcttggaggaagtaggaccatccttcttgtgtgtgtgtgtgtgtgtgtgtgtgtgtgtgtgtgtgtttaatcccgccatagtccattttgtgctgctataacagataccacagactgggtaatttataaaggaaagagatttatgtggttcacagttcggaggctgagaagtccaagatcaaggggttgcatctggtgagggccttcttgctgtctcataacatggtggaaggcatctcagagcaagatggtgtatgctcaaaacagaaaaaaggggttgaattcctgtggtaactaacccactcccatcataatgttattaatcgattgatgggggtggaatgcccatggccgaatcacttcttagtactgttacagttaaatttcaacatgagtttcaagattcaaaccatagcagctctcttaaggtatcatttacatacagctaaatgcataaatcatgtatacatatagcttggtacatttttactatgtatacatacctgtgtagccaccaaccaggtctggatatagaacacacttaggccattaagttccctcatgccccttcccagtcagtatctttccaaatactcatttttttcagttgctttgtaaagagttttcatcattttcagtgacttcataaaggcctacatcttttggaatgtttgcactttcactttgtagatgatatgcattgtgttgctttgtaattgaaataacctgtcaatcattgagagactgacagggcaaaggtgaaatggcctgacatagaggctaatgctgctttgggagggatgtttaatggggactgatattataaatgtttagttcattagcggatatttttgtgttaagaatacttttgcttccctggcaacttctgtgtctgataatgaactttgattttaagacccttgtacctattttgttctgtattacatttttacatatatgtcgttatagattctctaatttattgcattggtctattattcctatgcaatctgttagctgtgagccgttagatctttatgaaatttagatttgatcagctcagccttgagtctgaactacttcagtgccttcccattgctcttggaattaagaccaagctccactaagctcctcctcattatggcctaagtcctgcacaattttactttctcagtgattccaaagtaagtaaaatgacccaataagaaaaatcctcaacaataacttacaaaaaagtaaaaatgtgcataggtatgacccattgccttagacttacagtttagtgggggaggagacattaattttcaagagctggcagagcatagtggctcatgcctataatcccagcagtttgggaggccgaggtgggtggatcagttgagcccaagagttcaagaccagcttaggcaacatggtctatctctacaaaaaatacaaaaaataatattagctgggtgtggtggtgcacacctgtagtcctagctatactcaggaga

SEQ ID NO: 58699 - DNA, 4212 bp, Homo sapiens
gaggctgtacttcagtggatgcttcttcagataagggtttacgaaattttcctgactagaaacaagaaggggactccttgtcagacctgggatatagtccttgacttgcccctaacatgctcccccaacccccttgtcccccactattcctgtgtgttccagtgcactttacatgtttttttgctattgaatttattctgtcttataattatgtggttctttttgtccctcttcattgtaagttccttgaagaggatttttatattcatggtactagcaaaatactagcatttttatattcatggtactagcaaaatacttggcaaatagtgggtggcctgtgtaagtgtttgactttgactgcgttgctcttttatagaatctgttcactagcaaccccatttttggaatacctgtagtgttctagaagctctactggatattgtagggtgtagtgtagtatttggtggatactaaatgttaataacataatttaattaagcaagcaaaaactcacatcctgactccaggaataggtgtagaatttggttttcttttgttcttttttaaattttaatttaatttttattttgtagagatgtggtcttgctatgtggaccaggcaggttttgaactcacctggccagaatttatttcttattctaacacagagcttggaagtggctacaagtgtcaggattgtctaaattctaagccctttggaggataccatgtttacttgactttatgattaaattctgaattactgaaagggccatcaatctgtttttaagtctctttgaccaaagaacttgtaaatattttcaagtaacaagcatatgcatctctattggtttaatttatttttaccccatttagtgcttgctttgttttgattctttttttgtttttgttttttgagatggagtctcactcttgcccaggctggagtgcagtggcatgatctccactcactgcagcttccgcctcctgggttcaagcaattctctagcctcagcctcccgagtagctgagactacaggcgcgtgccaccacgcccagctaattttttgtatttttagtagagatggggtttcaacatgttagccaggatggtcttgatctcctgacctcgtgatgcgcccacctcagcctcccaaagtgctgggattataggcgtgagtcaccgcccccagccctgctttgttttgattcttatcagtgcttcaaataccaatcactgggtagtgtatgatactcttgaagtattagtgtgggctgccataacaaaataccatagactgggtggcttaaacaacagaaaattattttttatttttatttattaatttttttgagacagtctcactgtgtcgcccaggctggattgcagcggctcgatctcaggttactgcaagctctgcctcccgggttcacaccattctcctgcctcagcctcctgagcaggtgggaccacaggcgcctgccaccacgcctggctaatttttttgtattttttagttgagatggggtttcactgtgttagccaggatggtcttgatctcctgacctcgtgggattacaggtgggagccacagcgcccggcctagacatttattttaaggttctggaggctggaagtcagagatcaggttgccagtatggatgggttttggtgagggttctcttcctggcttgcagaagatatccttctctctgtgtcctcacatggtagggtgggtatgggaatcctggggtcggggagatgaggggggatttctctctcctcctcatttcataaggccattaatcctattgaattagggccctgtgcttataacttaatttaacattagttacctcctaaaagccctttttccaaatagagtcacattgagggttagggtattaacatataaattttaggggaacacagttcagtctatagcagaagataactacattttttttttttgtcagtgcatacaactttggaagaaaataatttgtttaatatttaggtgaactttagataagttttgttttaagtaaccagaagttgtttactaaagaagataaattaggggggttgattgatttatacaagatatccgttaaattttctagaaatctctttacactgggaaccttctattttacaatgattaaagtaagttttattaacaggcaacttttccaaagactactttgggtatgaggcaatgtatgtatatctaagtgtagagattgaatggtgtagggtaaagaggacaggctttgaagttaactctgggtttgactctagtttgacatttactaaataatttatttttgagtgggttataaacattttttgggatcgaatatactttgtgaattatagagctgttgagaaaattaaataaaattctggcataacacttggcacacaaaatgagcttgataagagtaaatcccccacttttatgaaagtctgacatctcttaagtttatgttaagaatgtgaaaaaccatgtaagatggtgcagctgctttagaaaacagtttggcagttcctcaaaagttaaacatagagttatcgtatgacccagcaattcctttcctagaaatgaaaacatttgtccacagaaaaacttgtacacaaatgtctatagtatcgttattcataacagccaaaaagcagaaataacccaggtgtgtctgatttcatgaatagatcatcaaaatgtggtatgtccatacaacagaataatatttggccatcaaaaggaatggaattctgatacatgccacagcgtagatggaagcattatgctaagtgaaataagccagacacaaaaggcgatatatgccatgattccatttatatgaaatgcccagaatagacagatctatataataacaccagaagatctcatttgctttttacgtgagttgtttctgacatttttattactttggattaatattttgaattgacatcttcgtgctatttaaagaagagagattgaagatagaaccactggacatttctctgtagggaaacaagcacgtgggaatgctgaggtggaaaccttggtagtggtggctttgaaaggcctgaacaaattttggagctgtatcttcgtgctaaggagacagccagccatctctttggtaggcctgttgtaagtaaggatgactaaagtcaccagtaaaatgtgatgaagcaaatccatcagaatcttcagaaaacttaaatctgggtggtgattttctggggtttgtttacagtagtctcaaataccaaaagttttgtctttggggaatgaggtaatcatgatatttttaaataaactgagcccttttccagtggtaaaggccttatagaacatctggtcttggtaagaatacatctgatgatgtgaaatcaaaatgactacctttaactgtgccttagaggtcctcagtcttctgtcctttttggtatctgttacatttgcaacttggcagcgggggagctttatgaagaaccaagaacttaagtaaaataaaatgaatagctcttgaggtcaaatctcaagggagtccaaattgctccttttacagttcagtgaagggatctttttatgcagtcttaataattattatatactggttatttgaatatctgctttgttctgcagtctttctcctcctcccccaaattctcatgttagactgatattgcaagcaaaattgtgaccgttcagtttttaacaatttaagatttatgtatcttaagttttcatttaaaacttttacttacagtctacttaattgtggtctttgcacaatttttttagaattatttttagaaaaataaatcaattactgttgtccatatgtctggtcagtatttttttaaattacttttttccttccattgtaaagtagtacagattttgaacagattttagaaggtatggaaagtataaaacatttatttatgaaatgttaaatccaagccatctagtattttaatattttaatgtgtagatttctaaactttttgtagtgcatttgcagcattgcagatcattgtgcgtgtgcatatgattatatataaaagtaagattatactatttaaaaatggaattatactatatttgtattgtgtattttgtagcttgtccctttccatatatataatatctatactttttacattttattatttttattttttaaata

SEQ ID NO: 58700 - DNA, 4722 bp, Homo sapiens
cgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgaggtgaggggcgcgcggggcgggggccgggcgggccattgtgccgcgggagccgcgacccccgttctcctcggaccccgccttccctctcccggcccggcgcgtctcccctggtctccggtctgttcctcccccctccgccttttgtcccttccaatttctctttctttcttggaaacctccccaacccgtgtggtttgggggtctcgcttcatcgttctctcatttttcctcaaatgctcttctttcacccaggatttcccttcctaaatttaatttgcgcctggctccctcccccaagcctttgcaagcgaaacccgggagatggggaggggttcgagaatcgaagcgtgcgtgttgctgggaaacaggtattttttcgtatatatgtaaaaatttcatgcacttttgcctccgaactctcgtgtttaattaaaaaaggaagaaaagtttgaaaggtctgaaatctctgcgggtaataaagtgcctctggtaggggtaggtgaaggagctgtgaaaggtgaaatttcacgatggtgggggaagggaaagaattgattaggttcacgtggtgggggcagtaaaagactgggataagtaagttggtaggggtgtgtaagcgggggcggggaagggatctgtttggaaaagccttttctcccctttctctgtagcagcctgtgttgcattgcagcagctgctttttccctttgctctgtactcaataaaacaggagctaaattatttttgcggccccgaagaattgaatgtactgtcgtaaaatatttttttaattgatacgatgaaacatatggtatgatatttttctttattgtttctcaaattgtgtaggagaataaaccgtgatgtggtgtgtcattcattggagattttttttccagcctttcctaaacctgttctgtgtccataaccttctcttttcggattggtgcaagacttcgtgtgaaatgggacttggtagactgaaggctgatccattctgcgttatcatccttaaaggccttccttttgggttaaacaattgtggataaagtaaattactccatttctctctcctggaagagatagtcttacagttcatttggatttgaatctcctttgtgttaaagattaatggccaaccgttgctaagacctttataatgtaatacaatgagatttgaatgatataatctacaaattccttcgctttggcaagaaaatgtcatgtcattggaattctttctcaatttcggtagtttccattttaaactttgcttttcattttttttttctatcaaggttaaacgtgtttccattttgcttttatatatatattgtgatatatctttgttgaatttttacttaggcttactgtgaatttgaatttttttttctgattccaagttacctgtatttatgatggccttaaagagtgagtttaatgtggtgtctctaggcgactgaccccttttcccttgatgatttcacacaagttattttcaaatataagcgatgagtttaaatagtaattatagcatacgaaccaaaaaacacaatctttgtaaaatatggcttgaaaactttgagtcgtatgtttgagcatgacttctttttttttaaatcaagttactgatgtccttaaactcaggaactataatatacatactgttatatcttgtaatattatatgttgttggtttctgttttagagatctaatgccgtagggatcttgcagaccagaagttatcagttgtttcaaactttgggtaaacttatcttaacattgagaaatataaaacagggaaagttttttttttttttttttttttttttttttaaatgcagtcttgctctcttgcccaggctggagtgcagtggcgcggtctcggctcactgcaacctccgcctcctgggttcaagcgattctcctgcctcagcctcccaagtagctgggattacaggcgggtatcaccacgcccggctaattttttgtatttttagtagagacggggtttcaccatgttagccaggatggtctccaactccggacctcgtgatccaccagcttcggcctcccaaagtgctgggattacaggcgtgagccacggtgcctggccgaaagtgggttatttttaaataaaaacaggaatagttgtctaattcaaagattgtgaactaaaaaaaagttaccgttttgggtattcagtgaagtttaatcactgtcatgtatagatgtcagtctgtcacaggtaaattatgtcttcacttgaaaattccttttctaataaaaagtaacttctgtttttcaagctcttttcttgctctgttccttatgaagtgtagagagagaggaaccacgctgatgttttccagtaacgtaaatatagaacttggtacacaggtctgaaaagtttatttaagcagtctacagtaattcttcgtaggctaattttgaataagagcaggaaagagggtcagcttttcactttggaaggtactggattatttggcaggtggttaggtagtacttagatttgcttagatacctgtaaaagtgagattggtatgggataaaacgttcttgtgctgcttgcaaaagtctttggaatattctttgggatattttggtgcttaggaagtgcttttcaggttatattaatatatgcttagtcttcatgctttcaagtcctgtgggacgttaatgttagtcttttaagttgagtcctttttggttatattaagaggtagttctgatgtttcaaaggccatccagaaataggaatgcctgaacaggaatttccaattaagtcggtcagaatcctgaacagaggatatgatgaatatattacggtataactattagtggtatctgtcagatgactttaattttaggaatagcatgatcactgtgtataatcttatacagaagagaactgaataatagtttatgttcctgaaacggtcataggcatttgagtaaaatgcagtatatagatttacttgttaatattttgcttaaagatgaatatttaaaaaatgaaaaagcatattacttatacaggacagtggaaaggttgagaccaaaaagctggtacttttagtgtcctgtctgtttagttctattcttatttttcatttatgcaatgtttcaaaagtgtaagatgctttgtgattaaagtgtgcgtgtatgtatgtgaatgcgtttgtatgcatgtacatacagtgtgtgccttttaagtgcatttttaaaattagttggtttgttacttaagatttttttttttttttaactgaaagaggagcttgtctgatctaaaatagttgcatgtagcctggtggctaaggagagctcagaagattttgtatttacattcttggatccgtattaaaatagtccaggcttccactagctactctgactttctcatataaaaaggtatagtagggttatgaggatttgtccaagccatttactagctgggtgaccttgaagtaatcacattatttcactgatgcctttttaaaaaatatgtaaaaatagagataattcttaactgagtagtgaggatcaaatgataatagaaggtactttatacactggtaagccttaaatttatgttactcctcctgtttccaggcctatttctatgttagactatttgggtaaaacttctgggcagtgggctccaccttgcgaccttatttagctcaaggatgtcaaaaagaccacatttttattattttataggtgaggaagctgttcccttcttctgtgtttccttccttagggtctttgaagtatctttatttgtggtaatcataaattttatatacatttcagagtgtggtacaatcaagggtcagaagatccaggttttatatgctgacctgttaattgagtaaactggtaaaaaaaaaaaaaaaaaaggagataatcttatatttcacaggattgttttgtgaagtgtcaagtgagatatccatgaaaggatacaaatagtagtctctttgttcccatgggtcttcatttatactcgtagctgttggatgtgtgactttcccacagaggtttattttaggagcaagagccaaatcttcattttttgaatgtcagtattgtaggaatttactaagtgaataaatcttgaagaagagtgtggattaatagagaaaattcactaaagtttattcagtattcaaggtgttggataccttgttggcccagttggattaagcaaaataactatggaggcaccatttggctggtatagaagaaattacatactgaataggttttggtgatttatcttacagaaggcttaaaacaggtgattgtataacttgtaaaatatctagtctgtatcatgag

SEQ ID NO: 58701 - DNA, 1019 bp, Homo sapiens
accacgcctggctaattttttgtatttttagtaaagacgggttttcaccgtgttagccaggatgatctcaatctcctgacctcgtgatccactcacctcggcctcccaaaatgctgggattacaggcatgagccaccgcacccggcgccagtgtgtttttaaaggtgttctgagaatgtctagcattctttttattaacgttctaattagattcagagagtagctaagggatactgtaccccaaaagtaacctgatgctatatttagctttggttgtctgcaaagcaatttgccataaaagtcttactctaggatgagatgtaccaaaatctttgacaataactcatctatttcttcatttatattcttgtgaaaaacttttttttaggacttgctcatttaaaatttatcaccaatgagggtgcttatatttcagggaaaggccctgaatagaaaaccactatcctagcttcccattcaggttttcttgtctaactcaggtggcattttatatctgtcaacatctcataattagtctttaaatagctcctgttttgtgtgtttttttgtaatgttcactgaggaactcattgtacttgattttattcagtgtctctcacttgcaaataatatttcccttcaaaagttcacagtctggtcttttccttcttatttttcactttattttctctcctcctactagtgagatggtgattcttgatttgctttatttgagttatttatatcttccggcctctgtttaatatcaagtctggcgtggcattcttttcctactgaatgatgcccaaattaagttaagaagcaattcctaagaaagctggcctgtgattcttcatggtcttctggtatcccaagcactggacagtctgtttaattttgaaagttgatgtaactagctaagttaatagtttatgtcaggtttgattcaagagttgctttccagagtaactctgttccaaaactagatgaggagatagaatagggaaggaagaattaaa

SEQ ID NO: 58702 - DNA, 1077 bp, Homo sapiens
ctggaaacttccccagtcactccgtctagttgcctcattttgttgggccttggtttctttcagtttcctactaaaacttacctctttggggaggcatgagtatcaatgcttggctaccaatccaggtaaggcctctgaatgaaaggtgatatggaagggcacaaacgatctggatacctatcccctgggaaagtccaggcctcaggccacagcaatgccacagcttctggaagctgcctgggaactgaggttttattctcctgtgtgtgtctacatgcctggagtgttgactctggagacctatgaatacagtaaatgacatcataggtagctcaggtcaatgaagatttatttttagctatgacccttgtctgttaaatgatctgaatttaaaaagaaagaggacacggaagaaggaaaagaaatgtgaaaggcaatgaaagaatgtaagattcctgcttgatcttaaaaagcactagagcaaaagtcaagcacagctttcttatttcttttcaaccagaagggtgttacaggagaaatgtatgaagggcggaggatatgccctcttgtgagaattctgtctcttccctgcagttactcattttgagaatgtggctcccagtgtctacagtggaggtgggctcatttgtccctgggcttcttttttattttatttattttttgagataaaatctctctctgtagcccaggttagagtgcagtggcgccatcttggctcactgaaacctccgcttcccgggttcaagcaattctcctgcctcagcctcccgagtagctgggattacaggcgcctgccaccgctcccagctaatttttgtgttttagtagagatggggtttcaccatgttgcccaggccggtctcaaactcccgacctcaagtgatccacctgggattacaggcatgagccactgcgatcccagtgatcctgcggggattacaggcatgagccaccacgccaggcctggacttctttagattgtgcttttcagtaatctgtccctgtttgtcttggtgtcttatgggctgacgtctgagggatccctggttactcccc

SEQ ID NO: 58703 - DNA, 1067 bp, Homo sapiens
tgtggctggaggtgggaggtgagggggacccatgcacttggcaggcccgcttccaggacagccctttgctgggattgatgagctgttggtggaaaattgttgaggaccttggggttggtggctgtttcggtaccactgtgcagcctcctctgcatccagcataatttaaaataaacattttcaggaagccacacttctccagaaagtaacattgttttctggtgtaacggttgcctccttcagggagctaggtttgggggataatagggggcctttcactggccccacttggtctgacttagcagcaaaaactctgcgagtgctctccaagcagtttttctttcccaaatttccacacctaggaggcgctgaggaggcatgggcggtacttaggaactgctcactgtggaactgaggcacagcggggagcatgccctcgtgggatttgcagttctaggggcagagggataataaacaaaatacatttgtaaactataaagtatgttagaagatgatgtgtaatatggagataaataaaactttaaagaggggagaggagtgccaggtggaaagggaaggcctcactgaagggtggcactggcatagacctgaagagttagggagcagccaagctgctgcctggggtgcaggtgcaaaggctgggggcaggagtgtgcccagcttgaatggcctgatgtttgtgtttgcagagtgtgggtcaagctgatgagtgacctactggataaactgaactagctcagtctgtaagtgaggggactcctgagctttctgcggccttcttcccaattccaggaaaggaaggaccttccacagaaaataactactcagcaagacagccagggtgaacctcagcaccatctgtgacaagccacatgctctctgcgtgatgcctcctgcctctcagctgtgcctgaagcacactagctggcatggacttacgcggctgggaacatcttcaggaagccctgaatgagggctctgtgggcagagggacctttgcagaaagggcatcttgaccactgcaggaggtggagtgactctcctgg

SEQ ID NO: 58704 - DNA, 1024 bp, Homo sapiens
ttgtagctaaatgaccactatcttccagtcacgtttttaaaaaaaatcatgctggtttgcaacaaaaattgtattttctttactaggcaagtgaaccattttgttgggaagagtaccttggcttcgagaaaaaaatgatttcattctgaaaggcttcccctccaaccccctcctgcacaaactctcagcccagtaacttgtcagtattctggaaaagtgcattacaaaacaaaaactcgaatcagataaaatatatctctggaacttttgaggcagatcaatgaagctctgatttcaggtgctagcaaaataaagcaggcactctcattttgtattgttttacttctcagtttttcatggtgtctcctaaactttgatgttttgaagaagttctaatgtttgctacatcagcaggagctgaccacagggaagagataaatatagctctccttggaaaggtgaaggcttagccaccagaattctgccccttgatgctgagaatgcaccttctccgaacagatggaaaagaggggtggagattaccccagggacatatcttgcaaaatgctgatacccgaagatgtacatagccttgtgctttggtcatcctcccaaatcatgtccttggtgaaggcacatggagaggagagcagatgctgccagaccacggtgcctgacgccatgcactccctcacgtccagcctgtttatgtgcacacggctgcagcgggaccttggggtgtgggctaaataacaagaacaggggctcctctggggtctgttacaaggcagagatgctccacggtaattagggatttaggggaagaggaaggaacacacatgttgataataagtagttcaacattattatccccattttacagatgcagctactgagcttagagaggtttcataacttgcccagagcccctcaactagtaaacagtggagccgagatttgaacgacccaaagaggaaagcaaacaagcagcccctttattacttttttttttttttaagatgag

SEQ ID NO: 58705 - DNA, 1019 bp, Homo sapiens
ggattacaggtatgagccacggcacccggcctttgttttttctttcctttttttttttttttacatttttagtagagacaaggtctcaccatgtcacccaggctgatcgcaaactcctgggctcaagcaattctcccaccttggcttcccaaagtatcaggattataggtgtgagccaccacacccagctgacattgggcatttatggtacaaaacctccctcaggtacaacggctccaaaagagccagtttccagcattgaattcatcgtggacttacccatgtgtggttctggcaccctgcccggggctggaggcctgttcttggccttggtcctttagaataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgacagctcagtggtgtgtgagtcctggatgggatcctggaacagaaaatggatatcaggggaaaaactgaggaaatctggctcatattttgttgtgtgtagataccagcattatccaggttttaaaaaggagaaaatcctggccgggtgtggtggctcacgccagtaatcccaacactttgagaggccaaggtgggaggatggcttgagcccagtagtttgagaccagcctgggcaacatagcgagaccccttctctacaaaaaaaaataacaaaaataggctagacatggtgttgcccacctgtagtcccagctacttgagaggctgaggtgggaggatcacttgagcctgggaggttgaggctgcagtgagccgtgattgtgccactgcacttcagcctgggcaacacagtgagacctcatctctaaaagaagaagaaaaaaaaaggaaatcctgcaatgtgtgacaacatgaataaactctgaggaaataatgctaagtgaa

SEQ ID NO: 58706 - DNA, 1032 bp, Homo sapiens
aaattattgaacaagtatttatggaggcctgctgtgagccaggagctgtcctgagccctggaaacccagcagtggctgtacagacctggcccagctgtcagggggcacctctaaggaaaccgggaggcaataatcgtagctcccttgcagggaggttgtgaaggctgagtgaggacatctgtgcacctggagcacagtgtgagtgtgaaaccagtgtcagcccttattactgtcaataccatgaaggggcggcgggggcactaagggtggcaggactcaatatctaggctctggggggtgccagagcctgaccgtgcagggtcttctctctccctccaccctgactgtgctctgtccccccagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaagggtacggggctgctagaggttccataactgccccgtcctcgccaagggtgggcccggtgttcccaccaggctctccttccggcggggtgagcagggagttggcccgaggaagctgggaaaggaggggcctgagaggccggccccagacacaccgccctccggggctggagatgccacccctatatttgggctccaggattccttcttgcctctgtgagcttttctgacctccacctgggggtaggcgggcctgagaaatttcatagaacaccagagggcccaaggagcaatctgcctgtgactccgtgactccatgcctttccccatcactgccagggttcaactcggtggccaccgccaggatcttttacaagctgatgctgcggctgggcttccaggaattctacattcaaggaggggactgggggtccctgatctgcac

SEQ ID NO: 58707 - DNA, 1042 bp, Homo sapiens
tgtttttagagcaaaagaaaatgaaagcatgtgtagtgacaatatggaatgctggaaataaactcttagggggttcctttgtttttcagtctagattttttcttccggtggctctttgacaaaacttcctcggaggcctccatcaggttggagtgagtattgccaagttgagttctggagccatggccctgggtgaaagtcccacaggggctggggctgcagtgggatgggtgggggcggtcgtagcctatgcttctgaacaggcatcttcctccccagacagcagggcttggggcctcacctccaccctgccaggtttctggtagacactgtgggagctgacccactttgtgctatgcttgcagaaatgtggttaattttttaggccagaactcaattagcagctgtctcattcattgaaacttactgagcacagagtcacatggggagaaggaattgctgggtctcagtggtgccagggagtggggaaaggagaataataattaaagatggcagccaggatgcctctgggctctggggattatttttgccagaatagaattaaatttattactgatgtatccttgttagtattttaaacttataccatgccacttaatagtaatagctattgtttaagaaggcactatgctaaatgctttatgcatctttttctcactgtatctttacaatgagctatgaggaagatactattattctctccattttacagatgaggagactgaggtttggagacgttgaataacttgcccaagtttatccagctggttaaggaacagagctgggattcaaccccagcccctacagactatacattaggtcttaatataggtccagaggcttggcattgactttcctaaaagaatgtgcttacctgtaaggatggggcgagttattttaaatgagttcttgctgagtaagctgatgagttgggagctgatgactgtgacagacacacatacatacagccagcaatagtctaggttgacagtgactttcagattgacaagtccagtgacca

SEQ ID NO: 58708 - DNA, 1077 bp, Homo sapiens
tggagcaagtcacctccccatctctggggacacagggaggaggccagggtggtaggatggactgggactcttggctccacctcaggtctccatctgagggggagacaggaaacaggtgggggcctggggcctgggcatattcccaactttattctttttttttttttcttttttgagatggagtctcactgtgtcacccaggctgaagttgcagtagtgggatctcgactcactgcaacctccacctcccaggttcaagcaattctcctgcctcagcctcctgagttgctgggattataggcatgtgccaccacacttggctaatttttttttttttttagtattttttagtagagacagtttcaccgtgttggccaggctggtctcgaactcctgacctcaggtgatccacctgcctcagcctcccaaagtgctgggattacaggtgtgagccactgcgcccagccctaactttattctgaatgtgatttcttagaagcaggacagggctgtgagatgactgtatttacgtacctttcccacacacgtaacttgggcacaaatgtttctagcaacatcagatggagtgctggtattcctttacctcgagtatggtacaggggctaagacgggctctggaatttatatcatgtgagatcctgaaagttatgcaaatttcctgtgcctttatttcctcatatgtgaacaaaaatgtggggatagcgatcgaaccatctcataagagtgtggtgaggatgatatgagacacttcatgcagagccccgaggcctgttccactgctcattaagattcctctgtgtcttggccagtgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctgggtaatgaccctcctcacccttgtctatgttgtaatggggcagagtggcagtcctagggaaagggctcactgtggtagaccagaaccccaggagtcatgccccac

SEQ ID NO: 58709 - DNA, 1020 bp, Homo sapiens
tgaatcctgctgagctccccatgctaccacccccgcaaccccactctcccggggcgggtctaagagctcttcggggaaattcaaagcactacagggaccaacgtttgcagatgctctccctgcgccgcgaccaccctgtgcttggcccagttctcccggaggcgtccagagactgggctcgtgccgggggacggaagagggtgcgccccggcggatcccttcttggagcctggacgtgagctggccggtccggggcttgcagacctccgggaggagctgcggggctgagcggcgaccaggaggccaggccggggcagaggaccgccgagggccaccgcgggaggcgcagtcagctgcgtacaggcttgcgccgccgcgggccaagactccaaattgggaaaggggtggccgcagctctgcgcatgtgcaggaggcgccggagtttcactttgtaacttttaagtggtcggaacacgccccgcgctgctgggtcccgccagacacgccgccgccgcaggtacaggggacagggggcgtgaggaggggcaatgcaccctccgcctttcccgggacgtgcgcgccaggtgtccggttccggaacggctcccagcctacgcagaccccagagcccccgaccccaagcagggggtgacgacgcgggattgggtgggaggagagggtccgggcagcgcctccattccagccctgcgctccttgggaattcctggcggcttttcaggactttcctctccggcttttcgctttcagggctggtatctccttcttccccacccctctctttgggatttgtcggcggagtccgacctcccacctaactaggagtgcagctatgggctcctcggaccctatacgaggccgggctgggaaagggccaagcgtccgactctcctgacgccaggaaggcagaggccacccctcgggctgttcctgggtgaccacttcctgcagccttggcggagtcctgaggagggaggctggggactcggggactggggggaa

SEQ ID NO: 58710 - DNA, 2336 bp, Homo sapiens
cctggcctggctgccagctcagtggccctgccatcctcagagctcccctggagtcgggggaggccctgctgaccctgctcttgtccccagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggtgggggtcgcgggggcgcgcagggtagggggagggcgctgctaggcccggcttgggggcggggacgcgggggggcggtgcggggtcctcggggcccgtcccagtccccgccctcaagcggcgctgggtctctgtgtcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatgggtaggtgctgagggtcaaactggtaagccggaataaagagacaggcaattacatttattttgaaatggacaacttttcagagtgctgtgggaatgaatgagacaatgtatacaattcttcctctgactcttaggagatcctcagtaaatatcggttattaattttcaagttatttctagctgtccatcctatatcacaaacatccagctttttgaagttgagaggtggatcataaatctccatcccagacgccctctgacctcagccctcccagctgaccgctgaccctgctctctttgcccacacagagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctataattttgtaattttctattttattttaattaattaattatttttgagacagagtctcactctgtcacccaggcgggagtgcagtggcccaatctcggctcactgcagcctctgccttccaggttcaagcgattctcatgcctcagcatcttgagtaactgggattacaggcatgtaccaccacgccaagctaattttttgtatttttattattattattattgagacagctctgtcgcccaggctggagtacagatggcgctatgttggctcactgcaagctctgcctcccgggttcacaccattctcctgcctcagcctcccgagtagctgggactacaggtgcctgccaccatgcctggctaattttttgtattttttagtagagacagggtttcactgtgttaaccaggatggtctcaacctcctgacctcgtgatccgcctgcctcggcctcccaaagtgctgggattacaggcgtgagccactgcacct

SEQ ID NO: 58711 - DNA, 1272 bp, Homo sapiens
tctggtttcacaactggggaccaccagctcaggatctcatgaggccccgggaccctctgagcacgggcccggatgctcatccctgcagactggattggcccttagagccctggcgttgcctgagccattctggttcctgtcagttgtttggttgcagcaaggaacaagactctaggtccacttaccagcagctgggggaactgagcctcttgcagagaacgagagccccacctctactctaggaaatgagctttttaatttaactggtcaggcctcaacccacattaggggttcatgaccattgtatagacagctgtagccagctgttcacagcccagacagacttgccctatctagacagccccctcctcccagctcagggactcgtctggctgtgagcttccaggaggtctcaggggtgtgacctccctccctccttccctccccactccctacctcctccctccaccccaggctataaagctgcccaggcttggctctcagcacatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgaggtgaggccctccctccctgctgcccctggtcccatggggcaggtcagatgtgcccactccggtggtgtcaaagggctcctggccttgcagaggtctgtgggaggctgagtgagggccacggtctaaggggcagtgaggtggggccgggcctgtgaggatggcggggcctcagcatgcagcggtgcatgcagtcaggactccgggggtctgttttcgtactgccactctggtctgagttctacttggagcatattgctttaaaatcatctcacaaccatttgctcacatggaactggggtataactatgtcttgcccatcttccagcattgtgaacatcaaaatgagtcattgtaaatagaagcgtgtttgggtaactgaaaaatactgcacttgagtagacaacctgggttatacctggctgtcaggggtgcagcgg

SEQ ID NO: 58712 - DNA, 1033 bp, Homo sapiens
gcagagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatcttgcttttgttaggcttaatcttaaataatcatcctggagaacttgatgcccttgtgaggtcctccctgcttctctgcgagagcactgtccaagggctagaagtagggatgagaggaataaggggccaggcccttggtctggatcaaggtgttgttctagaatgagccaaagctaatggcagggaagagccaagtgggctgcatgggttgtgggtcagcagcccagaataaaggggaaagccgtctgctttgatgtggggcaggcactgtgctgagcatttgatcc

SEQ ID NO: 58713 - DNA, 1044 bp, Homo sapiens
ctcaaaaaaaaaaaggcaagtgacagcaaggggctggggggtgcgggatcgcggaagagtcggagactcgaacttgtccttcttgtatctagtttggacaaattcgcgagaaacactcaagttcaagtgaataagccgcggctgaccaccctggtgccgcctcgccgccacctggtctgaacctcgccgccacctggtctgaacctacgccaggagggcctcgttcatccccgcaaatcggcaacctggagaattcctgtgggccttgaggggcatctgatggccagcgccagaaataatattagccaggcctgggccaggcctcagccctgagcccgaggtggcttagggacggcgacctcagccttggggtggggggggggggtgggggcggccgggcgtcctgggccggcgggcgcctggagctcacgccaagctgccacaggggcttccgggactccagcccggagttccgccctccagtcgcgagcggaggaggcgggcacgcggcctggctcgggccgcggattggcctgccccgagatcctggccactgattggtcgcccggacggggcggggccacgtggcctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcaagcgcgtggaggcgggaggcggcttcgcgggcggtcccgaggcccgagggggcctccgtcccaccagcatgagcgaatgaaaggggagtttgcgtccggtggggtagatgagactctggttgagcagcaagtgcgtcttctgtcctcgtagagggttgagggggagagggagactggcactgttaggac

SEQ ID NO: 58714 - DNA, 1669 bp, Homo sapiens
agctttcctcctgctttggtgaattctttctcatggacaagttagctctctggagcagatgggggctgtgtagcacagtggttaagaagaggccttggagccggttggcctgggctccatctagctctgccttccactggctgtaggtcctctggcccatcaccgaacacctctgggtgtcagtggcctcaggtggaatggggataatgctggaacctacctgaggatgaaatgcagacatcacctgagataatacatgtgaagtacctagttcattgtctggcctattaggagacctttaattaatagtagctgatttattatttatgtttcagatatgtttattcatcttctcacaaatatccagcttttagaacatagtgagagctggatcataaacctccctcccaggtgcccactaagctgtgccccaggccttctgacttcagcctcccagatgacctctgaccctgctctccttgcccacacagagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactca

SEQ ID NO: 58715 - DNA, 2838 bp, Homo sapiens
gggtgtgcaaggagtgtaggttggagggagatgaccaaggggcttctgtgaatgtggccagaaccagcaggaaggcagaatccttcccgcccttcctttatgatttgcagacctggacccagcccagcctccagaagagacttaaagagatttaagcagctggctagcaggactttgtttttcacagaatagactcactttttcatagaacagggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgaggtgagaccctccctccctgctggccccggtcccatggtcgggggcaggccggttgtgcccactctggaggtgtcgaagggcccctggccttttgggactctgtgggaggctgtgtgagggccacggtccaaggagcagtgaggaggagccgggcctgggtccagggtctccagctgtgcactgaggcccccctccagcccaggggaggtgcaccaggctagacctgctggaaaaaccaagacttcagagaaggggagggtagaggagagaaagtagagctgggggagcaggtgagtgtgtgcctcaaggcacttggtgcagctggactcccagggtatgttttcacactgccactctggtctgagcctgaccttgagtaaatggctttaaaatcctctctccaccatgtgctcatctggaacaggggtatgactatgtcttcgccatctcccagcactgtgaacgtcaaagtgagtccttgtggatagaagcgtgtttggataactgaaaaatacctaagtagactacctgggttatacctggctgtcaggggtgcaactgggcctgaatcctcctgcagcctctcgcctccctagctcctcagtgcccagagctagagccagtgccaggcacctgggtgaggattctgctcccagcatctcagctgaggcaaacttgctagccagggtcccacaggcccccctgcctgctggatggaaattgttactaaacaaggcccagatccaaggaagatttgtaaactgggtttgccccagagatagaacagggccggtgtctcctggcctggctgccagctcagtggccctgccatcctcagagctccgctggagtccggggaggccctgctgaccctgctcttgtccccagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggtgggggtcgcgcgggcgcgcagggcaggagtaggaggctgctcggcccggcttgggggcggggacgcagggggcggtgcagggtcctcggggcccgtcccagtccccgccctcaagcggcgctgggtctccgtgtcgtgtgtatcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatgggtaggtgcaggactgggcagaagggaggcaagcagccactgagtggtccagacccccgtccccaggactgtctgggggaccggatggtggcggtgggctaggggtagggagagcgcggtgcagactgtcccaggatgccagcgattgcccactacatgtcagggtttctaatggcagaaattgtattgttggccaggcgtggtggctcagacctgtaatcctagcactttgggaggccgaggcgggctggatcacaagatcaggagtttgagaccagcctgaccaacatgatgaaaccccgtgtctaccaaaaatacaaaaattagccgggcgtggtggcgcgtgcctgtaatcccagctactcaggaggctgaggcaggagaatcacttgaatccgggaggtgaaggttgcagtgagctgagatcacaccactgcactccatccagcctggaggacagagcgtgattctgtctcaaaaaaaaaaaaaaaaaaaggaaa

SEQ ID NO: 58716 - DNA, 1017 bp, Homo sapiens
caggagcatcgcttgaacccaggaggcggaggttgcagtgagccaagatcatgccattgcactccaggctgaacaacaagagtgaaactccatctcaaaaacaaacaaacaaacaaacacaaattagctgggcatagtggtgcgtgcctgtaatcccagctactcgggaggctgaggcaggagaatcacttgaatccaggaggcagaggttgcagtgagccgagaacacaccagtgcactccagcctaggtgacagagtgagactccatctcaaaaaaaaaaaaaaaaaaaaaaaaagaaataaaaagaaataagactgagcctaaaagaaataaagtgatgtcaggaaatccgtggctgagacccacatcaaggatgctggcttcttcgttcagcagagacccctccagcctgcactgttccttcctgcttctgagtggccttgcgcccactcccaggcaatgtcatgtgctggccaagcccacagagccctgagccacattgcccaggccggagcccagttcaccactccagagtcaggtggtcttgggtaccctccttgccttggcttcaacatctgcagaatgaggaggataatagagtcttttttctaggttttgtaaatcacttgctgtttattaggctctaaacagttcccagaacatggaaaacactatgtaaatgctttaaaaaacaaaataaataaaagaagggacccgggcacagtggcttacacctgtaatcccagcactttgggaggatcgcttgggctcagaaggtcaagcagcctgggtaacaaagtgagaccctgtctctacaaaaaattaaaaaaattagctgggcatagtggcatgtacccgtggtcccagctactcaggaggctgaggcaggaggatcccttgagcccagtaggttgaggctgcactgagctgtgtttgcaccactgtactccagcctaggtgacagagcaagaccctgtgtcaaaaaataataaaaacaaaataaaataaggaatcc

SEQ ID NO: 58717 - DNA, 1242 bp, Homo sapiens
actcaattagaatagaaagcattaagattatggaattagtagattcagaggcatgggattctcattaagcttttaggagtgcctgctctttctgtgggaatagtgtggggataggctggctatattttactgtttagatgtttactagaaaaatcggaaaagaaagcaatattaaaaatctgtttgggaatgctatacttctgttactgttctgaatgcttgtttctaaatgtatagatgaaaaattagttattatgtgtgttgagaatacttatggaataacatgtggatggatgatgattaaaattcagttgcaaggtatggcaaattaaatgaaaatttctcaagaaatgtagttgacagttaaagagtctttattcagaggaaggagcctgttttaaatattttcttatttttttccctcaggttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgggtaggggtttatcagttttactgatctgactttttattttattttattttttttgagacagtcttacactgtctcccaggctggagtgcagtggcgcgatctcggcttactgcaagctctgccttccgggttcatgccattctcctgcctcagc

SEQ ID NO: 58718 - DNA, 1049 bp, Homo sapiens
agggataagctaagtcttcagaagatgtctagacctcaaagaatttgctgccagttttaagtcagtttttaatgtgaatgattctcattaacttttgtttttagcatccaaaacatggcaggcctagtatgggaacaatcgaataagaaacaatctttttgcatcaaaaaggttatgacataacaggaaaaagacaagtgtatgcaaataactaacgcagggataaataattaggtttggggagggctgggtatgaacttgtcagtctcaaggttacaaattgtgcagtggtgctttaaaaaatctgctcctagactagaatgtttatcattttaaatctgtgtaaatttgagattaactgtataaaatgttggtatcttaagaaatttaaatctggagctgtagattgcagctctttttgcaatccatgttatttatgatttctttaaacttagtccctatagtagaaactgagttgttaaaatttctggttaggtatgcaggctgcctccagcaagatggtttcagcagaaatcagtgagaatcggaaacggcaatggcctactaaatctcaaacagacagaggagccagtgcgggaaagaggagatgcttctggtaagtgtttcactttcgttcccaattgatctttgaggactgacttgagacatttcctccttgtttatctggcataaacacatttttgtgtagtgtttggtgggagctcagaaaatttccagagtgcttcaagctttaggtttcagtgattgtcacattgtactggtaatggtttctgctgtgaatgccattaattgaatgtaaaggatgaattttttccttacactgaaacataaaaatagctttatatttgaattacttttttggtgttgaaggggtttaacttttagaaattctaggtggaaatcaagctgtactttccaggtggttgtctgtggtttttcacagtcatcattgaggtctttggtcactttgccagacttctcttcaccactttcgcacttgagggtaaaaagcacagcagtactttttc

SEQ ID NO: 58719 - DNA, 1029 bp, Homo sapiens
aggtggaggttgcagtgagccgagattgagccattgcactccaaactgggtgacagagcaagactcggtctgaaaaagtatatataaagaaatataaatgagtggattcagtcagaaacttaaggaacatgaccatagcaaatatgaatagaaacacaaaagaatattagttgagatactggaacaagtaagaatagctcaagttcacacctatgtttttaaaaacaaaactattctgagacatgatgaagttagtgttaactcccactgagaaaataaaaatctgccctgcttttcatcaggctgggataacagacacagataaagccagctgcaaagtttttgttttttgtttttgtttcccccacactacaccgatgtacagctgcagagttaacaggaaatggtgatgtgtcataatgtcataacgacccccacgaaggtctgctgctttcttattcactgagaaaccttggtctcaaaaaccatagaatatataagaaattttgctgtttaaagttctctcaataagagggaaccttcccactcttgccttgtagagaagcattcttgatttccaacccaggtcagagcttcccattaagggtttctggacacaactttccacatttatcttaaatttgtagtttccaaggaaagaggagccttcacaatccagatctgatgttgacgtttttatatacagtcctgctttattttgaacctttttaaacactgcttgatgtaaatttcacctcaactccaccctagccccaaatcttgtaatgacactcctttctttgggttggtgagatacccatgactcctggtgtgcagttcccctcgttgcagtgaatcagtaagtttgacaggtttatctctgatagccttaggctggttgtgctaaaacacacatgataatttgtgtttgaagcactttacaatgcacaaatggttaaaagcagttaaattgagtctaaatgttgtatccttttttctgcttgtgacttcattgacaagaatcttaag

SEQ ID NO: 58720 - DNA, 1011 bp, Homo sapiens
tctgccgccttatctgcctccgccaggcctttcctgttcccctcccccagcccgcaccgccccgccgcccggctcacttgacccgccccaggggaggggaggggtgaacggaagcgtgaggggcggggcgttggaagatgctcgcgtcatcaagaggcgccgggcgagttgcggcgcctggtgtctcagagaggcttgaggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcaggtgaggatttcggttcctgttaggaaggagaaagaggcagacaggtggcagcgctgggtgcggagtaggtctgtccggggcgggggtacgtttattctctggggttttcactcgttgaggctgagagttcctcagtgttaaggtgcttcgaattgttactgagaccttcctttgcttttcttttgtggtggtggttttgccttcccaccaagagggagaaaaaaactgttacaggcacttagtcccgctcacagttacaaatactttgtttctctttctttatccgtaaatataatggtcttctggcagttgggccggctgatttttaaggctccagtcttcaccttcttactatggttatgtgacgtgtattttgtccactcatcacacagccttgttagccccagcctagagaagtatgtcatatccaaacccaggccaaaggatgattgggaaggaaaattgattcttctggtcagtcgttgtgaccaagcattcacacgtgtgtcctgttgagggcctgggttcttagggcctgttacgtagaagtgttcactattaatttgatggtctcatttgtccgtgcatatttgtgaaaacctaccagggacttccagagttacacgtgagcttttactgaactttcaagtaagtaagcttttaccagctataa

SEQ ID NO: 58721 - DNA, 1057 bp, Homo sapiens
gtggagcgcgcagctcctgcaccagggcctggtggcttgtcctgcccgcccgtgggggccgtgtgatctgttttcggtaggattgctttggaaaggaattgccgaatatagatagtcaaatgtccgcagcttctgcatagtttagaagaggctgaaaacggcagaaagaaggcaaacgtggtttgggaattagtacatatacctgttttccaattctcagtagcataggaaacggacttttcatggcccaagttatcctcacgacttgtcagttgattggctttggaacctctgaaccgtccctagatggtattgacgcttcacaactgtgtgtaaaggttttcaatggaagggtcatgcaaatatcccgtagggtagtgaaggaggaaaatttcataaatgaagggcagtaattatttgtaatctgaagatctcacaaagcggcttagtgataaacattatcccgaaacagatacatggaaatcagatacgagggaagaaatggatttgtccaaggtcacttaagtgaggaagagacctaggagaaacaaacagacaaaaatccaggcctcccgtttcattattatttcatgaatgttaagtgtccatggttgctgtgcagaacacatgcaatctctaatcctatcctaaaagcacatatgcaatcagcttggaccgagctgccagcaaagaatttcctataattcaagccaagatgagttattttgcttgttttttgttttgttttcaggaaaccgaaatatttattgttggatttatccaggaaggctgttctgcattagttaaatgcatcatatcttcaagaaatgttaaatgacatgggtaatgttttctttgtatgctggatttttcaatagcttctacttcttggctttaaaaaatatttctaaccaagggtcagaccattttaggtagagtaattatgatcttagatgatttgaactaactcagctgtctgtccatttgtgaaatgggaataataatatttatctctatgaagttaggccacaaattctttctagtaggttcaagtatt

SEQ ID NO: 58722 - DNA, 1060 bp, Homo sapiens
ggataggggtattttcgagcgatttggtgttttgtctctttggaacggaatcggatacgttttgcgattgtttccattttgttctggtcggggagccgagttggttcctgctcgaggcgctgggagcgaggcgggcaggttgggggaccctgtgccgagggacccgaaggaggcaaaaccaaaagtttatgtggtgcttggggtggaccggtcggcggatgtcgtgcgttaattaaagcctgggtgcggggcactttttatttcactgcgaagcctgtgaggactggacgcgaggacggggctttgtagaatgctcgctggtggtagctgttgttcctctcttgttttttcgagacgcctttttgtcaacataactgtaaagatgcaaaaccaagaatattttcagatatttacagcaatccatcaacagtcagacgaagggggggcagccaaagtgggggggagtaagaccttttttttgctgtaatttgactcgaccttccagtggtttgtgccttttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttggtagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggtattaaaaaacaggaaaaaaatgggacaaagtctctct

SEQ ID NO: 58723 - DNA, 3096 bp, Homo sapiens
gaggtattctgggaaatagaacttgaatgccacaagcagatttttaaatgaagttcattgggttgtgttggtcatctttaagggctcttaagataatagagggtgtagggaaggagagtggtgctaaattgaggggagccaacttcttcattagcctgacagctaataccttcccaaggtttatatacatgaataactttttaaaatgaaaataaatagggctttgatgaatttcttgctaagaatgcattttaatttcatgctttttgctttaaaggtattgttactagatttgaatgttcacatcttaagttgatcagtgaaatttgatactgaagctgaagaattgttgggtggcttattttttgaaagattactgcatttctttgaagctgcccacttacctttttgtgctagttatgtttttggtaacagtttctttattaattttttaaaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggtaaaatggtgggtgggaagactcagagtttgtattcctgttgtgtaccaagaacagttccaaattgttgcatgtgcttatatcatttaatcacaagcctgtcaggtagttgatattgttacttcactgttgagacttcagaaaggttaaattgctcaaggtcatacacgtagaaaatggcaaaaccataatttgaacctatttgactccaaggcttagtgcacattccattataccatttaaaattttgaaacattgcactaaaaacaatatttaaagaaaatcctctggtttggtttatggatgctgcaggacattaagaagaacttgagactagaggtctatatttgtagtaacaatttcaaacaacagtgcctagaataaaagaaatgtctcttcaggtcctgaagaaacatataggtagagagagcttaatacctaggatgggaataggcagtattaaaaaattatgcattaagacgtaaaaggagcagtgagtggaggataggattggattggcaagattgggggaacggtgcttaaaggtgatactggacgtgtaaaggggccaggatttgccttgtggtttcctaaaggggattagggattgccacttacatgtggagcatattgaatttaatcttaatctctagcatgtcaggacttagagaaatactgttctagagatatttatgtatttgagatatttgtggtttaagttaagaccaaaacttgaaattcctacaagatacttgataaaggtatgtagacgtcattaacatcagtcacttaagtaacctattttatattgtgtggttggattctttagttgcaagtatcccagaatacagtaaagctaccacctccatcagaagcatgcagttgggggtcgttaaaaatgctgattgttaggcaccattgcagacctgaatcattctgggggtggggagggggcatccagaatctaagtacattccattggaggattttcaaggctgctgttgctgtgctgggcttttgctttatgtatgagaaagataggataggtggattccaccctgaagtgtaattggtcgagctgtttctatggttaatctaaacttcatttgattggtgaattccaggagtaggcatccattaaattctcagtgagttgctgaaatttcaactactaaaatcttccatgtttttacttaaaactttattttctgttttaatagccgattatcttcagttcttatttattactaaatacagaaatgttactaagattcgtaagcattggtacaaagctgctaatattttctagttagaactgtgcttaaagaacaatactgtacttgaaaagtgtagcgtttttagcttaaatgtcaataatgtagccttttaaattgaatttactaaacaatctgggtaaaagactcatctttctaaaattattcacatgtaaacttccattgttactattacatatttgtcattaagtgtggttgtattggttttaagcaaaatgttcacctcttctgtccacagttctcttagtgttagatagctctttattggaaagagtgatctttgttaagcttttgtgttttctgtttgcttttttatgcatatattttagttatcttaaaaatacagagagtgggccgggcgccgtgactcacatctgtaatcccaacactttgggaggctgaggtgggtagatcacctgaggtcaggagttccagaccagcgtggccaacatggtgtgaaaccccttctctactaaaaatacaaaaaattagcttggcgtggtggcaggcgcctataatcccagctactagggaggctgaggcaggagaattgcttaaacccggaaagcagaggttgcagtgagccgagatggcgccattgcactccagcctgggcaacaagagcaaaactcttgtctcaaaaaaaaaaaaaagataacagagggagaatttgttaatggaataggataatagaagatcgcaattgaagtagaaatccaaaggtcctttgtttttggccttagaattacacactttacaactaaaggatagcaggcagtccagtgagaatggtagaggagaaattagtctcagtttgccatagataatcaataattgacttacttaaaatatagtctttgcttttaatgtctgagaacttgaactcaaatattcttgtgttaagtggacagtgttgctttgaaatggtaaagaggcagacgttgaatatactcaaaatgtcctaaactaatactttcttgtagttcttttttttctttgccattaaatcaaaattaattcattaggtcataaattagtgtggcagtctttaattcccattacagccttaatgttttaagggactttgggttacttgtaataaaattggaaatgtatgggtcatggtcagatcctctcgtaggagttcagtctcctctcagagctgaccagacacaatccttataaactag

SEQ ID NO: 58724 - DNA, 1022 bp, Homo sapiens
tccaaaactgttggatttatgattattttttaaaatggtaatttctccatttcaaaatgagtaagcaggccgggcatggcggctcacacctgtaatcccagcactttgggaggctgaggtgggcagatcacctgaagttaggagttcaagaccagcctggccaacatggtgaaaccccatctctactaaaaatacaaaattagctggacgtgatggtgcatgcctgtaatcccagctactcgggaggctgaggcaggagaattgcctgagctcgggaggtggaggttgcagtgagccgaggttataccactgcactccagccagggctacagagcaagactcaaacctcaaaaaacaaaaacaaaaagagtaagcagatgttttggcttagactaaaagattcttcagcttttcagacagctataagtatactaagaatttgagttatgagttaattctaagtggaaacgcccctttttcctcttcacaagttaagtgtcaatgagtgattcatacactgtcatttttaagtggtagtaggaataagataacttgaaaggatcttacagtcaaatgggaaaaaccagagaaatcgatactagtactagagggcaacaaatgctgttacaaattggggtacgtagaggaaggtacttggtagaggacaggggcatgtttccggggcatagatcaaagtatataaataaggaactgccaggccagttgcggtggctcactcctgtaatcccagcactttgggaggccgaggcaggaggatcacgaggtcaggagatcgagaccatcctagctaacacaatgaagccccatctctactgaaaattagtcaggcgtggtggtgggcgcctgtagcccgagctactcgggaggctgaggcaggagaatgacatgaacctgggaggtggagcttgcagtgagctgagatcttgccactgcactccagcctgggcaacaaagagagactccgtctcaaaataaataaataaggaactgccgggcgcggt

SEQ ID NO: 58725 - DNA, 1022 bp, Homo sapiens; identical to SEQ ID NO: 58724

SEQ ID NO: 58726 - DNA, 1031 bp, Homo sapiens
tagccaggcatggtggcgcatacctgtagtcccagctactcgggaggctgaggcaggagaatcgcttgaatccgggaggtggaggttgcagtgagccgagatcgcgctactgcactccagcctgggcgacagagtaagactccatctcagaaagaaagaaagaaatacggaactaacttgtgatatgttctggaatcaaaagtactcttatgataaaacaggtatgaaagggaacatagatgagaagcatgtgataaaaaccacttgttcaccatgttatactactggacaaggcagaggttcacatactgtgtgaatgggattcagagtgaggaggagactaggctgggatggggtatttggattggacatgattgcgtttataagaatgagagtgttaaattggatttcttgctttatttgtgacatttcagtttattagaaatcatgttaccattagaaaaattgaagtttcctagtaacaaagtaatttgatttgtgtaacttgataaaagatttactgacttaagcttttgttttttttcataagctgcttttgagctttgtcccacaggttgtaaaatgtaagcatttggtaaaattgtcagcatcttgcccagtcatttttttaaagggttcaaaaacctttttgttttaattcgtatagttgggtcttaactattggaaataacatcatcagtaattttttcttcattccttttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagttttt

SEQ ID NO: 58727 - DNA, 1183 bp, Homo sapiens
ttgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaa

SEQ ID NO: 58728 - DNA, 1021 bp, Homo sapiens
ttcagatgtttttagtttttacctaatgttccaagatcctttccaggatgccacattatagtcagtcatcatatctccttaatctgctatagacggtgagaatttctcaaacttaccttgttttaaattcctgatagtggccattgacaagcatcactcagtgtgttgccagaattcactctgccatgttataaacctgaaaatccatgcctgtagtcccagtctcttaaacaaacaaacaaacaaaaacaacaaccataaacccgaaagtcttgtcttctgtgctgaatactcccttgacctctttgagctggtttgtattaaatatgttaaactgtgacttcgaagctggttcataattttctcattcctgtaggtttctagaggcattttttttcctaacctcatagcattacagttcaaaaaactcttaaccggggcaaacctttcagagcccattttttgccacttagatcatctctgggttaaattggcctagtgaaaataattgaattttcagagtatctctgaatgcctatctctctactatgattttttcattttactgcttatatttaagatatacagaaagcaatagtcctcacaaatcatcttccatctttctaaaatggggaggactcatattggtcagaaggaggatgatgagagcaacattttcatgttactcagatgagtgaaattcctgaggatgaattaggaattgaatggctatggaaaggggaaaatgggaccttgaaataggaatggtagtaagcacagaaagagataggatgctgaccactgctaccactagatgttcatcactgggctcccagggctcagaacagggtttggtgtatagcacatacttaggtatttgaatgaatgagtgaatgaatgaatgaatgaacgaactaataaatgctcacatgcacataacttgttaaatggttcaacagaattcccaacaagagcagtttctcaaagaaaggataggctgggcacggtggctcacgcctgt

SEQ ID NO: 58729 - DNA, 1050 bp, Homo sapiens
agtacggtgatggagagagaggtacattatctttgagagaatgtaaaacagggaagtgtgacctagtcagagaggccaccagaggcttcccagaggaagggacaattgacctgagatatctgaagcaagaggagttaactaagtaaggaggaagaggagagcatttcagtgacagtggtcagggatggtggtatggttcataagaaatttggtttcagagatcttccttgtctgtttagaacaagtaataattgcttcagaaaaggctttgaaatcccttggtttactgcccccttccctttttttttcttatcaagggattatactagcatcttcaaatgagagaaaatatttcaaaggctctgtgactaactttgaaaaacttattgcatagtcaagtgcacataggtactgctcagtaacaagactttacccctttttctcagtccctagtggttctaatcctgtccgagtttttgtttctttgagctcctttagaatagcccctagaactttgggatagttggaggtgaagaatttttcaacagacaggctgaagtcaaagtccagctttctttgttcacatccacaagagtaatttattcctaaagccagaatctctcttccttgctagaatatttccctcactccagctggggccttcccaaggtcattcttgaatccccatagagggagtgttgaaaaaaattcgtttctaaaattgtgggctgccattgttacttgaagaagtacgatgacctctgagtgcctgcaacattgttaaacatagtaatctggagagactcccatggggaggcttttttattcctccaagtccttgatctaagctagaccatattgtacttggtgcctgagtacaactgatcaggtagtgctatgaaaatgtggctacctgcagggtgaaggctctttttctttagctttttaatacctattgcctttagaatctcttccagtaatagcagctccatccatgtggacacgacctcagatcaaagacttcaaagagaagattcagcaggatgcaga

SEQ ID NO: 58730 - DNA, 1031 bp, Homo sapiens
cgagctcaggagtttgaggctatagtgagctgtgatggcgccactacattccagcctgggtgacagagtgagaccctgtctcgaggaaaaaaaaagccataggccaggtgtggtggcacatgcctgtaatcccagcactttgggaggctgaggtgggtggatcacttgaggttgggagttcgagaacagcctgaccaatatggagaaaccccatctctattaaaaatacaaaattagcctggcatgttggtacacatctgtaatctcagctactcgtgaggctgaagcaggagaatcacttgaacccaggagggggaggtttcggtgagccaagattgtgccattgcactccagcctgggcaacaaaagagaaactccgtctcaaaaaaaaaaaaaatccataattgagattagagtgatcaaactcagtttatcaaatttattggttgcttctgagaagagaaaaggaaagagactggggaaggaacaaagggaactttactcctataaaatattaatttttatataaatagcaaaatgaacacatttgttaattttggggtgtagatacatttgtgggtgtttgatacgttgcttttatacctttctgtgcttttttaaacttcctaataacaggaagagagtatggaaatatatcattacaatctattacatgtagtacaatagattcatggtcgggggttcccagagaaagttgtttttctgctagagcctttcaagaaaggattagtggagatgagggaccatttgagctgggcctattgatcatcaaaaatgctcttttgctttcctgtcatgcagtgaatgttctgagtgtgctgacttgttttgattttaggtactttctctggaagctagtatcccttctagaaaattgatgtggaaattactgaaaatccagaccttggaagaagatatcttaaaatcttaattgtgttattaacctatattagcagcaaagagaagcattgctattcatttaagtaattggcttgtaaatgatacattca

SEQ ID NO: 58731 - DNA, 1051 bp, Homo sapiens
taaagtaacttttgggtgatcttttaggcagacttgagaattgcacaggcaattgtgagagaaaatatgtgttatcgaagcaaccgatgatgttatattgtcataagggtatttgggagttgtatgggttgagtgtctttactgtgagtctggcatagaccctaatagtggtcctggaacatgaggacctgagtaactagccatagttcagagatgtccttcaggcagtgcattgtcagaggcttggacagcctccagtgggaggactcccctgccctaagaccatgggctggttctgcagagctagattgggtccatttgactttgtgttaggcaccatagttaggcagtgctcataacagcacattgctattcctcctccaactgcctgcccccaagtattttgcttccacataggagaggttggtttaggtgaaagaacatgggactgggagtctcataacacttggattctctttgggctttgacattaccttgtttgatctcagacaagttattactgctctgattgttctgctctttctttcagtccgtaacaataggatataaaatcaaagcacctgtcctgttaacctcacaggactatcagaggagtcaaatgagaaaagagttaccctgtgaacgatttttgtacttgtagaagacactaattttacattcattttttacatcttgtgcaggcataaaatacctccttaaacttaacgtagcttagtttaacttacttaattttcacttataaagcagttaccacctgtcaaaaaatctgagtgaagaaaagtgttacattatagttgctcagcatttcttactgcatgaaataatctttgttgtttttgccaaactctttaaattccttgaaaatgtgtattcttactaaacaaccttttctcctgagtctttggcatcagttagaagttaaaaagcactgcaagttttttgtaatcctgaagaggaggaaaagatgccaaaccagagtttattcaagataataagtggtatttttgagagatttattctctctcctctg

SEQ ID NO: 58732 - DNA, 1355 bp, Homo sapiens
acagagactggctggaatctgtgagacccagttgcagtttcccaggacagagaatcttgttggtccagtctatgtcagatatccatttatagtccttagtacaagatttggaggcttcaactattgcttactcagtaagggctttgagactcagagactgacaggttcttcaagagggagctgtgggtacaaggaggcagtgattaacacccataaaacactgggaagtaagtctgagtttgtaggggtggcatggcttgtaggttaaaccagagaacatgagagtccattgatttcttctcattatttctgggtagttcctcagaaaaaggtttagtgctagcctcaaactaatccaggccctcattcaactttggagaaagactatgaatgcagctcttttttgggggaggttgtcctaggtggatcgaatgttgtgctgtatgtaggagtttgtgaggctttgctttgttatctattaatagatggctttgaggtctctgttaagttggtcacataagtaagttaagaagcatgtggttgctggctgtggtggctcatgcctgtaatcccagcactttgggaggccgaggcgggcggatcacttgattgaggtcaggggtttgaaacgagcctggccaacatggtgaaaccgtctttactaaaaatataaagattagccaggcgtggtagcaggtgcctgtaatcccagctacttgggaggctgaggcaggagaatcgcttgaacctaggaagtggaggttgcagtgagctgagatcacgccactgcactccagcatgggtgacagagtgaaactccgtctcaaaaaaaaaaaaaagaagaagcatgtggtttatctataaaagaatatgagtatctctaaactaagcatgccaagatattttcagtatttcctctattaagacaggctttaaattaaatgctgtggacccttaatttttcactggctttatttatacttaccagggccacctgtaacatcttccagctattcttctgcctcttactgttttttatgtatttaggtacagaagccatagccaacagttaaatacctcatctatgtcagagatgacaatccatcatcttaaagcatcgtggtaaattagtgtagctctagagccaaactgcctggatttgcatcaggctgtagcatctgctagcagtatagtcttgggcaagttactgaaccctctgtcagagggttgttgtgaggactaaatgggttagtatgtgtgagtactttcaacactgcatggcacatagtaagggcacaataaatgttaataattatgatggtggtcatgatgatgatgatcatatgcttatcttc

SEQ ID NO: 58733 - DNA, 1125 bp, Homo sapiens
tttataaattacaggtatgtacatttaggaaaaacataatatatgtagggttcaatattatctgcagtcttaaacatccactgggggataagataaggactattgtgtattgccaaattgaccttcaaggtaactataacagtttatactttcagcattcatatatgagaatgggtacctgtttgtaggatcttaataactttagatgttatctaacttttttgtttatctgatgggaggtgggggtcttggtatctaatgcttttaatttatatttcttgactagtggggttgaatatctttttggatgtttattggcagcttctatattttttcttctctgagtttcctgctgttctttaacccatattcttctcacttattagtgattttatttcaccactatatacatgaatgagacatataagtagcatatgctactttcaagtgccctccccgttttctttaaatttggtagtctgttgtcattggaatcaaccagtagttagtgctaccatttatcaaagaagtggaactgttctctgaatatttcccattttaccagaacccaatttcatacggcttttaaatgttggtagcagttagtctttattggtcaaactggtcgcactcttaattgcctatatggaaacctaccagagccaatcaggtgaaggaaagaaaagcattaataagttagtaataataataatcctattacctctgaagtagcaacctctgaagggtaaccctttctttattgatgaataaactgagaggttaaatagtcacatagctaggaagtgtctcagctgagatttaaacccaggccatccaattccaaagccttttccaccacattatactaccttagtgggatggatacatttttgaatacagcctttcaaagtgtacataatcttctatgcatgatcatgttaaaagggactaatgtaaaattattttaagtttttcttttctcttttggctaaaaattatttttaaaagctattttaaaaaccgattgttgggctgggcatggtggctcacacctgtaatcccagcactttgggaggctgaggcaggaggattgcttgaacccagggttcaagaccagtctgggca

SEQ ID NO: 58734 - DNA, 1027 bp, Homo sapiens
tattatccgttaaatatatttgtaagagcttttcacttatatccagcctatggacagaatagaaatttcacatggattttgtatataaagaaatcaggacatatatttaggtttggggtcagcatggaggttgagcttagaggtagagcttccccagtcagtgagagactcatcttctccttccagccccccgtggctcctttgcttctttagagcatatttgttcaactactactgaagtagaattatggctaatatattagaggagatttattccttccctaagatttatcatagctgtttcctaactaaaattcaggtcttcttttaaaaatttttttcttaattttttgaaataaagtagttaaccatgtttcttctttctttagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaa

SEQ ID NO: 58735 - DNA, 1027 bp, Homo sapiens
acgccattgcactccagcctgggcagcagagcaagactccgtctccaaaaaaaaaaaaaaattacaaaaattagtcaggcatggttgcgtgtgcctgtaatccctgctactcgggaggctgagttgagaattgcttgaactgggaggcagaggttgcagtgagccaagactgtgccactgcactccagcctgggtgacagagggagactctgtctcagaaaaaaaaaccaaaacaatgctatgctatatatatatgttgaaacactaaaatctattgctgaagtatcttactaaaatattggaaatttaatgtctaaccaatatacctaaatgcctctgtttattctaaaatatttcttctttgtctgtagaccagattatcaaaaattctcatgattaaaaaggaacatatcaagaaattaagggaaatgaacacagaagcagaaaaattggtaagaatttctctttttttttcttcatttgcttgtctaattttaaaatagtgagaccatctatatctaatgatttaaaaatatctatggaaggaaaccttcagataaatattatttttaaatcctcatttgcatgaggtccacacctgtagtccaccttcttgggaggctgaagcaaaaggattgcttgagtctagagtcagagactgcagtgagctatgattctaccactacagtctagcctgggtgatagcgagaccctgtctcagtaaatgaatgaatacaggaatacatacatacatacaacagtaaatcttcattgctatcactatctcttgttatacagaacatatgctaagtaaattggcagtgcattgccccagacctcattatgccattgactgtacagttgaataggattaatggatatattaggttctttcagcagtttgcatgagtctagaattgctcagatacctgtgaccaaggaagttgtaatggcaggttataaaaaatgtttcagaataagtaagtcaggaaatatctatgttgtcatctttaggttatcttgacaa

SEQ ID NO: 58736 - DNA, 1047 bp, Homo sapiens
ctaccaataaaaactcttaaatgccttatgataattttaaacaggaaaatatgttcatgttctgtagaatgaacaaaaatgtatcttgaacttcaaaaaaaaaagttgtcaaggacaagtgcacataagcatctaataatttgattttgtaatcccagcactttgggaggccaaggcaggatcacttgatgtcaggagtttgagacgagtctggccaacatggcaaaatgccatctctacagtaaatacaaaaattagttgggcgtggtggcacacgcctgtaatcccagctacttacttgaacctgggaggcagaggttgcagtgagccgagatcacagctgtacactccagcaagggtgacagaacaagagtctgtctcaaaaaataaattaaaataaatttaaaaataataatagtttgatcttgttgaaactaaaatgcagtgtgcatttcttggctaagttagctgttgtatacaaggttgaatgaacaagaaatagttaaataacaattttgttagctagactttggaatagctatgttactaggataatctagatgattcacaaacatacagaaaactgatctttatgactgtgacactgtcctgtcgcaactctatccactgccttccttcctgagcacatcactccttctggactattttacagagccctttttagcaatacagagaattctgagcaatacagaacaaatataatgtaggataaacatgatatgagacttcttcaagtatgtgaaaagtttttatatcctctgagttttctctttactagttgtagaatctctagtgctttccatcttcatttacctgacatggcttgttcccttaccctccttagtcatatcttctaaatctctcgtattttgtctgtatgtttatttaaagaacaccacccagagctgaaaaattatgaaaactaacttttactgattacttatgtgttgagtcctgttctaagcacttcataggtattactttgatttaatcttcaacaactcctatgagataggttactgttac

SEQ ID NO: 58737 - DNA, 1678 bp, Homo sapiens
gcccaactaaggttttttttttttttttttttttttttcttttttttgtagagacgaggtctccctatgttgctcaggctggtctcaaactcctggcctcaagcgatgctcctgccttagccttccaaagtgctgagattacaggcttcagccaccatgcagggcctatctttatttttttttaaagatggagtcttgctctgtcacccaggctggagtgcagcggtgcagtctttgctcactgcaacctccgcctctagagttcaagcaattctcctgccttagcctcctgagtagctgtgattacagatgtgtgccaccaagcccggctaacttttgtatttttagtagaacctggctggtctcgaactcctgccctcaagtcatttagccccccaaagtgctgggattacaggtgtgagccactgtgccaggccaggcccatattctttaaatctttttgtattactatgtaacttcctagtggcagctattacagttgcagttttgtatttgtttatgtgattggttagtagccccatcagagcaggtactgtcttaattgcattcccagttccatgcataacacctggcttacctctgccctttcataccattcttccctatgcaagcacagtcacccctcctcccttcttaggacttaacctgtttcttctgcccagactcattgctttgatttcctgctctctcacagctagttttttagatgttacctcctcagagaaaccgtctgtactcaaaagtaaggtagctagtacttagagtaattcccccgtccccaccaatatcaccctgtttatttcctttatcatgagctataattattatgtacgtgttttatatatatatgtctctttccactagagtttaagcttcctgtgaggagaggctttgtttgtcttgttctttggggtaaccctcgcccctaacagtgcttatggtaggcattcaataaaatttttttttccacatcagatgggtcatgtgctgacttttcacaaagtttgagagagacacatctcacacatgagtatgaaaacccaatcatcatgcttatgaactaagaagggtagaatctttggattaatgaacacctcgttagagcaagattctaatttaatcagattcgcctgactgaaaaatccatgttcttaacctattattttttgattgctcaaaataatactaacagcattatatcaaaattaactgtgtaatatatgcattgttctatgcacttttacatgtattaactcatttaatcctcattttacacatgaagaaacaatagcacagagaggcaaagtaacttgcttaaggtagcatgcaagaaagtgtcaggaccaagattcaaacatagctagtctcaatctagaacctgttttcttaaccactatgctatcctgcatctagaaaaaggaaagaaggaccggttgcggtggctcacgcctataatcccagcactttgggaggccgagccgggtggtcacctgaggtcaggagttcgagaccagcctggccaacatggcgaaaccctgtctctactaaaaatacaaaaattagctgcgtatggtggcatgcacctgtaatcctagctacctggaaggctgaggtggggagaatttcttgaacccgggaggtggaggttgcagtgagc

SEQ ID NO: 58738 - DNA, 1139 bp, Homo sapiens
ttccccactgcagttactggacgcaccaattaggattcttttcttataagtagcagaatccaattcaagttaagggaacaagggagatacaaggatacttcaggaaatgcaagggcaggaacgcagccaggcctccagagctggcagtgtcttctctccatggactgggaagcagagagattgagttgcacaaaggatgatcccccaggccgcctcctccactcaccagtgtttcagttttcttagaccaacccaaatggaactggaattttaattccacttccagattctccatagagaaagatctgattagtccagcttgatttggacatcgaccctagtcctgtgaactgtaaccaaaagcacaaggtcatgtaaaaggccaggggtctggggactgtggaatgtggacggaaacctagagctgctgaccaccactccaaatagggccttgccttgaaaatggccccatagcagtgatcgctgggcacaaactatgttcagccgcaactgcagtttcaggttctggaacagttccagaaactcaggagggagcctgagcagtttagatggtctgggttttgtggacttttatctcatctctgtatctgatcttattctcctaatcaaactgttggtttcgagagcccagtgtgaaggcctcttctgagactgtcctcttttgaataggtatgaactgaagcacgcttcacatatcagcaagttacccaagggcaagcacagtgtcaaaggtaaagtgtttccaaagctgttgctacagcccgaggcaccctggacagcacagaagccgggggcttgctgtcctgagaaggctgccttgtggctggctgtcaaacagctggagattcattttatcttttcgaggggtgtgtgtgcgttgttgttgttgtttggggggtggtggtggtggttaatatgctgcaactgaccatgattggaggttcattttatttatttttgtaaaaaaaaaaaaaaaataggcaagctctatagcaggaggttcatttttaaaaacagttcactctctgtggctgcagctggtatcacagatgccacaggagaatcttggtgcaggcaccagtaaccagatgcacgggtttcggctttaacctaacttg

SEQ ID NO: 58739 - DNA, 1056 bp, Homo sapiens
acgggtccaggaccaccaactttgctgggatcctgtcccagggtcttcggatagccccgcctgaagcgcccgtggtatgtgcctggcctggcgaggggtgggcaatgcctgtctctgcaggtgtctccataaagaactttgagcaagaggtctagttggtttagggggattctgccagacatcctttctttgggccttcacccttttatcctcctgaccctaaccctgtcaggggtttcaaacacagtttctggaacaaaggaggcagagcatccaggccagggcctgctgcagatgctaatcgggtgtgttgacaagcaaagaacagacacgtggctacaggccaagctgagtccaggcttatctctaccacttcccagccgggccacctctgagtgtcagtgtcttcagcaggaaaacgtagcgatgaatgagtaaggctttacctagacacgagggatcgtgatgccacctgctggattctagatgggtccacctggacaggaccttctaagcctcttgtttcacagttgtagaatgaggaggagagaagtttaaatgattctctctggggctgtgcagtagtgtataacgggcaaatggcctaccctttgtgaacctcgtgtttcatttacaaaagggaataaaaataccagcctgcattccttgggtgttgacaggcgctagtttaagtaacactgatgagctcattccgtcctcatggcagctccatgagactgtgttccccatttgagaaaagaggcaagtagagtccagagaggttacgtagcttcttgcagctccttggcacctggcagagctaggatctgacagcctggcttgtgagctaaaactttggtatttcctcaccatgggcattgtgagaattagaagtgatggattgcagcacttagctgggtggcttgctcaagttggcactcagtgaacagctgctcctaatttcccatcagaagattctcagctctcccttttccgaccttccagacaggctacatgtttggtaaagggatctatttcgctgacatggtctccaag

SEQ ID NO: 58740 - DNA, 1112 bp, Homo sapiens
gggagggccaccctcttgcccttgttttgaagttgggtttctacccacattgatggaggcagagctgtttttcctgcccctgttctaccaaatccactggggaaagagctgttggagagggacagcctctccctcataacagcatcttcctccccattttccctccctgccttttaagacagctcctggctcaggacccatttgtctaaagtaccttcactgtaggtcccaaatgtcagcatgtacgagaggaaagacagttcttccacctctcaactcccccaggccacaaggccttgttaacattccagaaagtccttatgagctctcaatatgtgcagcaggtaacaggctggccctgaccagcaggagggtttgccattcactgtgttggaccttctctgcatgtaggttttctctgccacctgggtgagtctgtctcattcaccatgatacctaagtcgggggctttcttttgctcctccaggccaaggtggaaatgcttgacaacctgctggacatcgaggtggcctacagtctgctcaggggagggtctgatgatagcagcaaggatcccatcgatgtcaactatgagaagctcaaaactgacattaaggtaacagggtcaggccttcctcaagcatcttaacctctcatcctgagagcagcggtcccaaacttccatgtgtgttaggatctcctggaaagcttgttaaaacacaggtggctggcgcccaataattcacttttctaacaagttcccggacattgctgctggtggtcctttgagaacctttgggcgtttcacgtgtagataatgcaccttgtttgcaaggcagccttccaagccagcacctcagcttggcgtacaaatttatttttgagggtcttaccaaaagttcttttttgtttgtttgtttgtttgtttcctctccttaatctagagaggagctctgtttttctaaacccttgtagcgtgaacttttagaagacttattaccggtgtccatttcagaagtggaaatgcttgatggcacctgtaataaaaacacaatgcttgcgttcatttttctctggtgctgaagtggactgtgttggcacacacagtctct

SEQ ID NO: 58741 - DNA, 1053 bp, Homo sapiens
ggaagtgtaagagaaaagagaaggaatttgtccatcagtttcatgtcccattgctccaaagtttgcttctacagctgcccagcacttccaggttgggcatgagtgggcactagacaggttcccaggcagggaccagcaaccccagggtgggtcagcccatgcagacgctgcagtggcaactagaataagaatctggagcagccaagagaacttcagggcaggcacaggaagagtctgacccatgtgcagcatcaggcacactcatcctggccactgttttccacacctttttgattaacactcagctttttttgctggtggcactctagcctgtgtcctttgtctgcagtccagccccacagacgcagataccttgcttgagttgttgatttgggtctcttagcaatgtgcttttttcctgaaggatgaagaggcagtgaagaagctgacagtaaatcctggcaccaagtccaagctccccaagccagttcaggacctcatcaagatgatctttgatgtggaaagtatgaagaaagccatggtggagtatgaggttattgcgctttatcattttatctgtgagcatttgctgtggatgattatttgctgagctagtgaagagctgtctgcctgttcttgtttctgtttcaaaaacaatacattggctgtcagcttcttgtacctgtccttcaatcttaaattgtgtgagtgttggggcctggagtggttgcacttttgcagagggttgtttgatttgcagtgaagcatgtgttgtgttggagagagttgttcctggtccctagtcccctttgtactttttttctgagacagagtctcaccatgttgttgcccaagctggtctccaactgctgagctcaagtgatccacccacctcagtctccccaaatgctaggaatataggtgtgagccatcgtgcccggcccaccctttgtatttttccccttcttcatgctgtggcaaggtgtattagccatgcttcctttgtggcccaaccaaaccaaccaactggagttaccatgggaagtgcaagat

SEQ ID NO: 58742 - DNA, 1023 bp, Homo sapiens
catcatgtcttggccttggatctgagttgaaagtttcattatttttagggtacagctgtaagggttgactccttgaacacatgacttccagatagtactttgtatttctttggggagaggactagaatcatttttatgcaaaggtctccagactccaggattcagtcctcaggcttggctgccagaaccaagtttaaactattctttggcattttttgtagtcaatatgatttgaaagtttaatgaaaagtaaaataaagaccctttattgttatagcagttgtgtttgttctgtgttaatcaccatccttttggggtgtgtaaaattcttccccacgtgaatgtaatggcaggaaaggggagctcctgaaatgggacagctgacccacacatgtgtatctgacaccctccttcccactgcaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggtaaccacataatgcccttacactgtctgcttctaggaaaaggaagggacaccttattctagaaaatccacatcgtggatcaggtggcatcatagtaaacatactaccaaatgttgaaaggagaataatagtccttcacaaattctcccccaaaaatagaagaaaatacttcccagctcattgcatgaaggccagtaccaccctgataccagagccaaagcagcacaggagaactacagagcagtttcctgtgaatagacatgcagaaaccctatgaatagagatacaaaatcctaacaaaccgaatccagcagcatagacggatctatacaccactcccaagtgggatttatcccaggaatgtaaggttggttcgacatttaaaaatcaatgtaatatatgaa

SEQ ID NO: 58743 - DNA, 3668 bp, Homo sapiens
atcagcactagtgagaaatgccccaagccaaccaagacagtgagagcaacgtatttttttggcaggagaagtgacccgctgcttgtttactcagagacatgtggcatagtctattggtgaaggtcacagtttggtgggtggaggatgagggttccttccttgaacataaacctgttattgacttccttttcatatcctgagaggggaccagtggtcactgcagtgtgtgctggtggtcatcccgagtccactgtgctgctggcagcctgggtccaggtgcccacatgaagggccagttgggggctggcattctgacccctccatggagggttccctcctctgctttcccctgacttgcagttcagcatgagtcaataattttgttctctggagacctcagcagtttcagttaaactgtcagtgtttcctagttgtttgccctcacagggaaggcaggaaggacttttccttgcagctactccagttctggacgggtgtcacctgcactgtgttgtttgctgtgaacagaaggcacacccctgtccaggcctttctggcctgggtcagtgcacaccaggctgctgcttttctcctagaatcagttagctcagctccgtgtgattgtgctggccactgctttgagggactatcatggacatgtctcattttaaaatggggttaattcataagaattgcagtttgtttgggagaataacagaaggaattgggggttcatgtgaccttacccctcttcccatccgactccagcctcctggtccctcgtccgcagatgcagccttcctagcctgaccttggcgcggacctggggtaacccgcagctgcctggctcacgccgcgaggctggcctggccatggagtggcattttgtggcttgctccctgcccagtcctttctgtgctgagggacatctgtaggtactcaggtggcagcttgctgtcccgtcctgttttctcgcgagtgtattttcataggcttttcccaggagctcgctgcttggctcacctgctcctccacctccccttactggggagcagcaccagagctggccttgctgaatgattctctcctttcatcccagataagccattatccaacatgaagatcctgactctcgggaagctgtcccggaacaaggatgaagtgaaggccatgattgagaaactcggggggaagttgacggggacggccaacaaggcttccctgtgcatcagcaccaaaagtgagttgaatctgaatttgtgcaacagggacaatgcttctgtatcttatgattgtgatgacgagtaagtgaggaagagtcgaacacagcgctgaaaaactggatcttaacatcatcatcgctgtggttctttatgaagggaaaccagtatttgctctcagtgttgctgctttgtactgtagattcacatgcattgcgtgttctcaactaaagacggtaagctactataggttgagtctccctagtcccgaagcccaaacaaattgcctcaaaattcaacactttttgagtgacaacatgatgctcaaaggaaatgttcattggagcatttcagatttcagagttttggattagatgctcagtcagtaaatatgaagcaagtattttaaggtctgaaaggtttctggtctcaagcatctcggataagggaagctgctcaacctgtattctcatcacttcgcactgctctgtaagatgtgcatagatatctgccaaaacagaagttcaaggttcaagtatgtttggaaaaggtagggtaaaacaaagctaaacaggtttctgtgtgggtttattatgctgattaccactgtaggtcttcaggaaccagagaaatagaatacaggatttcccatacatatttgacatcagggtgttttttctttggagtgtttgttaacatcgtgctgtagaatggtttggagaaggctgccctggctcatcataccttagaaaagggggaatgttgctgataaaaacactcttgggagcattagacttggaagcaaaggagagctgtgaatgctgagggtttggaagtacacactaaatataactgtagtaatttgaagtttcagttttgttttaaacttgtattttggttttttttcctttcaatttgaacagaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtgagggccccaagctgccccctccagggccaaaagccagggacattggtggccaggttgttgtccacggaacctctccctttgtgtccctgacatggcctgttgagtgctgcagagcaggacacagaatggcaggcgctttggggtggcgggagtagtgtgtatatagatgccgagttgacagatgatgggaatgagaacaactcatttgccttctaccttccccttactttttagttacatttaacttcatgtttacatttttctgttctcctccaaggtatcaacaaatctgaaaagagaatgaaattaactcttaaaggaggagcagctgtggatcctgattctggtaagcaaacaggactgccagcaaagtgggctgtgccgccccccaacccccagctgactaggagcacacatccaaatgcccgcagcatacctggggcagtgtggtcgtgcctttgtcctcactcaggcctccttcaccagctcccccagtcctgagaacacacatttgtggggagcctcccgagggtggtggtagtgtatccaagaggcgtgaacctcaggcctgcagatcccttctccgtgagagtgctagcacctcaaggggagagaaaactgtaggtgcttttcctctgggacaggactggaacactctgcgcatgtcctggagaaaggtgggaaggtcttcagtgccacccttggcctggtggacatcgttaaaggaaccaactcctactacaagctgcagcttctggaggacgacaaggaaaacaggtgagttctgcaggtgtagcctggttgtgcagagacatgggcccgtcctgcattggttagtgctgtgccatcagccttgtgaaacccgttaggcccagtgcctggggaatgaaatctaatcacagagatcaaaaacaaattataaggcctttgcttaaaggggagaaagaagccacttactaaccagtagcgttgctgtccttgtacagttgtcccaaggtatggtttcacatattcttctgctggcttttctttttgtttggtgttttgttttttgttgttgttttgcaactatttgttttgttttttgaaatagtctcgctctgttacccaggctggagtgcagtggcgtaatcacagctcagcggagccttgacctcccaggctcaagcaatcctcccacctcagcctcctgagtaactgggactataggtgcgcaccaccatgccttattttttatggagacgggcctcgctgtgttgcccagactggtctcaaactc

SEQ ID NO: 58744 - DNA, 1801 bp, Homo sapiens
aaagattaaaacttccattttcagaagagcttaaatacattcctgcatgatactgaatataatataccatcaaggaaattggtgtttgcgaatcattcctactctaagattggtggagaatggccataccctgcctcctctagttgctgataaacgtgggccgtgggctcagcctagcacctccaggctcttacctggtgtttctggggattgatttctgagggttggttccaggagccttggtgcagtctcccccacacccttagggcttcctcatcaccttccacagtattctctgagagaccacacagcaggtttaatttggtgtccacaggagcatgactgggagtcaaatcctgtgctaatcacccagatttgcaggggcagctcgctggtgcacaagggtataactggaggctcagcatgaccagggctcctcctccagttggattcttcctttgaaaagagctagcctctcagccactgggtcttgtccataggctcagaacgacctgatctggaacatcaaggacgagctaaagaaagtgtgttcaactaatgacctgaaggagctactcatcttcaacaagcagcaagtgccttctggggagtcggcggtgagctgcctttgtgttaagtgggacacgcatgtgaggccgaccccgtcgttgtggagtgactgtcccaatggagtgtgggaggccctccgtgtgaacacctgctggtattaattgcaaggagtataaatcgtggttgtgttgcacggtcatcaccaccatcgtggtcaccatttttccggggtggatggggccggcattcacacgccccaccagacatcttccacatgttagtgcttgctctagagtgccaggcctgtgaagagaggagagccccctcctgaggggtggcatgatggtttcccatcagtgtccccagctggcccttctctgctgtcattcttgggagttggcttggcactgtactttctgcaatgccagtggttgctttcccttcatttctaaatcactgagggttgggggcgctgcaggaacacttggaaataaggtctcctacaagaatccaagctccattgtaaaccaagggtgggtggggtgttaagagccccatagcaagcccacagcaagaagcctctcttctttgtagtgagtggaatctgtgcaagttcctccatcccacattagtaagtgtccttttttgtagtcccgcatttgccctctgacatgtttctccactggctgcagatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggtaaggggtaggggaagatcctgggatctgttgggagaaaaacctggccccactttctgcgcttgtttatacttcaggtccctgagattgcagggccatgttcctcagacttctttacagctgcgtcatcctgtttaccagaatataaaattacatgtttgcaaactacgcaaatgtagaaccgaagctcctctaagtatggagtagaggtccatttggtgtaaaatgttgcttgcaaagaccatgaatagtttttatctattgaatgcctcctatgtgccaggcacagttctaggcttgagggacatatggtgaagaaatggatagtaattcctgctttctgatacaaggttttttcaagg

SEQ ID NO: 58745 - DNA, 1003 bp, Homo sapiens
accccctagccatgggcttacctctagcctagtcccggctagaaccttccaggccaggagatacatgggtttcttttttttttttaacctcagacggggtctgagccctggattcttgtaatgggttgttctgagtccctggaacaaccctagcccctctccctggctgggagagtatgttctgaattggatggtgtcttctgccatcttggctgcaagtactccctgagtagacagtgatcgcctaagggcactgagtggggcaggggttagggagtgacaagtgtgagtaggccctacagggagttgatagaatgacattaagatactgcatcaccgcaagtcattgggtgtcagacttttaatggctctggctgtctctcatatcctgtgtctccttcagaaagagaaaaggcgatgaggtggatggagtggatgaagtggcgaagaagaaatctaaaaaagaaaaagacaaggatagtaagcttgaaaaagccctaaaggtgagttctcagctctgtgtctcctttcgacattctgctgtctggattctctttctcattctgggaagacaattcaaggagttgtgtcccacttattaagacctttagcaaattgatggcagttattaaatagcatggcttttccccagattctttttcctcctccaaaagaaaccatttttatttggaagagaatccacattaggctgtaggtgtctgacctgcagccaggcttgagcaagggctgagtgctctgtttccgctcaccagcctcatactgggatgacagagattcatgctttggccaaattatgcacaactgtacaccctgcacctttgtggtcacttgcaaactttggaaactgaatacttagaggatgccaaagattcttagcatagacaaatggcttgaagagatcaagtgtctccacattttttaaatgaagatcttcatttttaaaaaaggaatagactgataatgacagaagaaaactatccat

SEQ ID NO: 58746 - DNA, 1276 bp, Homo sapiens
atgcctgccccaggtcagcagaaacatcttaaggggaatgttagcaattcttcacatgtccaggcaggtaggtaggttgccagccatttggaatttaaggaaccctgagtcttgagggtgggtaacacacaatccttgatgacctgagagagctaaacctctcaaaagctcatgagtcttcaagttggcgggcaggccttggcttggaccctcagctcctcactggctggagcacaggctgcccgtatcatgttcactatccttgcttgtcgctcccttggtaccacatatggtttttcctgcagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaagggtgggtggagcactgcggggttgccctgggggttcagtgaggggttcaagggaggcccaaaggccctacaggttccataccactcctctgtttcccttcgctgactgtcagtaagccagggagatgcaaactgaggaatggtgacagcagagatgtgggggcaaaggacagggtagggaaagacagccaggggttcccatggcctctgctgagagccctctcccctgtgagacctgcttcctggtggtctattccccttccaacatctgagctccatggacaggctaactacactttcccaccacaaccctttagatacttaaaagaccaccttccttccctgggtatttgttgtgcctgggttgatcactattcggaacaatgctgggagaatggtgaccatttttagttaggggatgggcagtggataattttcctggcttagagttgagaatgataagggttttgcatggtgttaaaatttagaatgggaaggaccatcagtgactgtcttgaatccatggacacctcttggtctctccagtttaccctctgctggtccctcagcctcagtctggagaactgcttgttaacaagcacaccaggggtggtgtggcagagcctggtatgcaccctgctccttgaacggtgactgggcaaccatcaagcagccatcacacattatctcagttcataacgcctgttcattgcagcagcacatggggctctagaatgtggaagaaaactgaaaaatca

SEQ ID NO: 58747 - DNA, 1123 bp, Homo sapiens
agtgatgggaagatagcttcgtcttattcctaatcttaggcaagaaacattcaacctgggaatttatttttataataagagaagaatccagtttttgtcccaaatggctagccagtgatccccagaactctttattgaataattcaaccttttcccactaatttgaaatgatacctttagtacatatttaattcttacatatacttgtgtctgacttatatcaaaatatttcctttaattcaacactttggtaaatagaagtataatggaaattagaagccttagtgagacgtcagtatgcttccaggcttttaaggtaagcacctaataagtgctttctaaagtgtgggaggggcctccagagaaaggggaggagatggaatgtcagacagctgaccaccccctgatatgctgctctttcaaggagctcagtctgagaagggtcatttatctccagaaaagaagctctattagctgaccacggttgttacaaacagacagatgagatggaccaatcgtagtctcccaaggcataaggtgtcctagtggaaggatcctggggaggtagaagaggacggggctcctctgagctgcattttggggctgttgagatgagcattgctgtctgtttgattctccaggcaaaggccaggatggaattggtagcaaggcagagaagactctgggtgactttgcagcagagtatgccaagtccaacagaagtacgtgcaaggggtgtatggagaagatagaaaaggtaagatcttgggggcccagatccctgaactttatggattgcttgcaatgatgttattggctatctcaagagaaaagaagaaatgggggctttagggtgctagctcaacgtaagtgattaaaaataaagtgaagacattagtattgaccagatacgtcagtgacttccagacaggtctggtcctccttatcacggtccagttctcatgtatgtatgcatctgctcttggaaaatgttaacaaaaggagtctcttttggacccagcagtggctggggagagactgtttgtctgtgttttatggtagaattaggtataaggagtgtgtttaccctgttatgagcctccagccttctgtttaatcaaag

SEQ ID NO: 58748 - DNA, 1714 bp, Homo sapiens
gccgaggcgggcgggtcacgaggtcagaagttcgagaccagcctggccaacatggtgaagccccattgctactaacaatacaaaaattagccaggcatgggtggcacgtgcctgtagtcccagctactcaggaggccgaggcaggagaatcgcttgaacccaggagacagaggttgcagtgagctgagatcgcaccactgcactcagtgcaagactcggtctcaaaaacaaagccagacagtgctcgaggcctgggagcagaacctgaccctgtcacaatgaaaggcctagtgggaagcaaaccacctggagaggggaactgtgttccctgtggccagacttctcaggtcctacgcctgggaaactgcgccccagaaggccagtgagcagctgactccagctctaggcatgctgccccgaaccatccgctgtcacagttgcctcaaagacctccattcattccactcccatctgtgtggctgctgcaagcttgacacttttttctgacacactttctctgctttgctcattatctgggacttgttccttgttattcttaactgcagaggcacttaaagagcccttttctggggcacacaggccctttgagtccaggcaagcctggagcagttgtctggccattcccagcagatgctgcaggattgtgactctgcacaagtgtcttctgtgcatttcactaggccatgaggcagctcaccactaaatgtagcagtgtgtggtcaaaagggacgtggggcagagctcagtggtaaaaggccacctttctcgtggctgtgtttggtgtcctaagagaatgagctcaagaacagtgggctacagtcttctgacccttggggaagatcgtgagaaggatgctgcagctcttcatgtgagagcggaggctgtcctcctttcacagataggagaacaaaagtttcatgtgctatcccactgctggggctgggactggggtcgaggtcaaggtcaaggtctagtgggtctaagtcaaaagttaactgcttacttacttccctctgtttctcttccttctagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatgatatttggtattttgtttttccaggtgcttggaatgtagcctttaaagttgttttgtttttaatatactttatttttgttcatggcaaaagtaagcaaagaacaaagagtttccagtaccccctccccctcccaccacacaggctcttccttgtcaacacctcccaccagagtagtacatttgttataattgaggaacctacactgacacatcattattgcccagagtccagaaactcctgatgctctacattctatgggtttggacaaatgtatgatgacatgcatctgccattatagtatcatacagagtag

SEQ ID NO: 58749 - DNA, 1006 bp, Homo sapiens
ttgatagattgaatccccttctgaggtttcctgagccttctgtgaggtggtgggcttgaaggcccctgtcatttcccaggggctcctgcctccagcttccagtttgccgatgtctacctttgtattaataattctggttctcatctgccctgttcctcctcgcttccaacatattacccaagcttagtgctcatggtcaaggtagcttgattttcctcccttccatgagctgtaatgtgttttaggaatgaccagatatccctcagtggattttcagtacttagtacaagggagggcgacatttaccgagtggatacccaagtgccaggtgtacttccgttatcttatttcacaatatgcctgtcatcttggtgtcctcggggcatacctaagtcagtacgtggcacacagtgcttatttggtaggcattttttaagttctaagcactctgttaggttttaaggacacagaatccacctttgggaatttccagtttggttaaacgggaaatgactggtaaacaaacgttaccgtaagagaggatggatgccacctgatggagctgtgctctaggcattgtgtgcctaggagtccgagatgacccagctaagggtggaagcttgattaggagtcgttaattcacagaagtggagcagaaagatgagaatagggaagtagacagggcctacaatttgaagagccttgttgcccactaaggaacctagaacttactttgaatatacaaggcagcctgttatgaagttctcactcctggtgcaggagctcttaacccagggtctgtgggatggtaggtagaaggcaagaggtccatgagtttagataagaaaaaattgatatctccatctccactaacctctagataaaattatttcctctaatcataaatgtaagcagcaaagcaaaggcatattagcagtccctatttttttttcaccagtgataattacagatattttcatatcactttacagttggaagtttttca

SEQ ID NO: 58750 - DNA, 1053 bp, Homo sapiens
tgagcgcctgtagtcccagctactcgggaggctgaggtgggaggatcgctgggctcaggagttccagactgcagtgagccatgatggcggcactgcactccagcgcggtgagactcagtctcaaaaataaaagggggaggggttgggggtaaaattagttgtgaaatcaagtaagacttcctgggacagaacaatcaaaggggtggcgccgggtcctccaaagagctactagctcagcccaagccccgcctcggcccccagggcagcggcccgcagagctccacccggcaggcgcccgggaaactccgccccccggccggcagggggcgcgcgcgccgccggccccgccccgtggacgcgggttccgtgggcgttcccgcggccaggcatcagcaatctatcagggaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcaggtgcgggccgctgtgcgggcggcggggcggggacgcggcgccccgggttaactgtgtccgggaaggctgggggagggcgggcccagggagcgagcgggcccgggccctcggagcggcacttggggcctatggggccgcggccgcccctcctcccgagcggcccggccgacccttccggaaggttttgctgatgttgcaggaaaagcccgggaaataaagtctgcagctggtgttgcctttcgctttgtgaaaacgaggagcctcttctcttctcctttctgggtggcggtgttttattactgccgttcgcctcaggggttgggggggaattgtacatggtctctttaagctaatctgattttgacctatcttgttctg

SEQ ID NO: 58751 - DNA, 1033 bp, Homo sapiens
ggcagtccgattcagtgaggctgcaccttttctcctggatcaagagccaaccccaggctgggtggtggtgcacacctgtaatcccagcactttgggaggccaaggtgggaggatcacttgaggctagaagtttgagaccagccggggcaacatagcgagactcccttatctactaaaaaaattgtctaaaaaaaaaagaaaagaaaaattagagccagccccagctggaacagagtctgccgtcccctcggaaagacgtgccttgactcagggcactgagctgactgcagctgttgggcaacacacgccccaaaccttcatccaccaggcaggaaaggagctgctggtgagccctgccccaggcctcggccctcatgtcgccttccctcccacgtaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaaggtgaggccggcgagtgagggcagcctcgggccccacccgtgcccacctcagggggcttggcttctctcagcgccctttggaagctgtaagcttctccaggcacaggctcagaatgtgggtggcccgccccaaggccagacatttggagacatcagcctattcctcaggcgggatggctgtgtagggggctcaggcctcagagcagagtggcttctagccctgcccagctgtcagccctctgccgaggactctccatttagcccagacggtgcctggcaccgaaagccaggcgagaggcacctgcgggatgcctgtggggtagctggttcattctgccatggctgcaaactgggactggcagacaattcggggaagggaggagcatgctgaccgcctttgatgttggagccagggtctctgagaaactgcat

SEQ ID NO: 58752 - DNA, 1034 bp, Homo sapiens
aatggagagtcctcggcagagggctgacagctgggcagggctagaagccactctgctctgaggcctgagccccctacacagccatcccgcctgaggaataggctgatgtctccaaatgtctggccttggggcgggccacccacattctgagcctgtgcctggagaagcttacagcttccaaagggcgctgagagaagccaagccccctgaggtgggcacgggtggggcccgaggctgccctcactcgccggcctcaccttgattccctcgatcctgaaccccagggtggccgtggagctgatggtctcccgccactgcatgtaccgtggcttggtcacagcccgctgtgctttttcctcctcggtgggggcctcggggtccacctcgatcatcttctggtacatgtccttccgcaggctgggcttcttccgggccttcgtgagctcctcctccaggtaggtcctacgtgggagggaaggcgacatgagggccgaggcctggggcagggctcaccagcagctcctttcctgcctggtggatgaaggtttggggcgtgtgttgcccaacagctgcagtcagctcagtgccctgagtcaaggcacgtctttccgaggggacggcagactctgttccagctggggctggctctaatttttcttttcttttttttttagacaatttttttagtagataagggagtctcgctatgttgccccggctggtctcaaacttctagcctcaagtgatcctcccaccttggcctcccaaagtgctgggattacaggtgtgcaccaccacccagcctggggttggctcttgatccaggagaaaaggtgcagcctcactgaatcggactgccttcactttcactccaagcccatcggctggcctcacaaagcccaaggagctcctcctcgggagacccccacaggaaccagcagaagaaggaagacggaggcagggcagcagggggtgtcgggggtggctggtcctgatcctgctgctacggtggagctaagagaggggactggggg

SEQ ID NO: 58753 - DNA, 1058 bp, Homo sapiens
agacctggaggttatgcccgtttgccctctgatttgttgaaggcagtgtttccgtacagcatgactgaggatgcctgatgggaaggacccggggaggatggcgtcacccaggaaccgttagcatcacgggagggttgggacttgatccagaaaaacacacagaatcagaccctccccaggcagccccactggctcggggcagctccaaggatgggctggaggtggggaggagtaactgcttgcccaggaaggctccacacccacctgccacagaaccctgggtctgttttatggctctgtgtgttgagcaggaggagatcattctgtgtaggccttggcccccagggagtagattcccatctgctcttcagaccaggaacttctgggaaaaggggaagaggaaaagggagacaaaatgtggcatgccctgagcttccccaaggcgagggcttcctactcccaggtgacgtggggagcagaatcgggagctggggcaggcttctctctgttgcaggggaatgtggctgctgtctgccggctcctcaagctcccttcgcctctgacttcctgtctcctccaatgcaaagatggttggggttttgttgtcagattttttccctcccactacaaatctctctccacattctctgaatattttagctctttcaagtcgggtgccaggggacaaaaccacaccagaggtctccaggcctctcttgagtttcaaagaatcactcccctccccaccaccaccacccctccctcaccctggtccggctgttttctgatcctttctttccacatttctctgagtgaattgaagctccatctttccctgcgcttctggagttcagcacgagactctcttacagagcagggtccaggttgcaacaggcaggggtgacaaatgtcagcagcaggcactgcccaccctgcctgcagaggagcagctaagcaaagctcagaccagtgctcttgtaaccaggagtgcagccacctagggagttccccagctggttcgcatccaagcctgtgaggccgggggttacctgaaagac

SEQ ID NO: 58754 - DNA, 1054 bp, Homo sapiens
aattgtgactggcttcattagcattttgggcagtggccccgagcagctgggctgctgctgtcaagagttgctttgcagatggaagacctccttttctgtcctctcctcttggccctcattactatctaatgccaaagatacagagtgggggtgactcttggcttgggttctgtgggaccctgaacacacgagacaatcctgatggggggcggtcaggagtgggggtggttacattctgagtttcccggaacagctctgcaaaacagctccccaagggatgttgtctaattcgtctttgcatttccagtgccagcatggtacctgccatatataggcagctgcagtttaaaaggctatgctcttttctggaaccctccagggctgcagggatctcttgtatgataatgtcactatttgccatttcataggggcttaatcattgctgaaccctatcagaagtgtgaaccctatcagaagtgctaagcccatttgttttttcttgccagaggcttgggcctgagacttggtatggcttctactttgggtgtatttctcctaaggaaaacgtagggcaattgggagctttatcctggtttctttttaaaaatagttgttacagacactcccttggctggtcctggcaaagactcttgaggttgtaggagctgctctttcctcctccccagacacctggggaagttggtgagctccttgaggaaactcggaagcagtatctttttaatctttttacctccatccctatggtcttgagtagagagccacacacaaaaggcccctggacaatgaggagcaatggcgatgctgcccagctagagatccttcccacagttggtatctgtgtggcccctctgtgccaagcaaggccacaggagggcaggagggcactgtgtctctaggtaagtgctccctacagtgctggaactgctggggctgcagtttcatggaacccctcagttttgccagcctcaagttgacaagtgcaaaagcagatgtggtttctgagctcattcatgttcctttacagcgggcagca

SEQ ID NO: 58755 - DNA, 1391 bp, Homo sapiens
gcgtgcatcaccacacccggctaatttttgtatttttggtggagatggggtttcaccatgttgcccaggctggtctcaaactcctgaccccaggtgatccacccaccttggcttcccagagtgctgggattacaggcgtgagccacggtgcccaataccttccagctttttgaaagagttggaagaatgaggagacctaaattcaaatactgccctggttaactttttaactgtggaccttgatcaagccagatcaaagtttgatttacccagtggttttcaacaggagtgattttggccattaggggatgtttgacaatgtctggagacatttttggttgtcacaactgtaagggtggtactgctcctggcacatagtgggtagaggccaggatgctgccgacatcctccagtgcacaggacagcagagaattacccagttcaaaatgttcatattgctgaggttgagaaacactgatggctaagcctgagtttctttactatgaaatgaatataataatacctagctccttgacttggaggctcaaatgagataagatgtgtaaaagtacctgataaaactgcaaagtgctctgtgggtacccagttcatcagttgatcagttgttattgaggacacgccataccaattggtaatgttgctgtcactaattaaagaagtcatagatagaaaggttgactaggatcagtctcagaaaagaaccttctagggtcctaataaaagcaatttccaatgttcttaagggtctgttatcagtagcctctaggggtatagttgttctaacagcttcaaaactgttcaaccatactttgacacagatttttctttttctgtcttttcatgcaccttggtgaaatctgaacacattctttatggcattcttcctgattttgtatcctgcatcaaaagaagaaatgagattggtttgttgaaactttttcttaatgaacacatgtatatttttagtgatttctatctttccctgtaaatgctcacaaatcacttgttaggtaatccagccctatgtttgccagtctgaagcttccagaatccaatttggcaaaatgttaggcaaatagttacccatctttagtcctctgacacctcttaaaggttattagcaatggttctgtgaatgcagagttgagttctttcagagctatccttgaagacaaggtgtgctgtgagaacccattgtgggtagggccgcatggatcatttgaattctcttttaaaagtgttgatgtggagctttttgagtaaacttgagttatccaggaaaggggaataaggtacaaatcaccttccctctgacccatggtgtcagcacaggcctttaattcaaaaacgtgggactggctcctatgacc

SEQ ID NO: 58756 - DNA, 1038 bp, Homo sapiens
cagcctgggcgaaagagctaaactccatctcaaaaataaataaataaataaaaaataaaaaaagattgtactttatttggcaataatgtttttattctgaattattctactaggtccctttatttccttgtgaaattgttcttaattgcgctggcctggaaatagagcccatatggtactggagggtgatggtttttcataatttttcttatgcaaccacccttagtgatgagtccctagaggattgaactgtgcctcattctgtggactggactttttggaaacccctttttgagcccccaggaagaaatttggctgagagctgatgcctggatgctagccagctggctgctggccatatccagccaccccagtcccctggccatctgtgcacctcggcaacagagtggcgactgacacacccaggcccagaaagccagacagactggcggctggaaacttcatggaatccttgtaattagaaatggaaaagacctgttagctcgagtggtatcctcctcctcctcccacaggccccaaccagctttagaaggtgacatataatttgccctgtcacctggagcactcaactgagttttctgggtcttatctgtgaaatccaagagctggaccaaatcagtgttttttaaccccttttgggtcttatgccattttggaaagtggtagaaagccacacaccctttttccagagagaggcacatttcacaggccatgttgccctttcaggacattgataacaagaagcctgtctagatcctagcccacagtcttcaggtttggaacccaaagacttgttgatctctgaagtccctctcagctcagaaaacccacattctagaaagttttctgtcaagaaccctaggtatggaaatggataaaagggagtctcttgtacttaacttggaggaaaccactgtccagcccaatgggtttcactatcaagtatttttatttattgttttatcatttattattttccaggattgagttcaacttgtggtaccacgttctttccca

SEQ ID NO: 58757 - DNA, 1018 bp, Homo sapiens
gttaaaggaatgggtgaatgaatgaaggagagaaaaaatccctgctgcattatctacccataaaagaaatacagaaccatctggaaggtgaagaacaaagaaagggaatcaagccctgggaatgcaagtttgttgcttattcctgtgactgctgccacagggataagggtgctaggcttgggtttaggagacttgggtgaaattccagtctacacatggctagcaagctctctgaaaaatggggagagtaagtgtgacctcatggagtggtgagcgttcaattatgtcatgtttataaaagtgcctagcactgtacctggtacatagtaggggtgtagtagtagtggtttccttttgttcagttgcagggttggggattactttaaggcttagactcaaagcgataggaatgaattgcttggtcagcagaagtgcacactgcacaccagcctcaagggacaaggtcaaccacgacacgtttgcaaagtgtttgtgcggggaagaccactctgatgtttcttacttaaaggcagggtcttccaactttgtctgatacggaatgacttgttacaatcatttcacaggcaagccaacactcaggcttttgactaacttgtctggcgtgtttctcaacaactccattaagaattcactgttagaaatctgatcttttctcctctgttgagctttacttgggcattttattgatttgatatcacttagtagaaacccattcaacaaaaggtatctcttcaggccactagtcaatacagcattttttatttgctgagatttttacttctattttgccccacatcagctggtaagttttataagtaagcaaaaagtaggagctatagacaataaggaagcagaatgaacctctgcaattcatatttatgtatgatttcacttggagtgggaggagatgttttttttccccatctttgaataagtagaaaaacatctcacgtaacctggggtggtggtggtgaattttcagctgaagggaatcctt

SEQ ID NO: 58758 - DNA, 1049 bp, Homo sapiens
ttgaggtgttacataagtcattttcagaatttttgtttttaagtgctgaattgctacagagtcacttttctgattttgttggcacatacctgttaaatgcagttccagattagattagtactggctagtttatttatattcctaggagtattgacaacattgtttaggcttattttattttgtcaggtctcaatttagttatctaaaggtagaattttaaggtatttaatggaaagaattttatatcttggtggaaaaaaaactacagactttggataatcaggaggtggttcagaattaacttgggaagtcttctaaagcatgttgtgatcgcagcctcagggtagaaggttctgtggattttggtgggagaggagaccttgggatggtaggtttatgcatatggtactctcaactccatgacaaggccttgctgtgatttttcttttcctcactgggtagaattggcatcatgaaagatgtatttttcagccatcaggggagctcattgttaacaaaagtcacaccaaacccaactatgaactctttggtaatttgaaaagtggagtggcagctgcctgtttgggattttgtattaccagttctaagatggttgcccttcctgtgttaacttaccaaaccaagtgacgatggtgctacaggcagtcccaaacaacatggagcagaaacaatcagcatctccttcagacccatgggtctggtccatctgactgtggagggctaccttggtgatctggaagaatctgctgacctggtcccttgaccttgtagtcaaatttgactagctaaagttctgccagacagctcttcattttctcactgggcccccttcattcaccccaactttctggtgaagacagcagccctgatccatttttccaggagtaaactattatcttaaatacagttcaagtctccttggttgacagacaccataaatatatatgatctcattaggaagttaggcctctgtgcttcctattaaaaaataacaaaaactaggccaggtgtggtggttcatgcctgta

SEQ ID NO: 58759 - DNA, 1039 bp, Homo sapiens
ctgtgtttgatagataaaagccccaccagctctgtctgaggttctaccaaactgatgtagcattctcttttctggactttgctgtgtctgtccagctactgcacaacgctatagctgcacactctcatgcttgctcacacttgcttacacttgccctcacacatgccctcacacatgctcacacttaccctcctatgctcacacaggttcccccttgctcaccccactcacacaggtctgaaatggcatgttcagcgttccagtcacataaccaacccctggccctcagacccacactagacactgagattgtttctgtgctgccctaccttcccacagagttaagcctttcgggcctcctgtggcgctttcttcatccttgctgaggaatgagtgtgtatgacttggtgtgcaggcagggggtgacagtatatctgcttagtagggatcagacacttgaaatttgctcagaaatagttgcattacacgcccagtgtgcaatggctgaaattcaggcacattcatgcttactgttctctgagatctgaacaaaatcaaattgcactgagcaaggatagtgctcaatcttttgttctttctgacaactaaaaattaaccagcggttgtttacttccctatataattctgtttaagagaatctggaccattgagacaccaggcttaaaatgttgtattaagatataaaagtaccttactttaaaaatagatttttattgatttatttcaaaattgttctgtcagttatatgtacaaaaaaaaaaaaaacaaaagaacgctgggcacggtggctcatgcctgtaatcccagcactttcggaggccaaggcgggtggatcacttgaggtcaggagttcaaaaccagcctggccaacatggtgaaaccccgtctctactaaaaatacaaaaattagctggcgtggtcgcgggcgcctgtaatcccagctacttgggaggctaaggcaggagaattgcttgaacactggaggtagaggttgcaatgaggcgagattgtaccactg

SEQ ID NO: 58760 - DNA, 1068 bp, Homo sapiens
gaatgaactgggagattcagaacgaaatcatcaccccagcccccaataagtccaaggatgttggatagaggggtgcaggtggggaacaggggtaccaagggagatcatggaatgtttccccagcctgcaatctcccctcctaaccaagaagagagcagacgccatctcaaatctcatgatttatgttgatgtcattgtttccagaccctgcgtcatcacagagggtaaccttcccaggctcttccttcgggctactgtctgacactcagcatttcctgctggtgcttgtctgcccccatcccccttggctctactggttgagctattcaaatgcctatgtaggttctgctgaattttcagaacttcacatgactcatcccatgcatttcagtgactgcaaagaaaagtaaaccattcccgctgctaaagacagttgtctttatgcttactgagattatataaatctgcattttatttttgcaacttcgcaaagaaacatttgatgggggagtaatgagggtaagggcaggatggggaataaggtgaaacagaagttacattgcgcacaaatgcgacatgcatctgcagatctttttttgatttatttctaaaaacattttctgggacctggagcctcatgcaaccagatttctttgcctgtgacccctcttctactttaaatatggatcagtacctcacttctctgccccattctcttgtcttctctactcttctaattccactgcttcagcctctacctttgctgatgcctccccaaactgcccagctctcttctctcctgaacatcagccttgtgtttaagacagcccaatgttaccaaagccagcaagtccaaattaaacccagtatgattggcccctttggtgtttcgattctcagtgaaggacctaaccacaacacctgttcatcaagctacaaaccccagaatcttcagtttatcttaagagtctggctttccttcttattcactgttcctcactccacctgagttagcaagctctctccattctactccaacttccaatgtgcctcaaagtcaccacttcc

SEQ ID NO: 58761 - DNA, 1038 bp, Homo sapiens
gcctgaatttctggagctctggcgtctgcaaggtggcctgggaaagagtttatggaacagctacagagttctaggtaccttcatgcagttgaggattcgagcccgtagaggagaatcgcctgcagcgtggccccacgggaaagcacattccaggcgcattccgaggatgagcggagaccatgtatggaaaggtagtgccaggactgtcatgagtgtcccagggctcgggggattcacccgtgaactgtgaggtcttggctctgatagacctggttcttatgctttaggaggggagacaaacagtaacagaatagacaaatgcaagagagagtgactctggacccctcccacaacggcctcctaacaatggagcatgagcagatacctgcaggatggagggtcctgtgcaggctttctgggacgcagactggccacctcccccaggccctgcaggcagccactgttagcaccgcctgagatgtgaaccttttctcctcccccagctgccatggtgtggacggttggcatggcgaagctggacccctcctctcagggtgccctccagctcccctacgacccggagatgggtgagtatcttggggagctaacagcctctcatcactggggggcagctccctacctgcacccagctctgctcggcctggcttccctgagaggcatgagttcaggaggggcagagggaaaggtccgttgaaaaccagccggacacatgcggcttgaagattcagcaagtgttggaccctcggtcctctgccagcctctgttgcatcgttctgctgggcgtgggtgggtggagtgggggaagccctggtgtcaggtgctggtgctcagggggaccccttcttggagctttgttccctggtaacactctgaccagctgttgtttctctctcttgttgtcccctcctcacggtgatgacggacatcttctcttcctggacacccagaagaagactcctatgacagttttggggagccttcataccccgaagtctttgagcctcccttgactggcta

SEQ ID NO: 58762 - DNA, 1003 bp, Homo sapiens
caccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgcacacatttctttaactagaaagtttcctaagcaaaggagttaggagagcagggtggcctgacatctgccagccctgagctgtaaggctgtggatgctgagcaggtccctggactcagttgtgcacggtggcacagacactgccaggtggttgccaaaacatccagtggttccttcagcaagtgttcaccctctgcagaagcctgtgagggcctgagctcagaaaccactctcctttccttctctggctttggccctgggcactgtggtgggagagtggacagtttggctttgccttctctgtacatcaatcatggg

SEQ ID NO: 58763 - DNA, 1029 bp, Homo sapiens
ggtcacccgcgcttggtggccttgctgttggtcctccccgtcggccctcatcacaatatatgcggtgtcatctgggaactggaggacctggtggcaagtccctgctgttcacggggctggatgaggggtcctggggacagtccacatgaaaagaaatgttaaagttcaagctcagagcctgggccccagcccagtgtttgttctgtgcttggcacattttttgtttggcactgatactggctcagaggagggtaaaagtaagagtcgattgcccggtaagctgaaggtggttactgtttgacacgtgcttgagcaaacatctctaatcttcccgagattgaaaaaatcctgtggctcttgctccctaaggtgtttacagccagcatgtggtcaagggttggacattgtgctgccgcgatgcctgttgtagctgctgtttacacctgcttggtgctcacggttcatgggccagggctgattggcctgctgaggaacagctgcctgctggcttcagcccctcctcttttccctcagtcttagacagggacgggggtgacgcagaggaagcagtagcagtgactgcgtcccctgctccctccctgggtctgtgtgcccaccatgagcgggattatgaagctggcttggaaactcatctggcttttgctcctgtaaaaatcactttttgaacagggtgctgctgccatttctgtggctgtgcatgttggggattcaggttcccctggtgctcagcctcctcggtggtctcttcagtcctgggctctcgatgagggagctcaggaagccacggagcctgggtgcctgggtcctgcctcactgactcataatgctaataaactcgtgtgtatgaggacagtgccagaccccgttgggggtacagaactgggaaagagagggcccctccctccggagcttaccttgcagtaagggaaatgggacaggcacacacagagtcatacagggcatggcgaggtgaccttaggccattaagagatgagggagtttagagga

SEQ ID NO: 58764 - DNA, 2014 bp, Homo sapiens
tggaggcctctacaccccacgtcccgcagggcaccctctctcctggcagggccatatgtggtgtcttctggccccagtgcctggacggcaccagaagcttgggaagtatttgctaaatgagtgactttgggggcacagaggggcccccagcaagcttgatttggggtgggcaaggacaggggacaagtgattgctttttggggccagagctggtgggagggtggccgtgagctgttcccaggggtgaggtgaggcaggagtaggtggacaacgaggctgtgatggggtccaggtcacggcagcatggctgggtcttagctctggttctccagggtgtgggctggggccaggacacagctgggaagccagttgggggttgggggagtgccccaggcagggcccacccgtctccctgggctaactcccctgcctcacccatacccccacagtaccctggcgtggcccagagcatcaacagtgatgtcaacaacctcatggccgtgttgaacatgagcaacatgcttccagaaggtctgaggctaggtggttgggtcaagggcaggagtgggtggcaggcatctgtgttgggttctggggaccagagggggtcctccctgcagagcccccttcctcgctgatgccctcctccctggcccaggcctgttccccgagcacctgatcgacgtgctgaggcgggagctggccctggagtgtgactaccagcgagaggccgcctgtgcccgcaagttcaggtgtggcccccggccgggccccttgcgtgtttgcaccagggaggcagaagggaccatgttcagcagctggtgaaggcccctccagctctgaggggcagagggctggggttgcagcctgggccgaggccatatcctgcctggggtgaaggagggccctctgcctggttggggggtgtgtgtggggggggggacggtgtggagggcctgtggctagggcgtgacctccctcccctacccagggacctgctgaagggccaccccttcttctatgtgcctgagattgtggatgagctctgcagcccacatgtgctgaccacagagctggtgtctggcttccccctggaccaggccgaagggctcagccaggagattcggaacgaggtttgtctgtgccagcagacaggtggggccagggtggccctgctgtgtggctgtttggtgacctaatagtgtgagctggggacttggagccctgaggtgctccctgggggtgaggggcagtgaagtagcaccagtgggacttagggggacacaggggagctgctgccttccctggcccaagtaacactgggaatcaaacagtccctagggtagggtgggtaaaacaggaggcaggggcttctctggccccagtctcccagggcaccaggcagtgtggtgctgcctgacacagacccttcgcgctgtccacagatctgctacaacatcctggttctgtgcctgagggagctgttcgagttccacttcatgcaaacagaccccaactggtccaacttcttctatgacccccagcagcacaaggtgagccccagggtgggggcacccgcagccaggcctgagagcttctccgaatggggcacgtgaggccctggactgccccttgtcctgggaaagtcagcagagagctcagggctctgggagtggggatcctcactgccctctgttgcacccccttcccggccccacacacccgcaccatggagcaccagggccaaacttctcctggtgtctctgtccccaggtggctcttttggattttggggcaacgcgggaatatgacagatccttcaccgacctctacattcaggtaactggagaggggccctggccttggtccatgtttttctgaggctgggacaggatgctgggggactcggggtagggagaatgactgggttcctgcccttgtgtccccatctgcgctgcctgcccctcaggtctggtgacagcaggcagttaggctgacagctgccaggcgtggt

SEQ ID NO: 58765 - DNA, 1200 bp, Homo sapiens
gtttatgcccattaccatgatgtaatccagtttacagcagagctttgaatgagaactcagcgccccgggcactgtgggaggaacccgggctggtggagggctctggtgtctcgccgccatttatccttcctctcttgccccaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaact

SEQ ID NO: 58766 - DNA, 1116 bp, Homo sapiens
ctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctca

SEQ ID NO: 58767 - DNA, 1429 bp, Homo sapiens
tatcagagatccctcctctacattttcttccctcttccttccaccactttaagaaaaaaaaagagataaaaagaaaaaatctgtatcttattttttgttcaaaataaggtctatattgataagcaaaacaagtgaagatagcattttccacagaatcattagactgcttggtttttagtgtttgttgtcacctgattttgttaacacatgataatcgttctttttggcattaacacaagtgactttttgccctctcattgcatttcagtttttaatgtacctttcattgctttaatgttttcttatcacgtaagtgcttttgtatttccaggacaagaagttggtgtaaatttttgaaacctgtttcttcacctgtacatgtagtatgcatcaaagattttatctgtctgaattcctcttcttcacaaccagattttattgtcacatgacttttttctatttcactaccaaaggacatataacctggggcttttttataggcatccatttaatcatctaacaaatatttattgagcacttactttgtgcccggaaccatctttatctcagagtagacactagtaaatacaataatatgcatgtctgaaaataataataatatgcatgcctgtacttgtgtatgtatctattgaaaagcttgtgatattttaatgtattctcagttgttaatatgttctttccattgaaatggaattattacaaactgtctcataaaataaagatgaattaaatttatctaaagttaacatatatgtttttaaataccaaagccacatgttgtcatctattcagagagcatgtgtcccagacatttttatattttaatttattcaaatcagtattgctttcctgtgaaatacttataagcttagaaagtttattgtatgtctttagaaatttaattctgttgcttttgtgcaagatgttcttgaaacagaattgtttgctttttgaatgtggaaggagaagtgaggctaagggagtcatattcctctatcagatgcaaacctttatttgtatctaagtgagccaagacaatataagcattaatataagatggtgtgtgtggcttataaatagatgctatattcattttcttgaatttttaaaataatttaccgttttaatacatggttgctatttgtgataaagaacaaatttttctctaatttggatgcaagaataatactttacctctagaagacttatttttagcacattacatttctcctagctttttatccattactaaaattgttaataaaagtatattttcgagcttagtgacatcctggagctttaagatgtaattttgcttcttaaagtcaaagtttcatgtacgtcagtacaacctcagagggtactgattttattcatatatctagaataaaaacaagaccttacagaa

SEQ ID NO: 58768 - DNA, 1024 bp, Homo sapiens
tctaatgtagagtcagagttggaatgtctgacttttttgtgtagctctttcaataattccctttgtaaccttagtttaagtaaaccattgaatctttctttgcttgtgtcaccatttgttgatattcattctttcaacaagtgtatattgagcatctaccctattcatgtaactgtgctacagtgctttattatacattcttaacagggactagaacacttacctgaagatttctctgctttctaagtttgattcactgtcaataacttaactacttttaggaatcaaatagttcaaatataatgaaattcctttatagaactcatgttgggcaaagaaatagtatacccctggtgtttacagaatccgtctatattataacggctatataatctgaatcatggtataccagttcctcatttacgatatatgttctgtttgcttcaaaaatgttttgatttggctactatatgatagccccataggatttgggtgggattccactctacagttatttagtgtagacctttcaaaatatttggggtttaatagttaaaagtaatccgcaagctgcccccccttcccttctcccaggttacaatgcaccatatctctcggtgtacagtgaaaatgcagttgatatctttgatgtgaactccatggaatggattcagactcttcctctcaaaaaggtaatttaacattaaaatgtgggctaagccaactgagtataagtgaaaacactaaattactacatagtaattttttttttattaattcaacattttctggaatgtgtaattggcagtttgggacttagctaagagtgagaaaatagaaacagaaataaagttggttaatttccttatgcctcactaaaaccatactaattttactatatttggtttatgcaaagtatgattgttattattatgaacaactagaatatatcctacaacttaaaatgtcagtgttatcttctacttttggattaaggagctctgagagagtacatgattattat

SEQ ID NO: 58769 - DNA, 1381 bp, Homo sapiens
catataaaaacttctgaaaaataagttctctgtttttaaaaatgggaatcctatggtgacgttccctagaatttagtgccagtagaaaagtttccttgaagatttggcatacttttacacaagaatcctttggggtttgccttggctgccagaaatctcaggactcaaatttaatacgtactataggtgagttaaattatcttatgatgggttggataatctttttttcctgtgacttctgatgtcttattcttccgtatgtgcatctgtaagttgacttacatccttttgagtataattgggatatgattaatcaataaaactatattttgatttattattctttctgtgtttagaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgtaagattctctttcttacggctgtcttatctttatatctcttcttccttttcccttctacttcgtctcccaaatgttgtcattgttgataacagttttttaaaaaagtcattcttaatgcttttcctcagtattgattatgttgttgatgtaaaaaccatatgtagttaggcctgggcaaacagggccagcattagcatgcacgtaatttaaacaaaacatctttctgtggaatatttcactaagatggattttttaccccacatcatattttgaaataacccagaattgttatctcatggtcccccaaaatatggtgcttgtaagcatcagtgtttcacagaacttattctggagaagtagttactaagtgagttatttaatcaggtatgtaaaggtataatgtaacatctataagaggtgttttttca

SEQ ID NO: 58770 - DNA, 1913 bp, Homo sapiens
ttgttgttgttgttgttatatatttaatgcctctttagtgatagtgttctggcacttttacagaaggaaaatgaaaatgatactaacatttcaaatggtgtctgccacctttgctttgtcatgtattctagtgctaaaggtagttattctgattaggaatagctgaactccagtaatggtatcatttaatgaatgcttattttattggtgagtgctaagcaaactaacataatcatgaaactagcataaagggtgtctgttttctaatatcatgaatattgattaaattgttctaggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcataggtatgaatttataacatttatcatattattatcattgtttactaatctaccttgagaacagggattggctttcatctaggaatccccagtgtccaacatactgtgcatcatatcataaatgctcagtacatgtttactgaatgaatgagacctatatcagatctttgtttttcagtaaacaggagtataaatacactttcaaagtgccttttttttcctgaaaaaacaacagtgctaagcattagcctactaatctattttctgcttgtgtgatttagaacaagttagtttcttagagtttaatatataaaatacagatggtaattaccttgctgaggttattgggaagtttaaataagatggaatacataacacagagtgccctgcataagaaagaaatccccttaacaaatggcagtttctgtgtctggaggtttaaatttttgctgtattcctgtgtatgcatctaactcttttgttactttccataaatactgaaaagttcaatgagtatggttcaaatgccattcacaatttttacctcccaaaacaataagtgtagaacaacttaggtttttcattttgtttcatcatttattaaacatttacttctttttgtaagtattgatatggattattctttaataattgttctattttagaagacatgagagatttaccagtataatctgaaaggaaatagtgtaaactgttattgtaattcattttatttccattttttgcaccaaatgttcttatcatctggtttattagcattacatggtttttttcctaataaaaatctttcacattcatgtcttacatagatcatgaaagaattgctttgggaaacgaagaagggttatttgttgtacatgtcaccaaagatggtaagagaaaactttttttttttggagtaattttaaatcgtgttaaaaaaatttaaactgtagattctaaattctacaaagagcaggatttgctcttatttatcctgcgactaaaattttccagacctaatttgacgtttataaattaaaagattatttttaaatttctataatccccctgaggtttaaaacttcaaatatgtattgtctttcttgtatcattttatttaacagttctgtacgaactcagattgcatttctttttttttttttggagacagagtttcactcttgctgcccaggctggagtgcagtggcacgaactcggctcattgcagcctccgcctcctgggttcaagagattctcctgcctcagcctcccagtagctgggattacaggcatgcaccaccacgcccggctaattttgtatttttagtagagatgaggtttctccatgttggccaggttggtctcgaactcccaacctcaggtgatccacccgccttggc

SEQ ID NO: 58771 - DNA, 1441 bp, Homo sapiens
aataactcctaaaatttacctttaacttgtacttttttagtcattgaaaaactccattttcaaggattggtagagtttgccaaaccgaagatgtcaggtagcttaatgcccactagtgacccttgcaacagaaatttcaaggcagataccaagttgcagtgggatgaagagcaaaaaactctagaaaccactcttttagaaaatctaaatcaatcattttattcacaaggttagatgcttcgtctgttgcttctttttttgatcactaatgtcaatacagaacagcagtaatacaagtaattttttaaatatttactatgtctcattaaaattgtcattggtaagcaaatgaatcagctacccaaatgataaaacagttatttaaaataaaattggagataagcattcatctaacatagcatcttgtatgcagtgagtgttacgaattttctttttgttaaaatgaatttttatcaaacgtttcttttttccctctaaaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcagggtaagtatgattaagttgggtttagattaatcctttaagatttattaatgaattaaaatcaaatccagttagtttaagaggatagttcttgatggaaaattaaatgaataaaattcatctaataattttatttcatctagaataatgatttgcaaacaaaaacctagcttttacatggaaataagttataaaatgtctcaagtttttccatattgttcctatcttgtgatgaaatcttcataaaggagtttgtggcccctgctcttgcaagagaggtggcatatggttatgaattatgagctattaaggcatagtcttgttatcttgggtagtatttacaatgtaagctgaacttcatcttacaccaagtttgacttttatgctatttagaaagaaacccatgagtgttattttaatgaaatatgagtgaaagttaaaatggtaccattaaaatgtttctcagaataaaaagtcattctgtatttgaagaatgtgttctcacattttctcatagcttaatgatatgtgtctcatctgctactttaccaaccagaatggcagacttataaaacgtgtacattatctgtaggtcttcaccatgcaattacatatgtaatttaagggatattttcatttgagttgttttggctgtttgtctgtctaaaacaaaactaagattcctaagccagctggagtgaagaaagggtggcagagagcactggctatagtgtgtgacttcaaactctttctgtacgatattgctgaaggaaaagcatctcagcccagtgttgtcattagtcaag

SEQ ID NO: 58772 - DNA, 1019 bp, Homo sapiens
ctctttttcctaagaaggtataaagcatattaaaatcctatatttgtatcagtataaatatgcaatattttacttaactatttgctgaacaataatttggataatttattaaaattctgaagctaagatttatgagccccccaaaaaagctattgtttattttatatacttttaaaatggcattgaagagcaattatcatttaacttcttaattattttagcttagtccagttcaaattacctaataaaaatgtttaaagaccataaactataagaagatgtaatgagaaatggaaataattcattctattcctatttagaaaacattctagaaagtggtatggggcataaggactcacattatggaaatcttttaaacaatctgtgtgtttttttatcaatttgttttgcagcgcaagactcaccagttttttgtaaaatcttttactactcctaccaagtgtcatcagtgtacctccttgatggtgggtttaataagacagggctgttcatgtgaaggtaagaacacaaaggaaagaaaatgtgacttcactatctaaattgtaatcaaataagttgattctctttcaaaggtgtataaatgtttgttttacttaatcatttgcttttttgcataacaggaatggaaataatctgtgttgtctgttgaatgttcgagaaactagacatatttttcaggggcaatatatttaaatatggttcatttgtctttgttttgttattaaatttgtagtccctgccaaaaaacattaacctgacagaagaaaattcattgaattttaaccttgtttaatttattagagaaattgttattaaaaagtagacagtgtgggaaccttttcagaaatattaaatgtctgccactatgtctgaaagatattttattcctgtattaatagcagaggtttttttttttcccctaacatccatgatttattcatcacatgtttatggaacacccactgtacttctaggcactggggacataatagtggata

SEQ ID NO: 58773 - DNA, 1518 bp, Homo sapiens
attttcactcccccagcagtgtgtgtgagttccccatttccccacatcctcacctcacagtcacacattaacttttgccagcttgatgggtattaagtgtcatttttgtattacatctgttttctagtgttattcagcatctttttgtatgtttattgaccattgatgatttgcctgtttgtgtcctttgttgttctattgaatcatttttcttatagctttttgtgttcattatatactctagatactaattctttgctagctatatgcattgcaaatattttctcccagtctgtggcttattttaaaattttatttgtggtgtctttttgtcttgcaaaagttttgattttaaaatagtcagatttatcagtctttttctttatgacttctgctttttatgtctttttaaaacagttctctatgcagagattataaagattttcttctatattttcttctaaaagtttttaaattttgcttttacttgtttaggaccttaatcaaactgatatatattgttatgtataatgggaaatgggcttctaatgtctttttcccatgtgaacaagtgaccctgctatatttccccccatcgatttgtaatggctatttctgctttatatgcatggatctgtttggatactctcaattcttttccattgttcttttggtttttcctgcattggcagtaaattgtcttaattacaattactttcactctaaaataattcctgatacctggtatggtgagccatcccacataccttcttccttttcttcttgaccttttagtttttcatattacttttaaggtcagcttgtcaaatttcacatggggcttttgattggaattgcattaatgtatagatctatttgaggagaattgacatctttcatgatactgggtattccatctatgaacatggtatacatattagggattctcttatatccttcaataaagtttcattattttcagtgtatttcatattgcttgttagatttgttcctaggtaccttaaattttttgttgctgtggtgactgggattctttttaaatacattttcttactgtgcattgccttgtctttataaactctagatcttgtatccagcacccttgcttaattttttttaattctaataacctttggactttctatgtaaatttgacgactttgtttcctattgttttttattaacttttgtatagattttcagtgttcctctcttttatctttcatatgtatcttttcaaatgttaaattataagtttggtttaaaactttttcaagctatttaaaagtaaataaaatctaaattagagctaaactcacaaacagaaaactctgagaaactcaactgaattttgttttaaggctgtagtgcttataaaatattctgtttttggaggttgtatggtaacaaagatagattgttgtatagtaacaacaaagatgaggttgtataataacagcaaagaaaggaccatccatttttcttataatattttaa

SEQ ID NO: 58774 - DNA, 1514 bp, Homo sapiens
atcatacattgctgatagtattctacattaattatcaataggaaaatatccccaacttgagaaaacaatttgtgcccttagagattgaagccacatgcccagagttctgttgagctaaaaacaaatctatgaagttaatttctaggggaaccttcttttccaagtgtttctactctcaattatttatcattcattcaaagtgaaattttgcttttcacttagttttgagtacaagggcattgtattttaattcattgttttaatagttctactttgccagcagtctcaactgcacctgactctttcagcagtggcatttctaagggatacgttatcatcatgtcttccctctaaaatatagccatagtaagaacaaaggaaaataattataagttcatgtttaaattcttaaactgatggtgtttttatgatttgtgatttctgatctaaacattgttttgctgtacaacatattcaaagtaagttcctgaaccacttttccaaattaccttcattgtcctttcattttaaaaactcaatcctagtaactctgaaacttgccatacagactagtatggttcaatcagtatggttcataagatcttttatgctaaattttaacccaaagcatttttaatttctaaaaatacttggtgtaaaaggatgcgactgaatataagtgctggtttttctactgatgcaaaataaagggaagacttactttagtgtcctgcacaaaactgataggttaggttttttttactttcagttaatgagtagtaaaagaccaaacttcattcttatcaaggacaaagttatctttaatctgccgtatgtatctctattaagtacccggcatttatttcacatgtatgattccttttgtgaaataaaaagttccatgtggaataccaacatagaatgtgcagtaggaccagggctcaaagtaacagatcaacagtgaagatcagggaggagcctttggttaactattctgtcaatccttgtttacattaaaggtagtggttatgcttttgtataatgatgtatccctaacgtgaatattcaaactaaagtttgttatcctcctttctcaagaaatgttgtcataatcatgccttacagaaatttgctaagcctgcacattgttgaaaagtgattttttgggtttttatttttcccgacttattttcctagactgatcccgttgagaacacatatgtatggaacccgagcgtcaagtttcacatccagtcacggtccacatctccttccacatctagtgaagctgagccagttaaggtgccttattggagcatccctgctccccaacttttcacttgtgtcagaaaagagggaattgaataaaacaagtctgtctctctcctcttaaccaaatatgtaataagttacagtctattggagatcattacatttaactgataatgtaggtagaagtaaaaaactaaagagcacattgtcctcaaatagtcaatctgaaatagacaaaacta

SEQ ID NO: 58775 - DNA, 1202 bp, Homo sapiens
ataaatggcatagttcaactttttaatatgcctaataccatctcaaaatatttcagtattttcacttatttttaatattttttataggaaaaattacttgattttgtttaaactctgaaattgatttttatttaagagtatatagttctaaaaagctagtatggtaaatttcattattctactttattacaattaaatattttcatttaaattaaatattttctatttctgaataaccaccttttacctcattcagcaaagaaaatcacttttaaatttgtccatatccatattctctttcatttttattgttggagaaaaactagttaggagaataagacttgacagaggagccaagaggtgtgtgttaaaagcctcaagaaaagagttactaatttgtgtagttgcaaattaaattgatagtgtatttttcctttctccaatatcccactgtcataataccacattttcataggatcagcaaacatgctggtaaatgttttaacaaccagctctgggactagagaaagccctgctttttaggttcactgatttcatgatataaccttccattagtccatatactgacaaaatggcttaaggcagtattttctaattttaatgcgagaaagtagaagacagtatgcccaacttctgtcagcatgtgtttaaacagctcaaagagcagacctgctgtaaaatttcaaccagtgctattgcaaacagcaaatacttggcctttcccatttttaaagagtttttgaaataatcaaacccagataatacaaagccgttatatcagctattcacatatacacagcattacctttcacacaggaacttcgcattttgtgtctttctgtcaagctgtggggctaaataaagccttttgcaacaggtcagaaactttacaattttcttaagatggctcagtttcttacacatagaaagtcccctacttagataccttaaaacttcttgagatgacatttcagtcagttttaagttcttactggtataaaatgtatcaattctgctttgcttctcagttccattttaactaaagcccctctccatggacacctaattcttgcaatgtgtataatcttatgaaaactaggaggaggagatttttagaaactaaaagacatttctgccatattcccaactcagagtcatatttcatatttataatctaaact

SEQ ID NO: 58776 - DNA, 2328 bp, Homo sapiens
agaaaacttgatcattcatgttgtacaacattcaaaaatgatttggaacaaattatacatcttattgactataatttatgtaaatcagttctagagaaatcttgtttttttttttttaatgtagttcagaggaatctcccaaactaattatctagatctgaggaaataatgttaataataaagcctttctattctaagataattccaagatttaaaaaatatcagtaacattatttatatatgtattattaacaaactgtaaatatcttcctatactaatcctagctctgtgtttctcaacttgaaatgagtcagccactacctctgtgctacaagattctgacatgcccagagatggaatttttctaaaccagccacatcccaacactagtcataaacacacatacatactccctatttgaaaagcgacagggtagctgacagtgttgggattttcatatactatgtaaaatagtaacattcaaaaggaaagtcagtgatggatacaaattcgtaatgttcaccagtcatctccgtggagactgatcaacactttacattccgaattcttagactcggaaagttctagatgagggaattctgtggtttgtggtaggcatgggaagcagtaggggtggcctgctgcttcctgtggtcctgtctttctggtatgttggagggttggttgtaaaataaacatgaataactctaatatagcatatataatattttcggattacagcttaataatgaataagcatttcagatacctgtactatggccagtagaactgcattcaagtgatatctcattaattattgtgtttatgaaagattactagttcaactgattgcttgattattttgaaacttgtagagacttaaaaccattagatatttggatttatcaaatgaatctgaatatatgttgattacattacataacctctagaagggaaaaccaatatgttgtgtgcccagttatattagggtcaaatcaccagcccgtgaattgactaaatttttaactacttgctgttttttcaataaggttataatttaggatttgtttctctcattttattatggattaattatgtctcacttgccttgcagactttctggggccttggacacctagaacattttttgtgaatcttgaaataagaaaaaaattttggagggaaatagctgttataaggtctctccttaattctatgtctttattctatgagatatgaataaactataattaaccataatctattgacttattattacatatgattattttaaacgtagatataataggcttggttatctgctttcctggcctccttcaatttttctttggttaagtatctcacaaaaaaagtcagccactgaaaagtaatagtgcctgtgaagatgcttgaagaattacaaattactcagctgttaaatagaagcatctcagtggtatagtgtagaacctcagtgttccctgggacatcagtgtatttcagtaggacacatgcagttaccattcttaacaatggcctctgttgtaacagtagcataagattttatgttatataccatgtttttagacaagaaaatatgcagtattttaataaatttaaaattaactatgaaatgtcatatgaatgaggtagtattacaaaataatgtttcttgcattcttgtttctagtatgctattaaacctcatttacagtttgaatgattttctttataaatagtattaagtatagtagaagaaaaagtttttattgatagtattgttaatgtccaaatacaaatgatgagagagatttccacagtgctttcattaatagtgagaaacactgaatgtattatttcagattgttcatttagagtttggagcagagattttatagcccacgtatggcttaactttctcttatgttttcttagaatatgtgtaaattctccagactagatattccaatcagtatattgaaaataacttgagaataaattttcttaaagggaaacaaggtgcattatgtataactagtaagcttacccttactggtcacaacctttagtcatttgttaggatttgttctagcgcaataaaatgtatttactgttttccaaatgatatagtacttctgtaatactgtttttgtatcataagttcaattaacagaaataaatatatcactaaaagatttgagtttatacttgttctcaatacaaaatattaaattaccttctactttgttttcaaaatacttctagctagaggataaagaaaattgatagaaactggattttggccaggcatggtagctcacgcctgt

SEQ ID NO: 58777 - DNA, 1035 bp, Homo sapiens
tataaacttactcctgtatgtgctccactttcatggttgcctgtaatggtataatatctaacaaagtctaacagaattctaaaattaacctttgattttgtaacatttttaaatttaataatttagttcagggtccacaaatgttttctgtaaaggttcatttagtaaatattttaggctttgattagcttccatcacagcttctcatctctgctattgtagtgtaaaagcagccatagtcaatacttaaatgaatgagattggctgtgttctagtaaaactgttaatctacatgaaagtaggtagcaagctgtatttgttcttcccgcagtaatttatagtcccctaatttaccatgcctgacatttaaaccaagtaagtttggctacatccaagatggctcactaaccagcaataaaaattaatgacatttttccttttttctccttatttaagtaaactaaaagattcagagaagaagaacttggaactactctcagaaatcgaacagctgataaaggacactgaagagcttagatctgaaaagggtatgggagtgtgtgtttgcctcactcaggacttactgttatgttataaatatattttattacagaagaatcaattcattgcataggtgggagaattgttgacataagcaattctggcactcatttatgaatatacgtgtgtatatatgatgcatgtgcatacacacacatttggaagactgacctctgagtcattttgttttacttaatatgcattgtttaatgatttcatagtaacagaaaaagacactttgccataaatttgacgttttttttcagtgcagtggactacttcatgaataacatttttgtgattggaaaaaaattttattttataatgtactttataatattctcaaatgctatgatatgaggttatcactctgacagtggcaatgtgtgttaacatccagaacttggtaagggtacttgaacaagtatttcctagcactttttatgtgcctagaatgtataaaaattggggggg

SEQ ID NO: 58778 - DNA, 1042 bp, Homo sapiens
caaagaaattatttaagactatctttgaatttcctaccacttatttctttaggaagctttaaaataacatatattgcactgaagcttttttgttttacttttgtactttgtctttatatattctagggtcagcgatgaaaaggatgcacgagggtatcttcaggccttagcttctaaaatgactgaagaattggaggcattaagaaattccagcttgggtacacgagcaacagtaagcttctatgattttgcatggaggcttatcatattagaaaaaagagatttaaaaaacactataataaatccaattacttatatcagtttgtttagactttgagcctactaaagagttttttatgagaaaactattagtttgggtcttttccagtttagaaaaacataacacacagctggttaactataataatttaaatgttaaaaataggatggaactaaaaacacagtcattatttcataggatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatggtaagattgaatcatatagtcccactagaataatttctaagtttgtcataattatttggagagaagttacatgtttagtttccattgcttgcttttagaaaaatgatggccaaatatgttacaaagatttgaaaataactagatgcttttaagccttgtagatagtgatgaggttttaatatagccttgttttcctctggcttgtccataaagtagaattaatagtattaaataatattccattatttaattttcctcataaaatttagttgactctcaaattttattaaacctaaaattctctcatgtttaggaatattatatttgtataataatacaacatatggtgagaacaaaatataatcatttgaaaattgtggcctctaccataggtcttttataaatgaaaattcta

SEQ ID NO: 58779 - DNA, 1050 bp, Homo sapiens
gtctgaaaaaaaaaaaaagagagagagaacaggcgtacaagtgaaacaagattgatgttgaagtaatcattgttgaaattaggtagtggggctcatgggaattcatttttattttccttttctgtatatgcttgaaattacatgctattttaaagaaaaaatgacataaagacatttttggagaaaaaaaaaagctattaccaacagaaatgggcaattcttaagccaagtagagaatgttcacagaaccaagtcactgtaggttgtaagggaaaagcaaaggtagcaggagaattcagagtacttgatatccaaattcagtgagcaaaagggattattataataagacaggcatttttgggtagatgatgttgagtaatcaaatttgacaatacctgtctgaacacctcgaattcttggtcctaaaagtcatgcatgtcttaaaactatctttcagcttactactttgtatgagaacttaagtatacacaaccagcagttagaagaagaggttaaagatctagcagacaagaaagaatcagttgcacattgggaagcccaaatcacagaaataattcagtggtgagtgctcttttaaacgtttttttgtggatgattgtgagtatgtggccaagttggtatgaattccaggtggctactaataatggtttttatctcatttgtcagatgtgataaataagttactctgaaaagcacagttttattactgatctgttgtgttctactgtgttttctgttacattcctctgttccctaactctaacaaatgtcccataccagcatttaacacagcttcattgaaatctgattattattactttctaagaaaatgttaccaccttcagagtcaaagttggaattcatctgctacctatggatgtttctttctaagaccaaaagtcctgtatttgtgagtattttaagaaatggaaggcctgcaaaaaaaacttagaagctaaagatactgtactgttatcttgtatcatgattataccagattaattcacacatggcatttttaaaacctta

SEQ ID NO: 58780 - DNA, 1082 bp, Homo sapiens
tattgaatatgtacatttaatcttcccttttaaatactttgtttcaagacttgtaggtttctcatataaatcagaaatttctcactattatccttcaattaacaatgaaatttttgttatgtttattgcttattttaatatctggaagtattgatttgtgtttatcttatatgctattgctttactcaactatcaattctaacacatttcactagatttatttgtattttctgggtgaacaattaaatagaaatgataaatatgttatttttctttacaatattcatttttttaactattttacatgttggtcagagagacaattttatatgttggtctgaaatgaatgtcgcataagagtggtaatggaagacatcctttttgttgatatttctgaatttactcgatgtatctctgatgtttcacgtaaatagtattttgatagctcaaaatggatacttttaaattaaaagaattactggttttttttatgtaatggttttattgtgggacttagagtagtatttggaattattactggattttataaaatgctattgggtaggggtacatactgagattatcatttggatttttacatactgagattatcatttggattttaaaatttaatctattaaaataattcattttatgacacatttattaataagtttgctgacattaaattatcttcggtgtctgcaataaaacctattatttcttggtaggtttttcttttttacagatggtttaataatatcatttgtgttctatttggcttttcacattcttatcaataagtgatatgcatctgtaaccataattgttggtatctttgttaggttttgatttcaggggaatttttttttcttgaaacttactgtacatgctgctgccatcccaacagtcatcacaataaacagaacatcaaactaaaagtgttcttttctttaagtagttagaaaaatgcaagaatagtacgggtcagtggtaagtgccacagatgtcaatttagttctcattttcatagcgatgcttcagagcaagaatctgccttgctctggttcttctcaagttaa

SEQ ID NO: 58781 - DNA, 1236 bp, Homo sapiens
acaaaactgtaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagaggttagtagtcaggcaaattttgtagtgcccatgggatagtgattaaagctgctttttgagactagtaatataatatataatttttaaaatatttctaaagttatttttatagttcattaatattatttaatatggatttaaacatttgaattatcttcctgttacaaggtaaattctcattgggataaatgttttgtttggaaaaaaattataaccgtgaaatctgcatttttcattctgttttaaagctggaagttcatacagaagctctagctgctgaagcatctaaagacaggaagctacgtgaacagagtgagcactattctaagcaactggaaaatgaattggagggactgaaggtatcttttgacttcacatttatgaagcttaattgattttcttctctttaggcttgttaggagtgttagcttgtatactgtattcggtgtgcagtgaaaactagcctttcttcaaacctactattcataattctcgttcttaccagtaggaagctaatacagatttcttaattatgctgaagaaaatggaggactatgtttagtgggaaatatgaatctatcaggagggagttagaatgtttatgcagacctacacaagatgtactggtaatctgcatgggagtcatggttagatatccagaccctctatatatctcataaatgactcaggagaagctcaggggtagctttgcagacacttgtgtctgttaggataagatgataatgggcatagtctaaaacatctcagcagaaggtgctttgcaagggaaattcttgagccgttctggagttagactacctattcttaacttcttgctttcaccagttacttgctgtgtaacatgtaacattggacagaacattatggggccgggcacagtggctcacgcctgtaatcccaacactttgggaggccgggatgggcagatcacttgaggtcaggagttcgagaccagcctga

SEQ ID NO: 58782 - DNA, 1040 bp, Homo sapiens
cgtgtttttttttttcctcttttcttttttttgatattcagattatactggtccatagaaagagttgaattgcattcctgctttttctcacggaccaatgagttatttataagtatcttttaaaattttcaatatatggagttttatctttttttgttgacttctaatttagttgcagtgtcattacagaacttgctctacgtggtatctgttctttgaaatctactgagacttgcttcatggcgtagcctgttccatttttaaaacattcaatgtgtgttcttgaaaatagttcgtgttccaatttagagagcaagcttctgtgtatgaagcttttcagatcgtctttatattcactatttttttttttttgcctacctggtttatctattaatgactaagaaattaaaatttttcattatagtgatgtttaccaatttttctctgaagttctaacagtttctttttaatgattttgagactctcttatagaaggcacaaaagtttaggataatatttcttcttagtgtattgaattttatcattatgtagtgatattccttatccttagtaatactttttctactgaagtcaagatttcatttcttaatccagtataatagatggcctttaactggttactaatgtatatggatgtgtttctactatctttttttctgtttgtcatgatttttgcatgctgctttttatttcctttcttcccttctcaaaagtttttaactgtggtaaaatacgtataacataaaattaccatctaaacaattttcaagtgcacagttaagtaatgttaagtgtatttacattcttgtgcagcagtctccagaactctttttgtttgcaaaatcatttcttcttcactgaaatttgttgttgttgttgttgacattttagtttactctctagtcttttggtggttactcttggcttctaccatgtgtattaaccaagtttaagtttaagttaaatatcctaaaactatttcccacaaacaatttaaagacgtttaattttacagattg

SEQ ID NO: 58783 - DNA, 1037 bp, Homo sapiens
ccaatttttaatgttttagtattaaaaatcctttttatatattttgagaagatgatagtgctgacgaaaagaaacagattataccaataaaggactttgagtgatttgcttaatatcctataggcagtagaaaatgatttttctccacattccttgccaacacttgttatcctttgtcttttaaaaaaaatagccattccaatagatgtgaagtgacagctcattatggttttgatgtttacttctcttatgactagtgatgttgaatactttttcatatacctattggccatttgtatgtcgtcttagagaaatgtccactgaggtcctttgcccattttttgattgagttagcaaatattctgattttttataatgccaaactgttttctagcataccaacttccatttccacgagtagtgtagagtttctgtgttcatatttccagatttattacttttggccaatctagtctaaattgagattttaggttttagaaaatgtttggttgtggtcttaatttgcatttctctaattagtaatgaggtcaagtatcttcacatgggtctattgtcgtttacatttcttttgtgaaatgcttcttaatatcttttgtatatttttctgttgggtttttttcttactggttataagaattcttggaaatatttgggcattctaatcttttgtgagttatatgtgttacaaatatctctcagtggcttatctttttgcttttaggaatctttttattaaaaagtgttcttaggtttgttgtggccagatttatcaatatttttatggttagtgtatttgctgtcttgtataaaaaatctgagattttaaaaaattctcctaaatttttatcttaaagttttaaatttttaggtctgtatctcaactattttttgaaaactgtgaagatggaattttgattaaaactgcatttaatcagctgggcatggtgacttatgcttgtaatcctggcacttttgagaggctgaggcaggaggatcacttgagtccaggagtttga

SEQ ID NO: 58784 - DNA, 1009 bp, Homo sapiens
atcttaagctcttgaatgtaatgtgtatgttttcccttctggctgctttcagtattatgtccttaacttcaatttcaaatagttggactgtgattcacgtacgtgtcgctttctttatgtgaacagaaaatcctggttgagattcattgagcttttgcaattttctttgatgtcttttatcagttttgcaaaattctaagccataatctctgtagatattattttgcctcatgcactttctcctctccttctgggactgtaattgtgtatatgttagatggtatctcacatttcctttatgctctgttctgttccttccgttctttctgttttttgtgtgcttcattaagatattttctattgatctgccttcaggttcactagttctggcttctgctttatccattttgctgttaagtccatctaattagtcttaatttcagatattgtcttttttagttaaggattattcatttgattctctcagtttcagttttctgttgaaatttccccatatttttatgtatttttttctctgttttctttaacattttaatattttgaggtccttatctgttactttcaacaactgaatcttctgcgagcctgcctttctgtttttttctttcatttgtcatgcttttctgcttttccaaatgtctcatgtgaaagatgtcatgaataaaaataacacagagaaggaagtttatattatttttgccccagagaggtttctcccttttcattccatcaagaattgagcttggacaagactaaattgctttttttttttttttttttttttttttttttttttttttttttttttgggagacagagtctcgctctgtcgcccaggctggagtgcagtggtgtgatctcggttcactgcaacctccgcctcccaggttcaagcaattctcctgcctcagcctcctgagtaactgggactacaggcacgtgccaccatgcctggctaattttttgtatttttagtagagacaaggtt

SEQ ID NO: 58785 - DNA, 1043 bp, Homo sapiens
gtccctgagaatcttctttacagaaccattttatatatgattatttttctaaggtttgcattcacatgcaaaaacaaatacaaaagctggtatatgatatagtttagatttgggtatcttacacaccattgacttaacatccaaagacaatgaaagctttaaataatatagacagtctattaggcagttgttttagttcttctgtaaaatcaactttatgaagcaatttctttgtgttgtcatgacctgcagtaattgagactttatctatctgcagttatcttaaggtctagaaagtatatttttccctgtccagtttcatgggctagaggatagtattttttgtggttatcaggtaatgttgactcttctgtatgcagaaagtaggtctaccatagtcacattggaatctgtgtaaatcaaaaggaaagatagtaagattaatttaaccagaatgaaaattaccacactactttttatctctagaagaatactgaaattacatgtgtttgagaaagttttaatatgaatcagaaccaggatttgaattaataaagtaattaaatagattttcttagaatattacttttaaaataagttgagatttttttctgacaaaaagaatatcttaccaaacaatgaattgtttatttttccactaaaaattgaatttatttattttttcagagacattaaacctgacaatatactgatggatatgaatggacatattcggttagcagattttggttcttgtctgaagctgatggaagatggaacggtaaataaagataaatcctaaattattttgttcacagacatttcccttgctatttgtctgatatatctgttttagaaaccatctatttatactatctacccatccatccatttgtctatctatgcgccacctccttccacaaaggcatttgggcatacttacagtggggttgtctaaaaagtcacaagccatttcagctgcttatatcagtgatcttaagattgataaaatataccctttatgagacccttgtttgctcctt

SEQ ID NO: 58786 - DNA, 1052 bp, Homo sapiens
ttccttccgtctcagtgggcagtggtttaatctgcattttattgccccattactccccgcttttctcttctttttctcatttgctgaatttgaatgtttattttcataattacacataatttgaatttcatagtagtctttctttgaattacattttaaatgtggtatgtgggttgttttacttgttctccttgttgattgtatctggatggtttttggaaagatgcagagaaagattaggatttgtataaccaccattattttgcagtacctggaattatagaatcattagttttttattcccataattcttaaataatagcttcactacccagtggaaaagattagtttgagaaaagtttactgacagaattttttgaataactgttttctcaaatgtaggatgaaccccaaattaatgttccataaagaattctaatttctgactgacagaaaggctgttggtgatgtaattttaccagtgtggactttcttttattactgatgtaatatttctttgacaaaattaagagacaatttcaaaaagcagtttcattttaatataatgcagtatgctgtttttatgagtataaaaaaggaggagtaggaaaattagaaaataaaagtattgttttagaagagtccactaccctaacctatataaatgataaaaaggaaccgaatgggagatattaatgtgatgttgctgggaagagaaatgcctgtcttaaattagtggttgtcagggaccaatcccctgtgcaatattttgattagtggtgtctgggttggggccaaggtacatgcaattaaaataaccctctatagttgaattcagtgtccagccagaattgaaactatatagattaactaatgtcgtatccgcattttggtcttatgggggtaatatttgtaataatcatgcttttggtactgatgttctagtgaagttaaaaaaaaaatcacccatagaatgttgccctttcaatgtaatcgttgttttagaatgctttttttttgagacaggatcttgctctgtcacccaggctaga

SEQ ID NO: 58787 - DNA, 1050 bp, Homo sapiens
tgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatgtcttataatatcaggtgtattccttttccagaacagaaataatataataaacatagtaattctttgtatatttcctagttttacataaagtatgctctaaaaattttctttttgtgtttcagacagcatgttttcgtgaagaaagggatgtattagtgaatggagacaataaatggattacaaccttgcactatgctttccaggatgacaataacttagtaagaatcatttttgtatttctatatactgtttttttgttggaagaattagcattatttttatttaagcattgtttaaatgtaggtttcatatagaaaattaagtgcatttcatacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagtttttcatgatacctttaacaccagtaccattcctcttcccttgttcctgttgaagtccagctagtactttaaaattgtgctcaaattcatcttaaaataatcatttccagaattttccactgaaattaatctttctcatctcattctaactttacatttttaaattatttttattacataactaacacatgtatctctgattttttttgata

SEQ ID NO: 58788 - DNA, 1068 bp, Homo sapiens
tttatgggaatttagattgtttccttatttttactattttgaaccatgttgtaaaaatctttatatatactggataaacttttgtgagtttatcggtagtgtgaattcttacaaagatgaagtgtcaaactgtcaatacatttcattattttaccatttatctatctgcatgtgtttggccaagagaaatttcaaaacaggagagaaactagtgcttcaaaactagtcatgctacccaaaaagtatatgccatgtaaaatttaaaaaaattttactatgaaatgctgttagagatattggtgtgggctaccctgaggcacttcagcttgtgtatactgaagttgaaatgatttcaaggataatttttacatgaagggattatcattttatgcttgacctagaacttatccactccctaaattaaactccttgctagtcaaactctgggattttagttggggaggggagacattaaaactttgatagctattgttccaataaaattatcttctataaaagttggactattatctttgcactcatagtatgtaaacatgtctgttttctcacacacttggcagttgcggatgttaccaaattatttctatatttaaaattacatttaaaactttttactgaaaaataagttaaaaatgatacatctcatgtttgatttggccatgaaatatatattaaaatgaagacttaaaagtgaattgatgccatggtaatacttggaattcttacattttgcaatttaaaatttcactgatttagattttaaaaatgaaaaatgttgttctttccctcaaatattagagaaagattcagttattatttgaaagagtttctctgtgatagtattctatggaagagtgaagtctttattcctactaaatgataagccaaagtagatataatcatcagtggattttgtttctttttaactcatgctttccaagtatctgtgcaattttgatgagcagtataagcttgttagtctgatgagtgcatcttatcaatacgatgaagagaatcctgtgtcaactttccagaattaccatttat

SEQ ID NO: 58789 - DNA, 1473 bp, Homo sapiens
ctttctgcatattagagtagcatttctcttcctccccaccaacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgagaaagggattttatttattgtatttgatagtttttgatctgcaattgaaatataaaatacagaaatagatgttcctttttttttctttttggaagggatgtgtaaagtttagtttttgtaaaatcgttagttttaattgctctctatgcgtatgtatatgtgtgtatgtggtttgggggttatggtatagtatgtaagagtatgtgatatgaaaaataggatcgttttcagtttatttcatattgtttgatcctcacaaaacatatttgttttggcagctggccttccttgtaacatggtgttggaattttgcatgcattatttaataagctctagttctttcctgttgagcattttgttcagtttcttagtgatagtagatattgagtttgaattccagggcagaaaagttggaaagggggattaatgtgtaattaccaactaatacagtgttcaaaaataccaactaatacagcgttcacaaataccaactaatacagcattcacaaatacagttattagtttggcacatgttcactaactttttcatctggcaacattatttaatttaggatcttagaatttgaactgcattgacataattgataattggtatttatttttttacagaggaaaaaggaaaatggatggctgaaaaaattatttgtcattattttaaaatttatatttcctttatcttttctaggttgctgtagtaaaactaaaaaatgcagataaagtgtttgccatgaaaatattgaataaatgggaaatgctgaaaagagctgaggtaagagtcttatgtattggaatatataaatattttagaaatatttttcaggaattataaaattccatagagctcattaaatattacttggtaacattttgtctgtggtgacattttttaaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgattatgcagtcactttgtattttgttttatattacaggagttgtagtaaaatctagtaatggaaga

SEQ ID NO: 58790 - DNA, 1101 bp, Homo sapiens
agattaccagtcattcatcattaattcagctaatgtttattgagtagctatagattcccaattactaggtgtgtactagtgaacaaataggaaaaaaaaatccctgccctcattagcttatattgtagtgaatgaagcaaacaatgaacaaagtacttaaatagaatacatagttcatgaaataatgacaactaatggtaaagggaagcaaagaaatgggttagaaaatgtcaaggggtaaagtgacatttcattgaaggagtgagagagaaagttgtgtggcttcgtggggctagaatattccaggcctagggatcaacaagtgcaaaggctagttgggattgagtgtggtgatcattatagctggagcatagtgaaccagggggagagtagcacgaggtcagggaaggtggagggccagaacatgttggccctataaggcatagtaaggattttgacttttacttggagacagatgggaaaccattggaagctgtggagcagaggagtgtcatgatctgagctacatttcaagaggatcaactgtggcttcagtgttgaggatgggttgtgggatgagagggcagaagtagtagagaggtcaggtaggacaatccaggcaagattttcttttttttcttttctttttttttttgagacagagtctcactcacttcagcccgggctgaagtgcagtggcgtgatcttggctcaccacacctccgtctcccgggttcaagcaattctcctgcctcagcctccctagtagctgggactacaggcgcccgccaccacacccagccaatttttgtatttttagtagagatggggtttcattatgttggccagactggtctcgaactcctgacctcaggtgatccacccacctcggcttcccaaagtgctgggattacagacatgagccatgtaatagtagcttggaatgggttggaacagaggagatatggtgaatgaattcttgctatatgcaggaagactagatttatagaactccgtggcaactgtttctgtattctacaacctgtaacttaagaatgaacataaaatactgttacagcattctgtaactgcaatttgtaa

SEQ ID NO: 58791 - DNA, 2540 bp, Homo sapiens
gagagaatagtttcagtctagtagagtgaaatagaaattagattgaaataggtgtttgaaagaggttgagaagcaaacaaatgatgagcaagtggaaaaagcaagcatgtactactctttcaaaatgtgctttttggagaaatgtgttgtggaaagggatgtggtatcagttccttgaggaaaaggtaaaatgggggtgacgtttttgttcatatttttgttcttggatggggaatggtcttggaaaagtttttcaattgatatccaggagaaagggggattgaaagcaggaaagaaatttttaatggaataaggacaggaagggaaggaaggagagggtttgggatcaagatgtcaaatgatactgttagccctgaaaagtggtagggttcaaaaggaaaagaggtatgaagcgcaaaaacatttagagttggcatgagggaatgtaaaaggtctgttatctataaagtaggcaaccaggtcattaattgctggtgaagagtagataggacaggaatgggatagtttgtggtggcagggtggcacaggacattttggaagattagtaaagttctgttgagagtgatagaattaatgttaggactgcaggtagatttgagggttcagctgagattgagctatggaaataaaaagcaataataaaaagacaaagtatatatatattcttatatatattattccttacataatatatatttccttatatataaccttattttatatatatccatatatgtatgtgtgtgtgtgtgtgtatatatatatatatatatatatatatataacatgactttttttcattaaagagactgaagaaaaaaagggatttgaaaaattacttgtagttgctcattaggatatgtaaggcagttacttaaggacagccaaatttgctctactgtcctgatacttggaagaattaaagaatggggtacagggctggggagttggtggcagcagagagcagtccagcagtctgtcaagtcctgcctggtcacaggtcagtgccatttaaacctccaggatcaagtcagagcacttgacgcatgactgataatatttgagatttagtgtgaggtgtctttttaaatttttttttggtgtgttcttgctgtatgtgtgtactgattaaaatatgtaaaataaaagcaacaggttgctggtaattaactctgttatttcaagacagaattgattttgtatagaaaggtagtattggctggattatgagctttactgcttattcattcctgatgaaaatatctctgctgggcttacataccctgtagtgtttatgaactagtaggtttagaaatgaagagaccctagagagataatcatttcctccaagatgttttgtcttctaccaggaatttgtcaatagatatataggcccagtgggtaggctcacctctgcatgaatatttgataggagcatttctatcagttatgctctttcttaaaaaaaaacatgaaaataaacgcatcatttatgtaactcttataagaaatgcataaatcatgggaaacagtgagcaagatataattgaaattcagcagctcagtgagttacgaaccttctctctacaactcaattgtgttagttactgcttaacttaacgctgggttttcctttttgctttcaggaaaacctttaacttacgccctgggtgttgcctgtcaacagtttcctggtggctcaccgcttctgcctgctccagccttgctccggcagcttcaaggcttctgggcttcagagcttgttgtgaaagcttgctgctttggcctgctacccctgcttcaggtgtcaaaagcttttaattagcttgcttcctctaattactataactaggcccttacgtgtctgcataatccagttctagggtctgaaaggagaattacctttagccattcattcttctttaaaagatcttttactttggccctcctggcattcatgggagagtaagaagttatattgcatgattcacctttgatggtgctagtcttcagtctgtaggggcaaactggtgtgggcatactgtattttatagccagtgtttgttctgattggttgatgcccatgctgtcccaattttaaagtattttgactattgctactgaatatataaattgtgtctccatagaaaggatatctctagctggtttaataaactctttgtagtgtttttagtttgcttattaaagataatatttagttccctcccccatttttaataaatattttgaacacaaattggtcgctcacagaacagtttttaaaaatgcagatacagtgatttctatacattttgtaatgatcaccattaacatgtgtcaataggtatcagaattataggtatgatgaatgggaagagctcttcagtacttatataactattcagtacttggagtagtaaagtatactagctctcttatcagacagccaggtacatattctggttctattacttattaattttgtcactatgagtaagttaattaacttctccaaacat

SEQ ID NO: 58792 - DNA, 1377 bp, Homo sapiens
gagtgcagtggcataatcttggctcactgcaacctccgcctcctgggttctagtgattctcctgcctcagcctcccaagtagctgggattacaggcgcccatttactaccatgcccatttaatttttgtatttttggtagagacagggtttcaccatgttgaccaggctggtcttgaactcctgacctcaggtgattcacccgccttggcttcctacagtgctgggattacaggccactgtgcccagcatcttcctattttgttttaaaacagctttactgacatgattgacataccaaacaattcacctgtttgaagtatacaattcagtggttttgatatcttactaatttttaaaaattgtggtaaaatacatataacaaaatttgccattttgaccacttttacatgtacaattcagtggcattaaattatatttataatattatgtaacaaccatcacatagctgtctctaaaactttttcattatccaaagagaaattctgtaaccattaagccataagttttcattctcctgtcccccagcccttagtaacctttaatctactttctgtctctatgaatttgcctattctagatatttcatttaagtgacataatatatttgccttttaatgcctgtcttactttacttagcatgttttcaagatttatccacattatagcacgtatcagaccttaacttcattttaaagctgcttaacatactggtgtgtgtgtgtgtgtgtgtgtgtgtgtgtgtgtgtgtgtgtctgtatatatatatcacattttgtttatctgttcatctcttgatggacatttggataatttccaccttttggctactgcgaataatgctgtcatgaacatcattgtacagatatctgtttgaatctcttcttttgattctcttgggtacataggaatggaattgctgggatatgttggtaaatctatgtttagctttttgaggaactacccaactgttttacaaagcagcagtaacattttatatcccctctagcaatgaatgagggttccagtttctccacatcctcttcatcacttgttattttctgttttatttaattaatttaaaaaattcagctattgtagaggttgtgaagtggtatctcattgtggttttggttttcatttccttaatgattagtgatgttgagtatcttttcatatgtgttttggccatttttatatatcttcatatatatattattttacttttaagttctgggatacatgtgcagaacatgcaggtttgttacataggtatacatgtgccatggtggtttgctacacctatcaacctgtcatctgtgttttaagccccgcgtgcattagttatttatctaatg

SEQ ID NO: 58793 - DNA, 1082 bp, Homo sapiens
acattgtatgaaactcatatttttaatgccagggacttgtttcttctttgatttaccctattttatttcaaagtaattttttccttttaaaattatttaataattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctcggcttcccaaagtgccaggattaccggcgtgattacaggcgccaccacatgtggtcaaaagtgatttcttatatgagtagtcatttattatcccctagcagttggcaatttgtaaacaagtacttcatggtggtgaggtaaggagaagagggtgctgctatttaaaagaatgaggtaaaatgcagataatctcaaatttttcaaggtaaaagttcttagattaactctgcatttaactttatttgcacaatgtccatcataaactttagagtctggtgatgatggattgagcatacaaatataacttcatttccttctgcaattcactaacactataataaaataatttttttaaagagtcataaacctttaaggatgataagagtggtagaagagactatagaaacaaaattttggaagctgaaaagcaggtagatgagtggtaatgacttaggaggtctgagaaagtcagattccaaattagcagtggtgaaagctgaggacctgttcagtttacttggcagaatcttcagaagttttagaaattgctatctttaggaacctctggaagttgaggtatgggtagggctaaagtacagaggattgattgaggctggtttagaagcagtagaaactctagagcaattcccctgttgagtgccattgggttactttatccct

SEQ ID NO: 58794 - DNA, 1051 bp, Homo sapiens
atatttctgtgtgactatgcaaaaaaatcttacaggataagctttttgcattggaacattttgttgttatataattattcttcagtaagtatcaagttaatgctcattcatccaccaacaacaacaaatatgagatgactaattacattttatttttatatttatatatctccaatctgcacatcagtggtagagttctggacctcaacgcagagggttaaaatcatcatgaaaaattattgatgtgttgttcatttaggactttttatgtattgaagattatgcagcacccgtaaatgtatttgtgacctgacagtacgacacaaacgtgtggtgtggtatgtagaaacttaatgtacactagtgtttcctaaattatatttctagagatataaatgaatattctgaaaattaagagttcagtggctgtgtaagattggaaaatagtgctttttgtatgcctctttggatattacaaagcacattatcatagaaaaagtttcaaaaagtttgctgtagaaaccatttaaactttgttttacctagaatttgcctgagtaatttaacattggaactccttatgaagaacagctgacagagtttgggaaatgctggtatatacttaaccgtaggtagtgtgagagcctttaaactggttgtgtgacagaaagtggttaataaagtcttctaacacataaattgtcacaatttatatcaatttccaaacaaaggcaaaggtttgaaggtttgcctttatcctttccatattttttagcgtatctgtttatgtcatctaagcaatattaagttggtgtggagttttgcatggggtgtatatatctttacaaagaaaggacagtgagacttgatacatgacttcgaggagtttatatgtgcacttcttggtttgcaaagatgcacctgctaagctagtgattttgtttttttccagtaaagctttattatgttctaatccagttacctctctaaccattggtacagaatttgggatcgatattgtcatggctgtgaaatagaacaatgctaatta

SEQ ID NO: 58795 - DNA, 1681 bp, Homo sapiens
aaagcaccctaaaaagtagagtgaaatttgacatcataatgaaccactgctgtcaacccctaaagtccttgaaattactgagagatctcttaattatgaccttttcctgctctaattaagcttacttttctttatgtgtaggcatttacattaaatacagaaattgtcactttattttttacagctttcattactgtagatgttgcaaaactattgtctatctgaagagattacattcattactttgtgatttttaagaggaaaatatcatggactcatagttttaaaatcctgttacagtgttaagtattgttttttgcagtgtaacacattttggctaggccattggtttcagacttttggactagtgtgggaactttactactatttattacatccatgaagcgctgtgtttctagtgccagcaactatttatatatactgttaaggaaactagaaaatatatacttttattaaggagaaaacataattggtgctattttggcattgtgtgaacaattaaagctgtggttactattaacttttgttcagagtttttgggaggccagataataatcatagaggacaatctagtttcattgtttaaagacagacagcatataggggaataaaattagttttcttgcttatttttttttttttttttttggtagagatagggtctcactatgttgtccacgctggtcttgaactcctagcctcaagcaattctctgaccttggcctccccaaagtgctgggattacagatgtgagcagccgcacctggccttttttcttttttctgatttagatttatttttctctttaactcttcctcaccagtgccattcttcccactcctgatctaattatactgcaaagtactacttatatggatgaaaacaatcttttgaaaagattgtgaattatttcagtcatgtgcaatcatgtgttaactttcagttttatttcagattgcttaaacgtcactgtaggcttaatcaaagacaaaaacaccttctgtttaatttggtctattcatagtgataacacttaatccagtttccttagagtttccatggtgaatatctacaagtagaacacctaacctgaaatgtttctgttctaaaccaatatactggaaaagagcaaggggttttggattaagactgactgctttgattattaactgggtgatttagttatttaacctccctatgtctctttatgaaaaatggacataagactaatagtttatttttctaaaaagttaaaagttggtttaggattcttccttttctggtgatttatggttgtattttgtcagcttgcttcccattctgtttttttttttttttttttgagatacagtctcactgtgttgcccaggctggagtgcagtggcgtgatcttagctcactgcagcctctacctcccgaggtcaggcaattcttctgcctcagcctcccaaggagctgggactacaggtgcacgctgccatgcctggctaatttttttcttgtattttagtagacacaaggtttcaccatgttgcccaggttcatcttgaactcctgaactcaggcaatccaccgggctaggtctcccaaagtgctgggattttaggcatgagccaccatgcccgtcctcccattttgctttttaaaattttgataaagg

SEQ ID NO: 58796 - DNA, 1012 bp, Homo sapiens
accccgtcctgcatggctggagtgggaggaagagagagaagggggagatgctacacgcttttaaacaaccagatcttgtgagaactcactcactatcacaacacaaaggggaagtctgcccccatgatccagtcacctcccgccaggtccctcctccaacactgggattacagtttgacatgagatttgggtgacggcacaaatccaaaccatgtcaagggtcttactgtgttacctaggctggtcttgaactcctgggctcaagagatcctcccacctcagcctcttaaagagctgggattacaggcatgcaccaccacacccagcttttttaaaaaaggaatgtattgcttcatgagtgaaaacaggatgtcaggattaacactttaggaattttagacatatatttattttatatggaaatgtaaggcataccttagtatagcagtatataaaaacaaatagtgcagtatgttggaaattttatgaaatgtcccataattcctaggacttgaatactattacacagtaagctcaggctattttaggataaaataatttagctcaaataaatattttattgtaccactcttttatggcagtcaaaaatttattctctgacctttttctcatttggtacatttattgacagtatgttacgtatgtagctcattgtttttctcctgctggttgtgataggttttaaaaccaattactaagtctaaccagcatttaaaaaaaattaaagactagaatagaaaatataaagtacatcaaatatagaaggaataagtattgttgtgcaaaacattgtgttttcctgtagtccttattcccatatttcttactataggttgagataaaaatagtttgaaatacttcagtgtaggtgcagctatgctatgttgactgttaaacagtgaaaatatagacagttcattttttcaaaaaggacacacgatagattagggacttactcaagaacctagtgaagggaaagagtgtaaggtat

SEQ ID NO: 58797 - DNA, 2682 bp, Homo sapiens
ttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgccttctgattattagagtttaggtaagtagttttatgttatgagatatttcgctgtattatcagaataatttatatatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaagagtgccagtctatttaagaattgaaatagatcagatgttcttcatatgaattgataactgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtcttttatttaaatctttaaaagactatttgcaacaggaacgcagtattaataacacaagttgttacatatttgtgttcgttatttatattaatgaaagtgtcagctagatgctacttatctttatgctgatgatagattactcttaaagtacagtcagccaagattcttaccggctgtattcagcttcatttctatcaatttcattttattcctagttttagtccattttatttttatattggtacagttaatgttttgttcatagcagtatcaaaacaataagaaaactgacaattcaaagtcagatatgttgtttttctttgacagcctttcttgcttttggtgctgatggcttgagggaggaaataagtggaaagagaaagagaggattaagccaatgatcactagagcaagggaataaaagtgccttaagactatagatcacatttaaatttaataagatgtattatttttcatttatagtaaatagtatttgaaagactatgttttttgtctgcttagttttaagttgttgaaatgattatggtttgtatgtttgtgtatacagtaatagtcgatgtcagcataactctagaataaattacagtggagttgtagaagtaaaaataacttccacattgtaaactaatttgctagtaatgactgaattagtatatcattcgttaaatcggccaccccctactttgaaatgggaaattggaattttggggaattatttaccaatttacttaataaatgtaagataatattaatacaaaataaatatgcaaggctgtctgtacatggataactattttgatgctttttgaattttggactttgtaacatacagaaattatcactaaataactaattttatagcttattcagattttgtatatacatagaaaatagtctgtttaataaatttgtacctagagcatatcagcaggtactatgctttaagcttttctttttattagtatagttttaaagctgttcactttttttttatgacacgagtgttaattaagtgaggtgttgatggatatgtatcttttctaggacacttttgttcttcacatatgctgttcctcattgttagcttttcctgagtagaatttattaattaatcagtccgaattatcaaaatgttcacttaatacagatgattacatttattttatttaagttctcaactagaataatcagcaatattggttgggtacttgtttcctttatactagccacctaatattctattctaggaatgataatgagtaattacaattattttatctagtacaatgctggcacatggtagaagtgtgttcaatagatg

SEQ ID NO: 58798 - DNA, 1585 bp, Homo sapiens
cccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttcaaagaaaaaatacaataaaaaaacagacactagttattcaagattttccgctagtttttggtaaatattttcccaggagtagaattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaaacattcagactatggaaattattctcaaaataggaggagatattaaaatatctgtgtttgccttaggtcaacagaaagctgaaggtggtgatcagtgggttttatttcatctctacatagtacaaggaaag

SEQ ID NO: 58799 - DNA, 1067 bp, Homo sapiens
gtccagggaatagaattaaaatcaataattattcctttcacctggcacatgtgagcctcttctcaaagcagtcagagagtggactttaatatctcattctttctctgaagtaatttaatgatcacataagaaaaatgattctctgaaaatataatcttagaatttggctccacctccaagttgaaagaattttgtaaggaaagaaagaaaaaaacactcaagaaatatgtctactcctcacgtctgactgtgaaaagtctatataccatgacctgaaaaggaaagataaacatagtccatgaaattctgtggcaaaaaggaatgaaaatgtgcttaagaaaaaaaaacccaaaaactggaattgtattctctgcaggtttaaaggcaacctttgccaaaatctgctttctggaaactttcctctagacctggctgctaccatcagccttggctgcgggagagagacctggaagactgtggtttggaatatgtgaatgttaaaatcagacattgttcccttttctttacaacaacaagtctttggttttggctatatacatgctgggttttccggtaccacgttgttccttttttcactagaggtcagaactattgaagggatcttgatatttttcagtttgtttcctttttgaccactgctctcccctttcttacaatgcccttgagaagctaatgggctctgtttccatgctgaaatgaagaaatgatcgagcgagtatgaaatgacgcgtggaaggccacacagcaagttggaagaagattctggatgagaaacttgaaatttccatgtcctccccaggtctgtaaatccagtccactaagctaagtttttctaagacattgaggcccaaagatgcatgctgaaccacaggcatgaggtgtgacttcaaaccaagagtcaacactatgcggagtgactagatacagaatgctctaataaaataattatcacctgctggggcagagttaagcttaaaatcaccttaccgtggattattcaaatttatagcatattacatataattcagatagaacagggtaatgtt

SEQ ID NO: 58800 - DNA, 1047 bp, Homo sapiens
ttgctctggggtaattcaagtggacacagcctgtcactttttcctcccggcctcacttagtcatgtctggtaatggcacacacagcactgcctggtaggtgtagccagctcactctgcaggttcctagtcaccttcagatacactcactgcctccagaacattcttggcctgggtctcgtttgctcagggtttttgagaaatcccaatactgtaaagatagacttacctgattctttcccagccatcctcctgagagtgcctcggcacgtggctgagactggcaggatctgagcacaccccactcccacaccccacaaaggtgtccacggccgagatactcactgtatcccacggttgtgtttagactgaagtaggagcaaagctttaagatgaaaaaataggaattttacctgttaattgcaatggtggccatgtagttggagaggccctcaagtgtccacacatcagactctcctgtcacgtgtggcgtgttcttcacctcaaagcccgggagcgttggggaggtggtcaggtgactgcacggagctgagggtgagtggggctccccaccagccatccaggctgtgtctcccctggggctgcatgggcactgccatcattaaagatccagcaagcccagtggctcaacaccgggaggaacaggcttcacattcacgactgtggcatcaaggccagtggcagagcgggaggaagcagtcacccaaggtatggggttgggagggcccaggaaggcctggtgtgccttgggggcaagggcagcacgttggtcagatgcgggcccccttccttgcaggaggagcctagtttcacaggagactgtctttttgaggcaatacatgtgtttcctatttagagaattcctagtgcacagttgaagctcaagcagaagccagagtgagttacatttctggggaaaataaaaatgcacgaaaccccccttcatccagctgtggtttttgttgcagatgctattaaagccatcatgctgaaacgtgtcccagtggtgtgggttgcaactgggggtg

SEQ ID NO: 58801 - DNA, 1026 bp, Homo sapiens
tatgtactttaatcccaaatttgagttattcgcaagagtgtatggacatagcgacgggggaaaaagccagataggagtgtgcttgtgtcactgatggtgccagcctaacagtggtctgtattatgggcagattttgttttattccttaacttctctcatgtttcctggttttctacatgcagttattaacagaaaagacaaatagtggtgtctcctgatagcactgcacgccatggtcatggagagggcagagctgatgcaggggctagtgggaggcattggagctgtgggtcctggcaggggccttgggccatctccccagccgtcagctcatgggagccctgtggccctgaaggacatttaaattctaaatacacttaaatcacattttagtatggttgacgagggacatagggactgagaccagatcccgagcggatccatgtccctggcttccaggaggcctcctcacaggatgtgggcacagggacagtgtgagtgtgcagcccagccatcccttccaagggctgtgcctgctggttccagcaatgccctcaggatcacactgacagcaggggcaggtgagaagggagcaggttagcagagccagcaaggggtgggctgaggctttcttccctgtcacagcacaatttgggtgtgggccacgtgagatcatgggccaggcggtggaaaagacctcctgtgtgaggtcatctgcccgtcctcctggagccactgaccccaccatatactttccagagccccatccagcgatctaagtcatgactcaacagatggagtttctgccagctcccgagggtgtagaagccctgctgtctgggactggggctctagtcaggcatttattcatctgtcttatgacaaatatctcagcaggaaggccaggtttggaaagggacatgtggctcatttcacctctgccgtgtgcctgtgagtgacctcagcccccaactccctgtgccatctgcagaggggctgggcagctggccggggaagggctccttc

SEQ ID NO: 58802 - DNA, 1082 bp, Homo sapiens
cccccagccccatgccagccagccactgccacgtggtgggccagccggcggcccctgccctgcaccctgtgggcagacgcccggcctccaggcagctcagtgcagattctcgagctgggggtggtggagaggggcgggcatggtgagggggcagggcagccctttgattggttcatgtcatgtcatgaggaagctgcttgctttgtgtcactgggggacagattgggacagatgccggtggaggcagtcttgggctcgcatctggccatggaacgccatgctttatggccctgctgttgtgtgtgctggggacagggtgacctgcactgacctggcttggtttgagggtgtagtgtgtgtgtgtgttgtgagagtgtgtgtgctggcgtggtcagtgtgcatacgtgtgcgtatgttgtgagtgttgtgagtgcgtgtgtgctggcgtggtcaatgtgtgtaagcgtgtgttgtataaatgcatgctggcatggtctgtgtgtgtgtgtgtgtgtgtgtgtgtgtgtgtgtgtatactggcatggtcagcttggctgtgctgtgctgtcagtggcatggcggtgccttaggttcccagagcctctcgccctgggctccgtcttgtgggtgtcctgatggctgtgggctgggttctgggcgggttgctggtatggatacaggaactactgagtgaataggtgtctcagagccctaagggtctccagaaagccggggtgtctgtgtttttaaaagaaaacctatttatgttgctgtgggtctctgccgtccctgtgttatagtacataagaacctttattctcctgtggttcagagagcaccccgacatgtgcctgcagctgcatccccgtaccacagtgtgggtgcaagacgctgggtttgtcctttgtctggtgaagcctggctagaaggggtgggggtggtagcccctgccctctgcagtgtccgcatccactggtccctgagcagcatagctggccacaccctcatgacatgacaagactgtcactcagtcactattgggtctatgaagggcgtcaagtcagaggaaggtttttattttt

SEQ ID NO: 58803 - DNA, 1023 bp, Homo sapiens
ggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagtccaggcagccagttgctgctttgcaggaattgagcagaaatgcactcggaatcgcgggcaggaaaagaagggaggtcggaggctttggatggtccccgaagtcgccgcctagttgagagctgtagagttggtgccactgcccctgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcattta

SEQ ID NO: 58804 - DNA, 1052 bp, Homo sapiens
ggattccaggacttgccttcatcctcaggttaatattctcctgtgattgttacaagctctctaaggcatagttgcatttattgccttacagctgcgcagctgccgcaccgtccagataggtagtttcacattctcaggtgggtcagatgaccttgttagcgacttgacagacatgtcctggatgctctttgttcccaggaggctctcaggtcctcccccagggtcctgtcactcagccacctacagggatggggagacagtgaggctggctgataagccataaagtccttgactaatcctggtttcctggttctcacacagtggtaacaagggcttgcagccggttgtcagccaacagactgggaagggtggtgcttcttacaggccctgataacaggagaagcctaaatgacaagagaagagacagggaaagcataaaaggcaggcagattttcacaggcacagcaattgaaaatgattctgtttagaaggcagacattctcccacacccttgaggcccagggctcactgctggtgtacagcatgaagtggacaggagagttgattcagtccatgaacatttcaggaagttagaagtctatagttgtggattgcaaaatacatatctggcctgcctcccatttcctggctaaaatacttggaatctccgaagtgatgatgtctttttgtaccctaatgagttgaccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatga

SEQ ID NO: 58805 - DNA, 2852 bp, Homo sapiens
gacagcttcccaagatgagggcaacagtttctcaattcctgactcagccattttccctcagcccccatcctgaggtggatttggggggcatgggaggcagggctctttccctgtttccctgcaggcttccaggaggtggggtgaggcagtggtgcatccctgggtgggtgggttctgagcaaccactgctgggcagcacagaaccagacatggagcaccttgtctctccaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggtgaggtgggggccagcagggagtgggctgggctgggctgggccaaggtacaaggcctcaccctgcatcccgcacccaggcttcaacgtggaaaccgtggagtacaagaacatcagcttcactgtgtgggacgtgggtggccaggacaagatccggcccctgtggcgccactacttccagaacacacaaggtaagtggctggggcctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcgggcccagccaatgagacctgggccatacagggcaggggtcagcaggcaccatggaagacctcagcctccgtccttccctccatcggcctgctgctgaaccccactttgtatagctggctatggggcagggccactgctagcatacatagggctttgtgccaaccagggaatggtccctgcctgagtgggcacagcccccacctctcctcaagatgccatgcagcagggggctgccagtctgggggtacctgtttctgggatg

SEQ ID NO: 58806 - DNA, 1033 bp, Homo sapiens
tggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctggtaatgtctcctgtggcccggcagtgcccaatcacagccagcctcagtcatgttggcactctgctgcagcactgtcggctgaccagagcttgaacatttatctgcagccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcggtaagcttccctctccaggtgcttccaggtgccgggctggggtcgaggctgtggtgggggtgctggtgaccagtcgccttcggatggacatgtggctgtggtcactgtaccacatgacaggagtcaggggagcaggtggttgttggaggagtggaggaaggcttagatccaaaactgactctaagcaccaaaattagataggactaaccagtagtgtgtttttattttttaaatttatttttttgagacagggtcttgctctgtcaaccaggctggagtgcagaggcacgatctcggttcactgcagccctgaccccctgggctcatgcggtcctcccaccccagcttcccaagtagctgggactgcaggtgcacaccaccatgcctcactaattttttgaaagatatttttgtagagatggg

SEQ ID NO: 58807 - DNA, 1054 bp, Homo sapiens
actttgccagattttcatgttaagccagccaatactaaaattgtttagatatacaatttgaactccaaggtctgagtcaaattacctatgataaattggagaaacaactggtattcaagaggacataagtccagtgttaagcatggactcatggagaaccaggatggccaccttgtccctcttgagactctaaggcttttgttattaatggttctggattttatgattcatcatggaaaagataaaatgacccaaatttaatatactgatgtggttaacttgtaaattgtgaaaactgtttaaaaccaatacctccacagttgccagggatggcagagctgaggctgctttcctggacactgagcagaatcctgtggctctcgggcctctttgagtggggagctgcccggcagccccggatcatggaagagaaagtgctagaggtttatgatttgattcgaactatctgggacccagaaaagcccaatactttagaagaactggaattggtaacggaaagttatatggaagttcaggagataaatgaagaagactatctggttattatcaagtttacaccaagagtacctcattgatatttggcgattcttatggggctgtgcttaagaataaaacttcagcagtgtttaccatttaaacataagttggaaatctacatttctgaaggaacccactcaacagaagatataagtatgcagataaacaacaaagagcaagtggaggctgcaatggaaaaccccagcttatgggaaattgcggaacagtgtgtccttgaacctgactggtagctattttaagagccactgacctgtaatttatatatttgtttaaactctttgtataatgtcaaagactcacgtttaatacatagatgatttgtacctcagatcatttttaaaggattatttccaagcaagatttaattttaaggtagtacctaatttgttcagtgtataacattctcaggatttgtaacacttaaatgatcagacagaataatattttctagttattatgtgtaagatgagttgct

SEQ ID NO: 58808 - DNA, 1109 bp, Homo sapiens
tgaggacagccgcaggccagtgggctgctctgggggtcgtgtgggacctggggtggggctgcatgggctcactgtgccctgaccccaggccccacccacaggcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggttagatgggacagtcctacccaagcactggcatgagacaccgaggtccacggtggagggagagcaggaagcccagcccttcctggataccagccctcccaactccctttcttcctcactggcaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaatgagtggaatgtggccccaaggttggtggggccccatcatcccgatcgggccctgagctccggcagcccaccctaaccaccagccccaaggagggccacaagatggcctctgcctaggcatctgctgcctgccggctcgtggctgctgccccagggcagcatgatgcttgactggcaggcagggaaggtggcagggctggtcccaacccacctggcaggctggcaagtggggagcaggaagcggctgcatggggcagcctgaggctgcaggggtgggccctgagggctgcctcttggtgcccgaccctgtgggtctggcatgggccagaggttccaggagaggcccctgagctctggcagctggaggttctagatctcgaggtctaaggggttccctgagggagatgcccctcccctagctgc

SEQ ID NO: 58809 - DNA, 1074 bp, Homo sapiens
cctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctctttaaaaaaaaaaaaaaaagcaaccaagattccctcttgatatct

SEQ ID NO: 58810 - DNA, 1153 bp, Homo sapiens
cagcataggcttggtccaaggcccttatgtgagccagcaggtgagaaggaagaggaggaggagtagacactggcttgggaacaggagagctcagcaccttcagagccagcttggggacagatggggtgggcagccagaacccttgaggtagctttgcaaaggggggtgaggcctgggctagggtagcaaggtcgaggactagaaatgccccatatgagaaaaaggaaagaatgtggctggggctgtcagcctctggcaagaggctgcccacctaccatgagggctcacgcttattggagggcattgagttccctgattcaccaggcagatttcagtttgtccccattgtctttgaggaggggacagggtgtcaggtgcaaaagggcaggcttctgtgacaggactcatgtctcatggtcctgcctggcctctcccgcaggcgaagctggagaagtcactggagcatctccggaagcagatgcaggatgcgttgctgttccaagcccaggcggatgagacctgcgtcttgtggcaggcaggtgctggggctcccagggtcctgggtggcagggtagggggtgaaggtcctgtataggagaccccagggggcgatgctggccaggcacacttgcccttggcgccccaggaccagtcactgcttcagcctggccccaccgagcccactgaagggctggtcctttcccacgtgcacctgtcctgccaggtcgtgggcgtgggctcccatactgcaagggccccatcctggggtcccagcatgcttgggtggcaactctcaggtgtatttagggtctgggccctggaggtaaatttggaggttttgagggactaggtcatagatgtgggattcagccatcctgaggagtagatttgggatctgtccagttctggggtagatttggggtctgggaggctctgggtggtggatttgggatctgggaagccccaggggagaatttggaggtcaggagggaccctgggtggtagatttgtagtccagctggccccaggtggtagatgcagggttctaccaagccaatgggtggatttggaagttggggagggactagatagtggatttgggatctagtcggccctgggtttagatttggggtctagccagtcctgtgtggta

SEQ ID NO: 58811 - DNA, 1102 bp, Homo sapiens
agaaggtagaaacaacccaaatgtccatcaactgaggaatgggtaggcagattgggatctatccaattacaatgaaatattattcagtcattcaaaaggaatgaagcactgacatgctactacagggtgaaccttgacagcatgctcagtgagataagccagatacaaaggccacagattgtctgagtccactgatacgaaatgtccaaaacaggcaaatccacagggactgaaggcagactggtggctgccaggggctggaggagaggagtgcctgcctagtggggacaggtcttcctttaggggtgatgaggatggtctggaactagacaaaggtggtaactgcacaacattgtgaatgtactaaatgcacctgaattgtgtactttaaaatggtacattgtgtgtcatgtgattttcaccgctcgatttttttaaaaatctgaacctaatacacgaatgtgtagcaaatcatcaccgtaaccaggagaacaagaaggaaaggcaagaaagcctggggtcccagaagggctatgaggagggtagaccagatgcccaagaggagagaggcccatcctagtgcttttcaggatgccactggcctaccccaggtataaagagggggagcagggactgcccttggtgcagcagcagccatcacttggggaccttgtggagagaagagggccctcttggtggctgtgggcaactcatctctgcagggctggctgtctgtcctgtggatgcatcgtgacttttccctgcctgttgcattccccgcccgctgcattcccaacatgcacccaccttcactggaagtttgctcatcacacttcacacatccctatgggcaggcactttatggaggaggaagagaaaaggagatatgtcccaggaggagaatgcagctgaagccagcctcaggagtaacccacagagagagcttgcagttttgcagaactctcggcttggctcagctttgtcccgcatccctctcctcctctctcctgactgtgggtctctccccagccccagctggtcagttcccacatgctcaacaccaaaatgctcgagtcttccaattgaaaaacgaaaacgaaac

SEQ ID NO: 58812 - DNA, 1439 bp, Homo sapiens
acgaaggagttcatgatgcccatggccttggacgagatgccggtgtcggggtgcacctgcttcagcaccttgtacacgtagatagaatagctctccttgcggccgcgcttgcgcttcttgccgtccttcttctgtgccttggtgacagcctttttagaacccttcttgggcgcaggagccgatttggacgggtctggcatgatggctgagtctctccaaacagaaacgcgcggcgctcggagtaactctatttgtacgttttgtattcaaatgaaggctcaggatttgctcacttctgattggatcaaacgttgttctacgtcatcgctgggaaaggaatacgcaaattaggagtgccaggttctttttctgattggctaccatagccatccaatcgaacgccgcggtctagcctacctctgtaccatacataagggctcgctggccttcactgccctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctactatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaagtagtttgcactttaattctgaagagtaagtctatggatttctatttaaattgctaagttttaacaatgtgagctccaccagtgttaa

SEQ ID NO: 58813 - DNA, 1041 bp, Homo sapiens
agcatgttttggagtggcatgttcttaactccttcaagagcaaacaggttccccttcccctggggagggtgggtgaggacacaggtcttttcctgccacccgtttgcagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcaggtgcgggagccccgctgggtctgcccaccatcgggccagggtggacgcaggcagcagcgagccattgggggaccattgcccgaagtcaaggcttaaaagcccagcctgactcccactgccgtggccttgcagggctgaatttcgggaatgggtgggtggtcagggaaggtgatgggaaggggttttaagttgaggagggtctgaggtgtccctgaccttcacaaaggagggcacttggcatcccgagtgcccgagcatggaaggctcctgcctcgccctggggtcctgaaggcagaagcagccaagaaacccaacctcagggcttttcttctgcctctgcccagggcctggcctgaaccccagaccctgcagcaacccagatggccctgaacggttcagttgcccgtgccagccataggtgacaaggctttggccctggggagacggaagtctgggccaggccctgggtttgttgtgctcaggacagtacctcatgcgctgtctcatgtgcgctctctctttcgctctctccttttgcctctgtctctgactctgtgtgtctctttctctttttgtctctctgtctttccctctcccctcccatgcagtgatggcgccaacccgtggcagtcccagagctggaggcaggaggatggatcctcatctccatgggaagtgtcagcgtgtggctgccagggaagcgtggcagg

SEQ ID NO: 58814 - DNA, 1328 bp, Homo sapiens
cctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccaga

SEQ ID NO: 58815 - DNA, 1861 bp, Homo sapiens
aagagttgagagtaggtttgggttacactcagctgaaggcttaagtccattttatttctagaacccacctactttgagcactttttctatgttaagctgtaagtaggtcttgagtgtcgatgaacacgttgaacatgtttggcagtgttcagaccatagctggccctgaaagcagatggctgccacaccttcgctggtgcactggccccgcttgggtaaacagtaggatcgtttcaaggatgctggctcttccttctagaaccagcgggtcttctatcacctgccagaccctttcatgaaaaatgtgaaggtgatctttttactgatgagaattcatgaaaacataacttttgggtactttgcttggttgcaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatac

SEQ ID NO: 58816 - DNA, 1029 bp, Homo sapiens
tgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataattta

SEQ ID NO: 58817 - DNA, 1023 bp, Homo sapiens
accattagtattcttatttcatggtaacttccaagtatgtttttactttgcaactctgaattgaatcttttcttctaatagaggaaattaatcgaaaactagtagaaactaataaatagaaaatgaggccagaggtgatggctcacgcctgtaatcccagcactttggaaggccgagttgggcggatcacttgagctcaggagttcaataccagcctggccaacatggcgaaaccccagccctattaaaaatacaaaaaattacctgggcatggtggtacgcttgtagtcccggctacttgggaggctgaggcatgagaattgcttgaacccaggaggtgaagtttacagtgagccaagattgtgccactgcactccatcctgggcaacagagtgagactctgtctcaaaaaaagaaaatgagttttagaaggagcaagcaggacagttgaagtttgccaagctgaagtaaaagtcacctagaaccaagtcctaggctgtcactttgacgtatcagtggccatatttatacagcattgttccttaaaagtgaaacagtcaggctctcttctggacatttgcctctgagctggtgaaggaatgtttgcctaacctttaaactcctttgtactctgtgcttatttgctcttctgtaaaaggaggctctgtgtagcttgacagagagatgaggaatgaaatgtactgggtttttgtttccctttttttttttttttttttttgagacaggacctcgctctgtcacccatgctggagtgcagtgacacaatcacggctcactgccacctccatctccccatctcaagtgatcctcccacttcagcctcctgagtagctgggaccacaggtgcatgccaccacacctggctaattttttttttttttttaattttttttgtagagacgaggtctctgtctgttgctcagtctcatcccgaactcctgggctcaagtgatcctcgtgcctccacctcccaaaatgttgagatcacaggcatgagccact

SEQ ID NO: 58818 - DNA, 1048 bp, Homo sapiens
cagtattacagtatttgccatataattttgagaattatcagaatattttccttaaaaatgtatcattttaggctgttcaggttgaattgtgttccccaaaatatctgtttaagtcctaacccctagtacctgtgaatgtgaccgcatttggaaataaggtctttgcagatgtaatcaagttaagatgaggtcatcgtactgaattatggtgagccctaattcagtgactggtgtcattataagatgagggaaacttagacacaaatgcattcagagagaaagagatgtgaggatggaggccaagattggagggatgcatctaccagccaaggagtgccaaggggtggctggcaaccaccagaagctagagagaggcaaggagggatccttcccttgagccttcagagagaccttgaccctgtcagcactctgaatttgaatgcccggcctccagaactgtgagacaataaacttctgttgttttaagcttcccagtttgtggttctttgtgatggcagccctaagaaactaaaatataggctttgctcatcaaaatacgattcatgagaaatttaggatgacaaggcaagatgaagtgaagaagatatccttggtaaaggaaatagcatttcttttccttttttttttttttttttttctttgagatagagtctctcactgttgcccaggctggagtgcagtggcacaatctcggctcactgcaacctccacctcccgggttcaagcgattctcctgcctcagcctcccaagtaactgggactacaggcgcccgccaccacacctagctaattttttttttgtatttttagtagaggcggggtttcactatgttggtcaggctggcctccaaactcctgacctcatgatcccgcccttctcagcctcccagagtgctgggtttacaggcgtgagccaccgtgcccgtgtataaatagcatttcaaagtcacctggttccaataaagtatgaaataacttgctcttagggaaatcaccccaattgccctttaccttaatttcatgaaag

SEQ ID NO: 58819 - DNA, 1016 bp, Homo sapiens
gtgtcttatttaattaagtttatcttaagaaagtatatgtgaggcatggtaggtggtgggtaaaaaggagaaagaaccagtttggggtgttttggcagaaagctttgaagaataataaaatcctagaaatttactctgcttcttccattttcatcacccaagagcttgttggagcctgtttgtttagtgacatggacccagtgtggcttagtcacagaactggtccttactgaatttaacaagtattcattcactggatagtttatttacaagttgccaagactttgtgtggtacagtcttagaaaagaatacccagagggtactgggccaagtacccagcttatgtaatcattctgtcctcctcagagaactcccctgcatggtcctctctgcaactcctcacaacagtaatgaacggaaggtctctctttgtaaccaggatgcccctggcctttagttactattttttttaaggatcttaccctgcatttttcctggtagtttactcctaatggaatttccatactagttctatactgtctgggcatgaaacagactagcatagtcactgtaaccatttatctaccctctgccctgtaaataataaatccagttgccagtggcatccctgatctctgaaacaattaaattttgttctgcagttacaaaatataaactagccaatggactgtatagctgcgatattcaatttcagcttatctgtttatcatcacagaaatgttctttcataggcagtgtattcccgctgggtttagcaaaatacttattttgcctgtctcctgcccattcaaatagtactaatttctccaacaaattcatcccaaatcatttccatagaacactacgattaatgaaatctcaaacacctgtagcttgcatagggttttgttttggggtttattggagggtgtattgttttggggtttgttggagggtgttttattttggggttttttggagggtgctttgttttggggttttttggagggtgttt

SEQ ID NO: 58820 - DNA, 1051 bp, Homo sapiens
ctgagtgacatcctctcactggacaggttcctacccagaaagggcccccagatgatgccatttagatgacacatttctaagacagtgctactgagatcagcactgctgaatgtgatttcctcatggataggaatgttctataatctgtcctgatatggtagtcaccagccacatgtagctactgaggacctgaaatgtggccagtgcaatcgaggaacagaattttttatttcagttaaattgccatatgtcacaaacagctactaactgcttcacattaactaatttaaacctcccaataacctcctgaggatcatgtgattattactatctccatcttacagacaaggaaactaaggcccaggcagctgaagcacctggcctgagagggtcaatcagctagtgactgcaactgggatttgaacccagcaatctcagcccagagtctgtgtcctcaccctctctcaactcacttctaataactttccatacataaagctttgtgaaccttaaggaaagtgtccaagcatcatgtcaagaaatgtaatgtaatagcatggattgctttatccacctaaaaccttacaaacacatttctctgcaggggaaagcagtggtaggggctcgttcaaagacctctgagaccccagatggaagggctaaggggcttcctggatgccagccacaccaccgtccctggacacacaaagcacacactgcacggagggcacctcgccaagaccagcctttgggctgcagggcactgagcaccctccttcaccagggggagctggcattacctggtgatatcatagacgaggagagccccggccgcgcctcggtaataacttctcgtcacggacctggaagaattatactggttttactttcaaccaattgagaccctttactgtatcccactttcccatgaaaaaacacccatgcttgctttgtaaaccacaacacagggacagacactggtttaaaagagaaatgattcaaagatatttgaacatacatgtgaggggttattctgcctgaaatcacatca

SEQ ID NO: 58821 - DNA, 1070 bp, Homo sapiens
atcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatctttataaagaatcaatgtgataaagtcctgtaaaacaaagtgctggcacattgcaaggattcattaagtggcagcaattagctatgaaatcttgcctaccagagtctagtgccttgcgcatgctaagagctcaatagatatttgtcaattgaatgaaggaacatctctttccttttgccccatgactgggcaaacgaaaaataacaaaatatctcacttgctgtctcattttaccagaaacaaaatggaacaaactgtgggtatggtatatacttggtgcattcacgttgtctgagttatcttaaaggtgttggtgccattaccctgaaatgttgaaaagcggtatgagtagtgagaatgactggaaagagttgctagttttataaaatacatgtattattttcacaatcttatattacgcagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatggcaagtgaccttttacttcttactatttttcaaatcgcatatttgaggataatagcatttctttgaatttaaaacatatattggaatttcaagattaaactagatttaggaaatgtggaatttccaattgtttttttctataaattagacctattaagcatatttttagtatattgcattctgcctgcagaagttactataatgataaaagcaaatgtagtaacattatgtaatgacttttcagtctagggtctttgaatattagagatcttg

SEQ ID NO: 58822 - DNA, 1044 bp, Homo sapiens
gctttaagctgtatttacttttgcatttatagttatgcagattttgaaattgttcttaatattttttaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaat

SEQ ID NO: 58823 - DNA, 1052 bp, Homo sapiens
ttacgaattgtgcagaattatcttctggaagttatggcttccaataacagccatcttgcttgctctcgttcttacaatttagtcagctgagttcaagtgacccaagtataaatacccttcaagttgctagcaattgatcttcgatgaaacacaatgacaaagatattacatatgaaatggtataaatatgtgcctcctacctaatacgcaagtaagatcacctatagcctattatacatttattcatttttaaaatgaatcttttgaagatccatttattcacatttttccaagtaaatagaatattaactataactactaactataatcttttaaagattcattttaaaagtgaataaatgtgcttagaaattttaggggggagaacacacataacatacatataaccagaggtgccaagtattttaacatctcctaactaagggcagttaaaagacaaagaatcgattcctgttcacttctcctcccgcggacttaatgtccagcagagtgctagacaatattgcttcaatattctattactttaatattaaaagcagtaacaaaatcaaaaagcatatttatgacattgttttaattaagttaaaatcaaaattttaaaaagagttttatgtagcatttattttaaatatcattgggttctctgtttcagactttttcaacatgaaaggtaatttttaaactgtctcactgtcttgcaggttgtcccaagaattaggaacatgattacaaccacattcatttctagaatgaaaagaaagaattaggaccatcagactgttaacaactatcaaattttcacaggttcaaaaggtaattgacactctttaaaaaagaaagaaaagaaaccctaaccaactaaggacttggatgtaagatgaaggcttacaattcatactgatttattaaccattcatgcactttaaaagcactttaaaaatcccgttcatttgtcttccacttaaaaagaggaaaaaattggccaatatttgccttctacattatatctctgtctggagttttaagtagta

SEQ ID NO: 58824 - DNA, 1128 bp, Homo sapiens
ttcacctcaaaactatgcaaatatttaaaaagtttttttaagctcacaatacttcagtatgtgttttcaaagcttaaacagttatcatgtgtgaagagtttatggggaatgaaagcaatatgttctaaaaattgactatggttttccaaagacccagagaaaaatactaaggtaatactcagcctcacgtccactcacacatcttcgggtgccaagctggcataggcagagcaccattatctcttataaggaacttagcacatatccttctagcagattcttgtctccacaggatggagaagacatcattcatttgatggaaaccagtgtttgttaaaaccatttttctacccccaaagcaaacatactaaagagaaggagcactatttacataaatttgtgcctacccacacaccaccattctctcccattaaagtgtagataagatctactggctaggaatcaaagagtaacgtatttcaacctaaagtttgaatactgtacatcatcaagactttgttattgttaagtgctataaagaaaaagagaaagtaggggtgggcagtctatctaacaggcatcttcacactggtccccatcccagtggaacaagcaatgccaatgtaccaagtgcaattccagattgtaagtttgaaatgtcattgccagccattacagaagaggcaaaagtccacagtgggtgtatgccaaaaggtcaagtgtgacaagggactgaatccacagtatgtattctttaaaaaaaaaaaaaaaggcaataaaaaaagtgagtctttgactactcaaaagaaactttactactactgtacacacatattgtgttgtgtgcacttcgtctattggaatgtacttgagctattaaactattaaataataactgcctagatgatcactgaaagagaaaaagagaccctcgcccagcccagataattcttaaatatcacaatctacataaagatgctgctgaactgaaatacaaataagttaaaaattttcaggaactagcaaagttctactttcattatacatggaatcagtagtagtgctgacactcatttttgacttgatattctttcacaaacaaaacggcatataaggaaaacgagtctt

SEQ ID NO: 58825 - DNA, 1027 bp, Homo sapiens
ttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatgg

SEQ ID NO: 58826 - DNA, 1069 bp, Homo sapiens
taaagaagcgccaggttatcgaagctgaaggaagctgaaacagctcaagagaccagtggcaaatccagatgggccgtcgccagccttggctgtgctgctcctcctaaccttccggccccccaggaacttgtgaaccccaactccatctacatctttgcctggcttggtgtcactaaactcttctgggtaactccaagccaaaacccctcgctctgcaggccaccaacatgcagaatcctcctttggttcatcagaggctccattctggagttccccaacccaccatgctatcccctaagatctcccatgggcccaaagcacccagtggccaaaggacacgatgcccgatgacaggcgcatggcccagctggccactctcaaagggaacacagaaccacaagggcccagagcgcacctcgtgcacaggagcggacgcacagacgttgtgagtcttctggcttcctgtatcggtctgtttttctccccagccataaagagcaaatggatgcttgttttcttttattttactcgatgatctttggggacttttgaccgctttcctgtttcctctagcaaataaggcacttggttgctgtcgaggctcagtactggtgggtgatttgtcagtctctcttgttctggtttgttgttcaggtttatcttctacatctttcactggcagtgcttttgaaaagagataaatgagatgaaaatactttgaaatcagatttatatataattaaaatatttatgttgaaaaatcataatgcttaagacagtaacattttcacttatggctcaactcatacgatccacttaaagtagaaatacaggaacaagttagcataattttcaaaccatttatctcattttaaaatcaacaacaaatataccaagattgaaccaagcttattcaaaagcaaccactgctactccgattctgagacttagcatctggaatgttaaaagatagacagcaccacaccctaagggctttctccgcaatcccccaagataaatccaatcatctcaattttgctttccttcacggaaagatctggatttgtgg

SEQ ID NO: 58827 - DNA, 1048 bp, Homo sapiens
tgggattacaggcttgagccactgcgcctggccttctttaactgatttaaagtgtccagtttggctgggagcatttctaaataaataaataaatgaagtgtacaggtcagtggcattaagtaccttcacatttttgtgcaaccctgttttcactttgacctataggttatttagaaattttttttttttttttttttttcgatggagtctcgctctgtcgcccaggctggagtgcagtggcgcgatctcggctcactgcaagctccgcctcccgggttcacgccattctcctgcctctgcctccggagtagctgggactacaggcacctgacaccacgcccggctaatttttttgtatttttagtagagacggggtttcaccgtgttacccaggatggtctctatctcctgacctcgtgatctgcccgccttggcctcccaaagtgctgggattataggcgtgagccaccgcgcccggcctagaaatgtttttaagtttcaaaactgggagggattttttgaagtttttttgttgtatctagtttaattacattgtggttagagaacacattctatataatttcaattttgtaaatatcttaagatttctttatggccttggatatgcagattcttataaatgttccatatatgattgataaaaatttacattctgcagttgttgggttcagtgttctatatatatccattaggtcaagtttattaattctgtttaaatacatttgaaaaatcagatgttcagtacagctctctctgtgatgatgggcgtgttctccatttgcgctgtctgccagggtagccactagccacatgtgggtattgagcacttgaacgataactagtgtaacttgaggaactgaatctttaattttatttacttttaattaattaattaaaatttatatttagtaaccacgtgtggttcatggctattgtattggactggccagttctaaattgagactgaatttatttttatttgaatgttctgccaattactaagaaaggggcattgtaatcttccacc

SEQ ID NO: 58828 - DNA, 1006 bp, Homo sapiens
tcttatttctgttttttttttttttcccatttcttttttttctgaagtccttagttggatattagactttatcattttatcctctaattttctaagttttttcttgacagattttcatcttttattgttttgttttctgggtgatactctcagctgtatcttctaaatctcttattacattttccatttgagggatcctatttttcttttaaatgtaagagctcttgaattgttttctgggctgccatttattccctcccttacctccctcctttccgtccctttttatttctttttacaacacagtatctggttcctgattgatgcatgtagggttttatcttactgaggatatatattagaatttttcgtttgttttcttctctttctgtgtttcttcagcacaatctttcacttctgcctctttgtttctttttgctggtaattctctattttcatgttaggcacttttctcaaatgtctaatgatccttcgtttctcattcttatttaagggatggatactaaaaagctgttaggaaattctgtgtgtgtgtgtgtgtgtgtgtgtgtgtgtgtgtgttggggtttgggggtggaagtgcttgtgaaccgtgagattcttttcctcccatagccaatatgctatgaagagtggtctagactgtctccgattccttacttcatagtcacgttttctttttaggttagattttatttttagcaaagtttacatgtgcagtaatttaaaacattttgcttaaaatgaaaaaaacatgatcctgccccatttcccacccatgccccttgctcctttcactcagtttcgctttcctttcagcattggccaccctctttttatttaatcttatctgttggctttttgattgtgaacattatctactgacttcccattatgggagatgaagatttagctcaggatcttagctctgccttccctattctacccccagacacataccaacacccatttcctcttctccata

SEQ ID NO: 58829 - DNA, 1077 bp, Homo sapiens
gggtaacctctgctgacccccactctactttaccataagtagctccaaatccttctagaaaatctgaaaggcatagccccatatatcagtgatataaatagaacctgcagcaggctctggtaaatgatgactacaaggtggactgggaggcagcccggccttggcaggcatcatcctctaaatataaagatgagtttgttcagcctttgcagaaggaaaaactgccacccatcctagagtgccgcgtccttgtccccccaccccctccaatttattgggaggaaggaccagctaagcctcatctaggaagagcccctcacccatctccacctccactccaggtctagccagtcctgggttgtgacccttgtctttcagccccaggagagggacacacatagtgccaccaaagaggctgggggagggcctcagcccaccaaaacctggggccagtgcgtcctacaggaggggaaccctcaccccttcaatccctttaggagacccaagggcgctgcgcgtccctgaggcggacagctccgtgtgctcaggctttgcgcctgacaggcctatccccgggagcccccgcgcctcctccccggcgctccgccctcgcctccccccgccagttgtctatcctgcgacagctgcgcgccctccggccgccggtggccctctgtgcggtgggggaaggggtcgacgtggctcagctttttggattcagggagctcgggggtgggaagagagaaatggagttccaggggcgtaaaggagagggagttcgccttccttcccttcctgagactcaggagtgactgcttctccaatcctcccaagcccaccactccacacgactccctcttcccggtagtcgcaagtgggagtttggggatctgagcaaagaacccgaagaggagttgaaatattggaagtcagcagtcaggcaccttcccgagcgcccagggcgctcagagtggacatggttggggaggcctttgggacaggtgcggttcccggagcgcaggcgcacacatgcacccaccggcgaacgcggtgaccctcgccccaccccatcccctc

SEQ ID NO: 58830 - DNA, 1096 bp, Homo sapiens
gacaggaggattgctggaccccaggagttcaagaccagcctgggaacatagcgagactttgtctctacacaaaagtaaaaaattagccaggcacaaagtggttgcatgcctatggtcctagctactcgggaggctgaggtgggaggaacacttgagctggaggagttcgaagctgcagtgagtcatactttggggtccatactgaatatgttacttactaatagaattttcttcagaaagatacctcactacttggtttctgaaatcaaataggtaagagttatattgagtcagtagctaccttgagtataacatctttttttaaatgtgttttccttggcgtctcttgcatgttccctagagtgtaatgtcttatatctaatgtagaaactgtcagggtattcagcatgtaaagtgcctttatttaaatgatttgaaacagtatcacaaaactcagattctccatcccccacagccatcaaaataaaaccatgatagcaaacaaatcatttaattcagctatatcagtgatttcatttttccctcataatgattttgttttctagctggtccagttctgatggcaaagatgatccaattgaagtatctaaagacagtatatttgtgaagatcttacagaaacttttaaaagatggtaagtggtttgttactataccgttggaaattacagtgtcattcctcagttttttgggtttttttttgagacggagtcttgctctgtcactcaggctggagtgcagtggtatgatctcggctcagtgcagcctccacctcccgggttcaagcaattcttctgcctcagcccctggagtagctggaactacagacctgtgctaccatgcctggctaatttttgtatttttagtaaaagcagggtttcaccatattggccaggctggtctcgaactcctgacctcatgatccacctgccttggcctctgtctaaagaaaaaaaaaaaagaaccaagaagctttcatttggagtctgtccacactgatctccaagcattagtattcagatttgtagcttcctttcatagctgtaaaaatgccacagactgaattgtgtctaatt

SEQ ID NO: 58831 - DNA, 1061 bp, Homo sapiens
gacttttacattaccttattttaaaatcttacccctctcaggccgggcgaggtggcttacacctgtaatcctagcactttgggagaccaaggtgggcggattgcctgaggtcagaagttcgagaccagtctggccaacatgctgaaaccctgtctctactaaaaatacaaaaaaaattagctgggcgtggtggtgtgtgcctataatcccagctacttgggaggctgaggtaggggaattgcttgaactagggaggcagaggttgccatgagctgagatcgcgccactgcactccagcttgggcgacagagcgagactccgtctcaaaaaaaaaaaaaaagaaaaactcttacccctctcaaggttgctgataaaatcatcatcaccacagagtaacctgaaagtaattcatagatattaattggcttctatgtatgtagtattaacataatgaaaatttaggcatgtatttctttcagagccaggatttaatcaggattttttttgttttgctgtgaaggaagaagatataaatataaatgatctaaaactggaaatcctttgcaaagctcttcagagagataagtaagtgctcgtggcattgcttctttggaaagtatagaaactgcttttcctctgctctcaccacatgacagtcaataacagaagacttctgtgaccagacgtgttgggatttcccacctcctacactgggcaaccagtgagttctgttggtgggcaccagctgaatgtcctttaatttagttcagtcctgatacaatctacaaccacaggttgagggctcagactgcccctgactttgatgccaatttaagcaccagggggttttgcctgtgttcctcaccgaccagctataaattggggttcccacaaccccctccttgggtttgattaatttgctagagcagctcatagaactcaggaaaacacacctaccaatttattataaagggtgttgttaccagagagcggtcccgatgaccccaggagaggcttcttggatctcgtgcaagaaacaatttggggcaagtccacagagt

SEQ ID NO: 58832 - DNA, 1024 bp, Homo sapiens
tttttactataaaaatacaactggccaggtgcagtggctcacgcctaaaatcccagctctttggatggccaaggcaggcggatcacttgaagtcaggagtttgagaccagcctggccaacagggtgaaatcttctctactaaaaatacaaaaattagccaggtgtggtgatggattcctgtaatcccagctactcaggaggctgaggcaggagaatcacttgaacctgggaggcagaagtttcagtgagctgagatcgtgccactgcaatccagcctgggtgacagagcaagactttgtctcaaaaaaaacaaacaaacaaacaaacaaaaaacaaactacaacttccttacaagacataatgacttcttttctccataaatgtctctagtattagttacatgattgtataatcttctaccttattttaacttgtcatagctatatatctgtgaagaaaatagaagagctaatgaatatgatttcaagaaagctttggacttgttggaatatattgatgaggtaagtaaaattgcttgagatgatctcaggcaactgaatacatatataaaaagagggagatccctcttttagtcaatcatgaaaatgaattaagcaaaaaagactgtatctgtggttcaactacctttaatccttagaatgtaaacaactcttcagaaaagctgtcaaggtcaagagactcccttttgtgataattctcacacattcctgggtatctttttttgtgcacagataaatactgcttttcaaagtcctgaaatatttttttgtctttcatttattaagtcattagtttctgaaggtaatatacgactttatcagtttattctggctgggtgcagtggctcacgcctgtaatcccagcactttgggaggccgaggcagacagatcacctgaggttgggagtttgaggccagcctggcaaacatggtgaaactccacctctactaaaaatacaaaaaaatacaaaaaaaaaaaaattagatgggtatggtggcgcacg

SEQ ID NO: 58833 - DNA, 1007 bp, Homo sapiens
ggctgtagtgcagtggtataatctcagctcactgcaacctccatctcccgggttcaaacaattctcctgcctcagcctcccaggtagctgggattacaggcgtgtgccaccacaactggctaattttgtatttttggtagggatggggtttcaccatattggcctggcgggactcgaactcctgacctcaggtgatccacccgcctcagcctcccaaagtgctgggattacaggtgtgagccaccgcacctggcctgaatttgcatctttaagaaattgatgtgaattgtgaaactaagtgccagtaagtgggaaggtttccattccattaatgattgttggtttataataggaataaagataaaatttcaagtaacattttttattacagattttaagttttgctaacaggattttttcccatcttttctcattcccacagtttcactaggccagtacctgtgggctgcttctctagcagagaaatactgtgactttgatatattggtacaaatgtgtgagcagactgacaaccagagccgactccagcgctacatgacccagtttgctgatcaggtgatgagtgttgggtgtgtggccactgagtcctttagttgccttttcttgaaatggctttgccatttcaaatctgtaatcagggcttttggaatatgatacgatctttttgtagttaactttgatgagaagatactaatttgtatgtcgcgtttctttgtaaattttgtccagtagcgagatcacagttcacgacagcctcaacctcctgggtccaatcacttctcccacctcaccccctcccacacctcctgctttccagtagatgggaccacaggagctcgccaccatgcctggctaattttgttcatttttcagtagagacaaagtctcgctatgttgtccaggctggtctcaaactcctgggctcaagcgatcctcctgcttcagcctcccaaagtgctgggataacaggcatgagccatcgcctg

SEQ ID NO: 58834 - DNA, 1011 bp, Homo sapiens
tagcaagttcactttttgaggtcattattttagtctattagttcattagtttggggtattacattgtaaagtgatgtcatctgtaacctagtgctatttaaagatgcactgagcagagtagctataataaaaaatatcatcgcttaaaaatctcagtaacaatccagaatttgcctgtttataagacttatttgggcactctgacttttaaaagttaggagatgtgacttttcttgatttttgaatttatttttaccatcaactgccaataaattttcctccatctataggtctgaggatatggcttaatgagtaaaactcactgggtagttgttacccatcaccataatttttgttgtaagtagtttacttctgtgtattctctcaggtatcccaagtagataccatctgtgagtgcttactggagcatgaggagcaagtcttgagggatgcacctatggattccattgaatgggctgaagtggtgatcaatgtgaacaatattctcaaggtacaaaaatatagtaaaggcttcagcaaatcaaagcccagggcatggatagacaaggaactggtttccatgttcctactctgtattgccgataatgtataaggttgtagacatttgttaatcccaaaaaagttagaaaaatgtcattttattattaatcagctaatgagtattttgaatgttagcctggtgcctattaataaatttctataatcttgagtttctatttggtagaataataaacctttcatttgggaagatgtgtttgtatctttgcaattttttagttggttttttttctgagagaaggtctcactgtcacccaagctggagtgcagtggcaccatcatagctcactgtaaccttgaactctgggctcacgacttcctcctgcctcaacctccaagagtgttgggattacagaactgagacaccatgcctgattgcaaacgtattgttaatgtaactgtctaaatatttctcatttctatttttttaat

SEQ ID NO: 58835 - DNA, 1006 bp, Homo sapiens
agaacaggaatatctacatttccttgtgggtgttaatggcctggctgaagtgtctgtgtgttagaaacagttaaaacaagagacagctggagggacttgctgggggaaagctggggccagtgactgcccagggtgcttctggggaaaatacagctatggtattttgcatgttaccataattgctttctgagaatatgtgtttgcctttttgcaaggttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtaagatgagtcctctttcatgtggctttgtagaactgtgccatttagtgatcatgccctaggcaggaaagacggtgaggacgagttaaatcacaaaagatctcactgaaattttaaattggactccagattttctggctagagtgtcactcagaagtctcattgatcagttacctgtaaagaagagtttgcaaagttgactaagaagtgctccctgtttacttttttcccccaataactgtctccaagtacctatttgctttgcatgctgatcttctttttttttttttttgagatggagtctcactctgttgcccgggttccagtgattctcctacctcagcctcccgagtagctgggattacaggtgctagccaccaccccggctaattttcatatttttagtagagatggggtttgatgtcgaactcctgacctcaggtgatccactcgcctcagcctcccaaagtgctgggattacaggcgtgagctactgcatccatcctgatcttctcctttgtctctctcgatctactcttttttctgggggcagggggcactaagtc

SEQ ID NO: 58836 - DNA, 1116 bp, Homo sapiens
ttaaaagtaactttgagccaaaacctataaatggtttttaggttacatttaacttcacaattaacttaaaattttttttttatttttatgggtacatagtaggtgtatacgtttgtggggtacatgagatattttcatacgggcatacaatgcgtaataatcacatcagggtaaatgggatatccgtcacctcaagcattcatcttttttgtatgttgtgaacattctaattatgctcttagttactttaaaatgtacactaaattattgaacatgtaaagtttgttacatgtctttcgtgcctgacttatttcacttaacatgtcctccagttccatccctactgttgcgaatgacaggatcgcattcttttttttggctgaatagtagtccataattaattttttcttggtgagttttgaaaatattttgcctcccttaatacttgtgttttccaattttatttcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgagggtaagaatgtttcaattatggaacggtgtgttttgaacatattctggtttctttattagaagcatctcttaaagcatattttttagcttctcaaacaatttaatattaattcaatattttttaaaatattgtgaccttcctttttttttttttttttgagacagagcaaggctctgtcacccaggctggagtgcagtggcgcgatcttggctcactgcaagctccacctcccaggttcacgccattctcctgcctcagcctcccgagtagctgggactacaggtgcccgccaccatggctggctaatttttttgtatttttggtagagacggggtttcactgtgttagccaggttggtcttgatctcctgacctcgtgatccacccacctcggcctcccaaagtgctgggattacaggtgtgagccaccaggcccggccaggtaaccttccttatagtatgttttgaaaaagggtcagaacag

SEQ ID NO: 58837 - DNA, 1063 bp, Homo sapiens
tagatacactactctcttctaccagtcattacttccttggccatgttccgttggaactcagggctcctgcttacctcaattcttcacttctgctgaactctgtgttactgctgcctagaaaagggtgtatgtggttaggagtaataggtgagggtgaattcctgggggacatactgagttagctgcgggatcctgatatttggctgagagtctaagaaattgtttcctaggtaacttggtataattactctttggtcatgctaattttaaatgtcagatgaacaaatcaagagtaaattgggaaagttccataggaagcctaagcactcatcttaaccttacttagtcttctcttaactggacttttctagcccaggaagaggttaggatagttgttcttcagagtttggtctacctttaagttttcatgattcaatactcttaagatactttgttttaaaattactgaaagcctgattaaaaggagatgtgagaagaaagaatatttgtagaatggtgtttccagcagtgagtcagaatctaaaatatgcagagaagggaaatcagatgcatcttcaaaatactggatttgatgtgaaagattttctgtttgggtttgttctacagttatccgtttgcaaagaacttcagctgccacctagtgatttccactggagtgccgacttagtggctctttcttactcttctccctcaggtgaagcacattctactcaggtaggtgacttaaaagcttatttaaataaactttttacaacaaggacatcctaaagttagaggaatcatcctctttgattttgagatataactataaacctatagaaatcaagatattgtggtattggcaaagagagctacacacataggtcagtgtaacagaatagagaatacagttatagatccacataaaggcacccatttggtctttgatgaaggtgcaaaagcaattcagaaaggatggtttttgacgatgatttttctctgtatcaatgcatagtgtaggaacatttgtaattttaaaattacaaatgaccaatttgtattg

SEQ ID NO: 58838 - DNA, 1086 bp, Homo sapiens
gtcctcagcttggaatgaggaacatctttcatttcacaagaggttcaggaactaccagtgtgaaaagaggctacgttcaagctgctggagggccagttccacctaggcgcagtcaagaagggcgcctggctttccggcttcacgtccctggaagctcggcactgcagcggttctagatctggggccgccggctgccttcccgacctacctcgctgactgggcaccgcccttaacgtcacgatcccgcccccgccagcgctccgaccacaacccgcgggagccattgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggtaagtgatctccctggttgggtctggcaaccaacagcctcacgggccgcagtgggccggataggttgttgtctttagaagcctttggaaccggggcggcggaatagaatgccacagtattggaaaatagaccttttccactgctgcaggtagtatctgcttcgttttgattatcagttgatcagttgattccccactttgcatttttcatggatacctttgtgcagaagtgaagtacaaactggatttgcatcagtgtttacctacttcccacctactacccgtgtgatctggtgtaagtcactcgtgattttcttcatctgtgaaatggcgataatatatctcacctgagccagaggagttattatgaattgccacgatgcagatgtaaggtgatggtgataatgaggacctacaaccctgaaagatcattgtttaatgcctaacataccaactgacattaatatctgatgattggtaattaaagggtttctagctac

SEQ ID NO: 58839 - DNA, 1056 bp, Homo sapiens
tataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaactttatctgtgtctgtcactttttttttttttatgacccaggaaccaaagatgcagtctgtcatttcttataaaacttctcactacattgtttcttagtagaatttggctgtggagattcaggaataaagaaaagactaacattacacatatccaaaaacatgttgtaattaaaagttccattcattcctccttaccaagtttgttgaatgtcatcacttgtttgctacttacaaatattgtttaattgtttcactgcagtaaataagtatctcctacctacatcagggacaaggaactgtgctgtgaagttgatagatgagtaagccacagtttctgccctcaaggagcttctagttttgaaggagtgggaagg

SEQ ID NO: 58840 - DNA, 1445 bp, Homo sapiens
cttttaattctgtacctcaaagtgatacaactgaaaatcctttttcccccctttactctaaagtgagggaagctgaattaataatgacagttgaaaaccagtgggcagactgagtcctagttgagagttctaggtccacttcagacatggttgccatcaatcctaatcactctgtaagctgtaactgtgcagaatgcttttctccttacatcacagtatagttttatggagatcagaaagtcctaaacagttgaaattttgatcatggtaaaaattcattgctcaggaagggctgctgtgtgtatcaggaagcacatgggtgtcactgacgtctttgctttcttgtgtgtgtgctcctgtgtcagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaag

SEQ ID NO: 58841 - DNA, 1025 bp, Homo sapiens
cacagtctactattctgcataatgagtttcagggaaaagtgagcaaagactatggcaagagccagagtcctccttgcaaagaagttgcagatttcaaagcagagtgttaatgtaatgtggtcactttgataaggccattttcacaagaccctttggggcagggaaatgttgctgcagctgttttaatttttattaccaggctgtgcacacagcatacaaacctgagcctccccccatttctgaacctctctttgtgattagctcatcctctccccactccacttgggtgagggcaggtggatggtgatgggtgctcaggagtgtagggacatcagtggtgtatatgattagggatggagaaaagagcctggaagtttgcttattttttaggactactccatagggttctgtcagaattgtttgttcccatgtggtttgtgtgtatttcaaaaagtaatggatggagatggattccccgctttgtcctgagtggaaggcaggcagctggaaaatgcaggtggacttggggtctcctggtgcctcctgattcctaaggcaggggactgacatttacaaagttcctaccatgtgccaggtgccttgcgggcacctgctgtgaggtctcattgcttgcagcatggtgagaactacagatgataaaatcctgttcatggcaaaacataaattttaaaaaagactgctaggtctaaatttattagacatgttttaagtctgtttgaaattcgtgatatgttttatttccaatttgtaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgcatttctttactgctttgtagcaaagtctctatatccaaagaacttttcacatgtttcttgtttttttt

SEQ ID NO: 58842 - DNA, 1043 bp, Homo sapiens
ttttttggtgacttcaccatcttggtcattttgatgggacgtgttgctgtggttgttcagtgcctgcaggtggttcagacctgaatatacaactcctgaggtggactggagcgtggagcagaatgggcctctgccaaacccccatcctgtctcttcccactctgttgttaaaccgcgtggtctgatctagtattggcctgaggattctttcttcagcaatttcttgtcacatttcttctatgtggcatgctgaatatttatggggttttgtgaagaataaagatgtctgaaaaattccatcaaaacaggatgtaacaacttggggacagtaccttcaagcctgctgttaatttaaacacacacacacacagacacacccacacacacactcccctttcgtaggtaatgagaatgtcttgccacccaatgtaacaaacacctctgaatttttttttgtttttgacagttttttgtctcacctaatctggccacctttgttttgagcgtggtgcctccagtgtcaatcattgctgtaatttatgggcgatatctacggaaactgaccaaagtcactcaggattccctggcacaagccactcaggtaaaggccccttcctgtccgcgtggtttccagcagaatggggtcatagccaggatcctagagggcagatcctaagggatgtacttaggtttttcaatgaagtgcctgcctttcctttcattagaaattaccccaagatccatgaaacttaaactactctgttttctagactagatttctacccatatctcaaagtagatctaacttcactaaacattttatggagtcctcacttgttactatcactatttcttttctttctttttttttttgttttttttttttgagacaaggtacatgagaaaagttttttcatgcactctaggctggagcgcagtggtacaatcacagcttagtgaagctttaacctcccaggctcgagtgatctcccacctcagcctccttagtagctgggactatcgccccatgccaccatgcccac

SEQ ID NO: 58843 - DNA, 1050 bp, Homo sapiens
gactgcccagatgttggagttacagattattttagatcaagcactctcaactcttcttttatagttgaagttgagctgtaagggcaatcatgtcggtcttatgggaggtttgaaaataagcccctcgggctgggtgccgtggctcatgcctgtaatcccagcactttgggaggctgaggcaggtggatcatgaggtcaggagttcgagaccagcctggccaacatggtgaaaccccgtctctactagaaatacaaaaattacccgggcgtggtggtgtgtgcctgtaatctcagctactcaggaggctgaggcaggagaatcgcttgaacctgggaggcagaggttgcagtgagcccagatcataccactgcactccagcatgggggacagagcgagactccatctcaaaaaaaaaaaaaagaaaaaaaaagaaaatgaggcccctggccatgaagctggacttctgaggcttcctgaaggcttcagaaacccatttacatgccccatgcttgtgtttctccttaagtagcagctgggatgataactttgttagtatttctctgaagaggtcttgtttttacaggcaggtcactgccacaataatgagagaacctgggacaccaactcgaagtctgttgctctccatttatctctgtggataattaaccaattcttgccatttgaaggttcaatacaggaaagggtttccagggaggaacaaaatgagcttttggaagttaatgtaataaaacttctttgtaaataataccttaaaaaaatctcggccaagtgtggtggctcatgcctgtaatcctagcactttgggaggctgaggcaggaggattgcttgagcccatgagtttgagaccagcctgagctacatagcaagactccgtctatataaaaaataaaaataagttagctgggtgtagtggcggacatctgtagtttcagctacccaggaggctgaggtgggaggatggcttgagcccacaaggttgaggttacagtgaactgtgatcgtgccacttcattcaggcctgggtgat

SEQ ID NO: 58844 - DNA, 1095 bp, Homo sapiens
gaggggacggcgaagcgcgaaaaagttccctgcgcccagtacgcaggcgcagccgtgctcctgggcttcccgggcctcgtcccagctggcgcgcccggcgctcctccgccagcgggcagttgggggcgctgcagggagggcacccgagcgggttgggggcgctcggaagggtggcttgcaaggtccgggtagctgcagtccccggagtggggcggagaggcgcggcaccgcgcggacgaggatggggcgggggcgggcgcagcccgagggtgcaggcacgataaggcgggtgacagccagcggggaggggcgggcgccaccgcgtccacgccctttgctcggggccgggccgggagggtcctcgggctttgcgcgcgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcaggtagggtcctccccggccacttccctccgccgggcctctccttctccacacgcggggtcccggggcgccgagagggacacggccgggccgcagagcgcgtgtcaccgccgcctctcctgggccactcctaaccccggaggagggaggggatcgctcacct

SEQ ID NO: 58845 - DNA, 1417 bp, Homo sapiens
tgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaagtgttggcatctcatttcatctctgaggacaggcgggtgagtgttctgtcctgggatggtgtgtctctctcacctctcatcagggcaataacccgtcggttacctaggccacactgtccccaacgaaggtgcatttttatctgttcttgggttctgtttagcttactttgaatcatgattcccttagtattcacttggattattgatggcatttaatgctgtttgtacatccaagattgatagttgctgactggagaccacatatatttcaccatctagagtcatttgatgagatcctactttgcacttccttcaaagaccccactataaaatctccaaggggcataagaactggactgttcaataaactcaaactatgtattgaacaattccagataaaggactcgttcaaagtaaagtgaacttcaaaaca

SEQ ID NO: 58846 - DNA, 1029 bp, Homo sapiens
gtagaaaaaaaaggtgcccttttcttatacaagaacctaaggctgccacaatgaaccaacaaagctgactggtttggggatcttcatcatactcctttcttctggtgtttaattaaaacccattttaattgatgaattctgggacagaagagacagctgtagttttgaggagtttatctatgtgggaataaagggaaatgaattttgaaaacagatggtatacttgtggggagaggaccaggaaagaggactctttctgagtaccattagttgccgtcttttctgtcgtcacacacaggaaattatttcgaagaatcacatgaatcgcttggctttgcttcaagcacttctgaatccacaccttgttttgttacgttgggggagatgttttttgagaccctccagaaagtcactttaaaaacttcattcttatttattttgaaacactaagcagtttgtggctggtcactaggcagggggagctgtgatttactagtaactgtacctttctagcttagtgttaattcttaaacatccaggttttattttggctaaactcctctgatagttctgggttttgtttgtgtttgtttttgttttgggtttttttgggcacagggtcttgctctgtcccccaggctggagtgcagtggtgccatcacagttcactgcaacttcaacttcccaggctcaagtgagcctcctaccttagcctcccaagtgtctgggaccacaggcatgcgccaccatgcccagctaattttttaaatttttttggtaaagaatctccctatgtttcccaggctggtctcccaactccttagctccagtgatcctcctgccttggcctcccaaactgttgggattacagtgcgagccaccatgcctgaaccaatggttgtgtgttaatcttgaagtgaggctgggcgcggtggctcatgcctataattccagcactttgggaggccaaggcgggcggatcacctgaggtcgggagttcaagaccagcctgaccgacatggagaaacc

SEQ ID NO: 58847 - DNA, 2903 bp, Homo sapiens
ttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggtatgaataccatttttttcttccctgcacccgccttcctaatttccttagaatgtccttaccaaacacgacatatcttagaatggacttcctagtttccctcatcatatagctaaagccagactaatgacatgttacctgtagccattgaattcctgcacatgcctaacctaagatgcaaaaacaatttttagcagcattaacttcttattaatgaatggtcagtatttatactatgtgaaatgtggatagcaacactaagcctaatgaaagacctttagctaatattgactttagctgagatttgcagtaaatatacacttatgtgtgtgcacatttgctcaggtacaaataatcggtagtaggataactgagtcgaagggcctccattgtcaactgtaatgaatattattttccccacagaaggttgtgccatttcacagtctcagcaacagtagtaagaatactggcatccctgcaccctcaccacactggatggatggtattggctttctgaggccagtgcatatcctgtggctccatgtaccccggggtgttcccagaccccacttggagaagtaacacaggaagtagagttgccagctcccctccccccgtcagtcagtgttcaatcttgtttggcttgtaaccgtttaggacagtcattgaaaagggcaggcgcagcttgggtttcaggtcaccaaaaatcactaccttagaaaaaatgtgggccaaggaagatagaaattaaacttcacagcattaacttttctttagagtggtcctgaaaaagctgtgggccaaagtatttttgtcttatcaccactgaaattcaggtagctctgcctcacattactttggatggaaaattctttacacaatgttgaataattaaggagcaaaaaaatcactctaattaaattacagttaatgataaggatgtcaagaatattgggtgccctaaattaaaccattgttttcctgttcctgttttctgagtccacttccagttaggatggcctttgaatttttgattcttgcaaccgagacagtataattgaaggatttccttgtgatgagtgaagagtctagattcccatgtagaagctttaatttctagaattttatagtactctccaaaatattttttattacatttgtatttgaattttcaaacatctcttttccttggagacagttccctttttgggagttcttctgataaaactgaggaatactgcctgcatttgctttcgattttctgtaaatacaaaaaaaaattacactgaccttattagctttgatgatacagagtttggagattattctgtgcattaaaaattaatattaaagaagatagcattatgacatctgataacagtagaccaaaataaaacattttaagactctggccactactggtaactagctctgtggcttgtcctatgtttatttccgggtatcagaagtgtatctgaagactcagaagtgaggaaccgcatgcggaattccaggaactgaaagaaattaagtatggctggagttaggagaggggccaagacaggaagtgatgtagtgacactgtcttatatgagcaattatggcggccaaactagggtagtggcagtggcaaaggagacatggatggactagagaagagctcggttattcaattactgtaggggataagggagagcaagcatcaagggtgacgtttgtgtttcaggcttaaacagttggatgtccatcaagaagaaagcaaaagacgtcattggaatggtggttttgtttaagcatttctggctttccatcatggttcatactgaaagtactgtagatgctagctaacctctgccctttttaagaataaaccttttttttaaacttaagaactaaagctgagattctcctattctgttgttgaggggcttcctgcatgcccgcccattttatcacagcaatttgagaagttttctttttggtttctgacaacaagcatttggggagaaagccaggcataaattagttacgatagttggtgtttaatgtttctccagtgaaaatttggacttttctttttcccttatagaatgcataattaaaacagactattattttgaaatgaaatattgaatattaaaaaaaataaaatagagactcttaatacaggagccacaaactcacatacctagagaaaccaaacaggtaaaagcaagtggtgaagccaca

SEQ ID NO: 58848 - DNA, 1104 bp, Homo sapiens
ccttacctccattgtgtagcagttccagttcctcttgggcaggatcaattaccccagccaacactgtaactcccttccttgcctattgattcagaggtgtgaggagcccaaagtggctgggtggctgtcttaacttccagttcagtggaatgattgtaatttttcatcctctaaataatgagtagggatacatttattctaaaatgcatattatgaatattatgcagcagattcattcaccttgtgataaagtgaaatagggtgttaagcagaaataacatgcagatatcttttatcatcaaattagggagcaagattctctgatgcagtattcctcagtcttaaaccctgtattgatgccttttcatgaaaaaaaaaaaaaatgctaccagaacataagtgctgacttaaaacatttttattttaatttatttaaatatgtacaaacattacactagatctaaaacctttatgcttattatatttctttatgaaacccagactcattacagataagggacaagcaaaaccccaaaggcagtcaagttgaaaataacactgagtgaatgtaacggatggattttgccagaactaccttgctactgcaagcaggcatctggacagcactggtgactgtgacacgggctggtctcagctccttggggggcttctgccctgcagtggccctgctgtctccccactgtgtatgaatcacatcgaaacctttgctccctcacagcatgccttaagcacttatttaggtgtcaattatacctctgttcttttctcattcacccatgaattcaagctgtacaccttttaaataacattctctgtcttacagtttcatggcgctaaactcccaagttagtaagtagttgagtcttaatgacgtaaaatggtcttatttgtaaattatcactgcaaaagagaatttaacttgttaaccaacaaaatcagaatgaatatgctgatgagacaattgttaatgaaggctgtcatgttaacacaggacacgccagcctgtataaccagacatgttaatgagcccactaaaataagtgctttgattttacttgagacaatggatgccaaaagtaatca

SEQ ID NO: 58849 - DNA, 1050 bp, Homo sapiens
gaaattgtaggagtcttggaagatagggaattatcaaaatgattccagaaaacttcacagaactagaagacatgaatttccagattgaaagggcccactaagtgcccagcacagtgattgacaatgaacccacaccaaggcacctgtgaaatgtcagaacataggatcaaacatttcctgatgaatctcatggattgatgtacctgtcctctctcattcaccttatcctgtgctttatgcctttccttccctggccttcattttattgggcttcaggagggaggggagagaaacaagtgtcatcagtctgtcatgtttaaccaggacccagcatgctttggaaacctgctgaaatgtcagttgctgtgcgtgtgtgcacaacaccctccttcacccatcctgccacgtactgggttaataatcgtctctctgtttcccgccctgacttgtgtatcttctcctctttagtgcaatcagaatctggttgtgccaacatagtgtctgcagccccttgccaggcagaaccccagcaatatgaagtacagtttggacgactgcggaattttctcactggtaagtactcagctctagaaccttttctttttaagaaaacagagtaatacagaccaactttgggcacactgcttgtgagttagccctgctccacaaggagcggtaaaaagaaaaattaaaaaatagagtaatgcagatttccctcagaaccaactatattccacaattggtttgaggtactagggattcgaaggtactcttaacacagttcttgcattcaaacttatggtctattggaattcctgaagagttcaatcacgaggtttaagtttacaagggcagagctctgggtgtttattcactgttttattcatggccttcagcacagtgacttgtgacttgtattgaataagtaaaaactgtcagctatgcagagaagcatccttaaatacagcacatttgaaatgtacatgacatctctactaataatatagtacatttcacaatggtctttgccccgtatttccaaaagtgcaa

SEQ ID NO: 58850 - DNA, 1758 bp, Homo sapiens
actctcaaaggaaaatactaatgcatgtaactgaaactgagaacttaaaacacatccaaataaatgatcaaaaacagatctcccacacaaaacaactgggaaaccttgatttagagaatgttactttggttgggatgattgtgtgtgtatgcgtacatgaaatgcattccaaaatggacacaatattttggtcctggaggggaaagtatgttttacatgacagaagtgaaccccaaaattcatccagctgtcattggtcatctggactgcagtatttatttctggcaaagtagtgtttgaggccatggcaatactaggggttcctgtcattgttgataataaactcaatagtcaaaggaaacagtgcctcttttttttttttctttttcccttttctttttatttttgtgaacctacaaattagcttgaattattcaaaaataatttacttctgttcaggtcacttcctaccactttcctttcttacaggaatttatgagacatatgctaacacatatacataccctcttagtgttgtgctgcctttctatacctgtggtttaaataaagagcaaaaaaggtaaataatattatacaattaaaatgaaaacacggccaggcgcggtggctcacgcctgtaatcccagcactttgagaggccaagccgggcagatcacaatgtcaggagattgagaccatcctggctaacacggtgaaaccccgtctctactaaaaatacaaaaaattagctgggcgtggtggtgggtgcctgtagtcccagctacttgggaggctgagacaggagaatggcgtgaacccaggaggcagagcttgcagtgagctgagatcgcaccaatgcactccagcctgggcgacagagcgagactctgtctcaaaataaataaataaataaaatgaaataaaataaaatgaaaacacattttgcaaatccctaacttagagctggcagtcttttcctggctattaagcaaaaatatcacaatccccttcaccattgttaacttcatgctttgttaacatctatttatccagtttctgtggtctttgatttggcactgcctcctgcctgcttttttggctagttcactgctaattaacgcctctctcacagagtaggcaggagaaatcaaaggccctaaatttcagactggccctgtttgctctttgttagcttctctaatgaaaagtttcatggggctgattggaatcttggtattaaacagagtttgggggtgatctaaggactttattatcgatgcttttcctattttctgtaattgaagttggctgtattgtcattggagaaacagacaaaatggaagagtataccacgttggtattagggaacttagatttgcgtcttaactaggccacttagccacatggctggtctttctctcccatgtgtcctacccatctgcgatggtgcagttagataggttgctctcccaggcccctgatgtctctgtatcctgtcgttgcctcccttgaaggtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacaggtaatggtgggggctcgtctggtggggtgagcctggagcaggagaactcacgtcaatatccatgtggaattacttctcctcttctcaagacagtgccag

SEQ ID NO: 58851 - DNA, 1125 bp, Homo sapiens
atcctccagaaatttttgatttccagaaataccaatctggcaactgttgatacatgagaatagatatacattgtgtcaaaatcctccagaaatttttgatttccagaaatatcaataatgtgatatgaagagcagagtatttgacatctgtttttacctctgaaagttaagtattttatataaattgaaaatgatgagaaattctgaaatgttaacaaagagtataattatatttaaatccaatttcagtttgaaagattttataattataggaaaagctaggcaggtaacgaaactgcactgttcgtctcatgtatgagtctctccagagacttaggtctagtttaaggagagttttttttcttcacttgtccctttttggatattagtactctggaaatcagtctgggtggaggggaccgatttatctcaggttcattaattatccatgtcacttgaaatatatgtacattggaataaaacccagctgagttgattgggtcgtgtctctagtatttgagtttagcgtggttatgcaagagagtcattgccagaattcctgcccttaagatccatggccatacagttgattcaccacccaccctcagggaagcgcccttatcataaatggtagtttggactcagagaaattgctatttggggcagctaatttaagcatatttgttagaatcagtattacagactagtttctagcaatcttaaatatggtcagtgttgactatcattcattcttactccgttctgtttactctttcctaacttcacatcttttcccttcctcctcagacacataggtatattgtcgcaccttgaggacactgtgtcattgcagagcctgttctccagatcagtcattcacatgtctttcacatgcagagttttttcctgtcagaggtgatctaagagatcgaggcccatctgcctggaatgctcacggatgtgcatcaatatttgcatgcattcccaagtcagcaaaagatcggcagtgtggaagccggaaagatttcagtctcagctagagtagggaattgggctgctttgggaaagcccgcagagtaggagatcttgaagttagatgaaaagcagctgtagcaagtgatagga

SEQ ID NO: 58852 - DNA, 1557 bp, Homo sapiens
gtggatagagcttggtgacagtagacctaggatggaaaccatgtagccatctgcataacctctctgaactgtagtttcctcatctataaaatgcgatgataaggaataacttaaacgtggatttttttttatctttaagagacagggtgcctctatgttgcccaggcctgggctcaagcagtcctcccgcctcagcctcccaaaaaacgacctttttaaaggtacccagaaaaagaatgatgtgtatgaaaatagctaaatgttagctattatcgtttcctttttggcaaaataccttctaggttccctgtagtcctaagtttttgcgttaaatggaatatatgctaattttttaatgaatcgtaaattcttcctgccttaaaaatcagcgctaagctagaaaattaaaaggtgggcttgttttgagtatttttctttgtcatcaacaacaaattaaattagtgtatcttggaatagttttgttgctcctgcctgtaaatgtgaggcttatgtgagcttctgtcactgtgaaactaggtaaaggcctcacttaactactcagtaactggtttttggttttgcaagcaatatattagcacctgtgaaggacatctctggggaaagaaagggggttttgtttctgctaatttgttttgctggaagggagctctaggggtcatctgttaaaccagtattactcagtggacagtactagaagtcacgtttccagcctgtcttgtatgtgactggtggcttctcaggtagtaagtgttctgatcattctctcagcaagcttctagtaagcattcattgttgtgctccctcaggaagcccctggtcacatgtagaatcctttgagcagcaagatgctgtagaaggtgagagctcagacccttcagccaggtgtcctgagttcccatcctggcactgtgtaacttctttgcgcctcagctttcccatctgaagaacgttacctacctcataggtttgttgtgagcttaaagaaggcagtctatgtaaagcacttaattttaaatgctttaagtgtcttagcgtcgagtatgctcagtgttaagtattcgtagtggtagtgtatgaaacagacaagaatagggtaagttctgtgacagatttgttcctgggttcgtgtgtggaagggattgtgatcaaggaagcttttgggaggaagacatggctaagctgagctgcgaagtgcgggtgggatttagccaaaccaggttgtagtgccagtgtggcagtgcctccaactactggagggcccctgaggggagaaggtggagtgggacccaccagtagagtaagaagaaccaaggattggtccagtgaggtaaacaggcagattagagcaacctggaaatgacacagtagacactcaatttttctatccttcacactagtggaggcagtagaaagtattttgttttgttttgttttgtttttggagacggagttccactcttgttgcccaggctggagtgcaatggcgtgatcttggctcactgcaacctccgccttccgggttcaagcgattctcct

SEQ ID NO: 58853 - DNA, 1091 bp, Homo sapiens
tttgaagtgtatgtgcgttgtaaatttatacacgactgaataaaagtgttagtggaaggttactgttgcagctgaaataactgtattcctttggggttttctttttcacttggagacatattactttctccggatattgcttatgtatcttttcctctttcaatttgaaaccatgtatgaatgactctttccacaagtaatgtaatcactgattttggccttgttgaattcctgaacactcacctttgtggaagtgatgtttgatcatagctggaatacatatagtccatcttctgtgtgtgcagtccatcttttgcttgcttttgtctgaatttcccccagaaaattctggagtcaagcatcttgtatgtagatttaccccgacaaatctgttgattcattaaaaacttttaaaagaatacatattaggtaaacaagatacagtactgcaatactgttggttttctggtgcctgctcagtctgacattgttatagtattttttttcccattgtttttaaattttagataaagcctagccatggctgctgtttattctggcatttcccttaagcttaaaagcaagacaacttcctgggaagataaactaaaactagctcactttgcttggatttctcaccagtgctttcttccaaataaagaacaagtaagtttaatgtgaaactcatatttttacagtctgtcaagataattatcacttttataatttggatattgacaattggttaaaataaaaaaatagagaaaaagttggggagggaactttgttggaagttaaatgtaatgtcaatgaaaaaagtaatgagtcaggtacttcattaatacattttttttttctgttaaaaaacctcatttaggtcggggacagtggctcatgcctgtcatctctattttgggaggccaaagcgggggatcgcttgaggccaggagttctagaccagactggacaacataatgagatcccatctcttaaaaaaattatatatattatatatgtatatatatgtatatatacatatataatatatatataatatatatagtatatgtatagtatatatgtatataata

SEQ ID NO: 58854 - DNA, 1494 bp, Homo sapiens
ggaaaagttggaaatactgggagaattaccaaaatgtggcagagacatgaagcaagcacatgctgttggaataaaggatctgatagacttgcttggcacagggttgccataaacctccaatttgtaaatgcaatatctgtatctacaaggcacaataaaatgaggtatgcctgtataacctcaaaaaacgggttaagacgtgttagtttcacctgaaacttttaatttgccctagctgaagacaaatttgttgttttcctgttcttatcctttaataataaacattttaaaataccagaacacgtaagtaatattatcaaaggtaagttgtaaaagagaggttctcccccgccgcccccgtggcaattggatttgcttatacctgtaatgtccctataatgtctaacatctttctctcagcaaataaatttattttcagtgtatgtgtccttcaaattcaggtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaaggtaattcacttttctgttctgtatgtgttgcatgcatctccattgatttcttgttaatgctggaaacttgttttagtgtcaattgtatgaagatataggaaatactaaggtaggagaaaaaggatgtaatattattggaattaaaatagtaactattgaatgtgtatcatatgctctaagcattttgttatttaatattcaaaaaaagcttggaacgatttcataaacaggtcattgattacctttttaattggaaaaggtagctagcaaattatgcttctctgatttgtttttcttcttctttacctttcttttgggctagagggagatcaaaggccaaaatccggacaggaatttcctcaaaggttttttttttttttttttttgccactacggccttcgagccacaagtgccactagtggcttggccggcaacccggggccacctcagtttttgactgaaagtgattttgaagtctcagatcagaagtaggaacttcattgtcaaaactgagtgtgtttaaataccatgagaatagctagatacaataaaaactactactagtgagcacttcatgtgtgccaggctcaaagaagtttaactttcctaaagtcacatggctagttagtggcacagctgggatttgaacctcactctgcctgagtgtaaatcctgggctatgaagccataacactgcctcaccctcatgagtgtgcgggctgagagaaaatcgttagaggctagtaacggaggggaacgaaggttgagctgcccaatggcgcatagggcttaatggttcttgagattgtgttccaaactgggtcactttttaaaataataaaccagtggtcacca

SEQ ID NO: 58855 - DNA, 3807 bp, Homo sapiens
ggggtgagtttgttgatttttttttttaatacttttcttgtgtatgtatgggtttaaggtcagtaatgaattttctttctttcttaatgttcagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaatcactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcaggtaagatattttctcttgagctaattctgtgttatagaggtctggtttccactgctcccctttttggaactgggaataagtgaacacgtgatgtgttcaaaaggtaccacatgtgcggctgggtgcggtggcttacacctgtaatcccagcactttgggaggccgaggcgggcggatcacaaggccaggagatcgagaccatcctggctaacacggagaaaccccatctctagtaaaaaatacaaataattagccgggtgtggtggcaggcgcctgtagtcccagctactcgggaggctgaggcaggagaatggcgtgaacccaggaggcagagcttgcagtgagccaagatcgcgccactgcactctagcttgggcgacag

SEQ ID NO: 58856 - DNA, 1591 bp, Homo sapiens
cctgcacagagtcgacctttacagcccccctggtgaaaggttaatgggttactatgcagccgttaaaaatataattatgaaaactattatgaagacaagggctagaaatatctagaaaatattaagcaaaaaaagtacagtatgaaatgttaaatatgccacaattacagctatataagatatacatgcgtgcagacaaaggctagaaacccatccaaaaattaaaataattattgtattaacatgcatgtattaacatgcattgtattattgcattaacatgttgtgattgttgctattttcttattttgtacactttaatgttgcattttaataagaataaatcaaaatacttttctatgatttaattaaatatgccataagcaggggatagattataatgtttttggaggcccatttagagtttgttgaggttttcctctacagtgaaggatgattaagatttgttacctttattagggtatacaaataaaacacacttttactcctcccaaacaaacagttaatggaagagatttcttgtttcaagatggcacacatcacagttgtggggggtcttttcttttttgttttggtggtaacgaaagggctggggtcaggtcagtcttttgaggtgaggtctggaagtcagccgaatctgaccctcgttaatgtcacattaacgtctgtgttaagcacaccttaacctctgtgtttctgggtggagaagctgtgacgggtggggccacgggcgtgcctttcggtacgtgagggttaaatgggttctcgcagaaagtaaagccatctggtctgcctgtgccagtgccagaactgaagtgccatgggccaaatcacgctgctgttgtctccctttcagtaacctgtctctggctggattgtggattaactgaaaggctttgatattacattgttctgtcttattgtgttagggtctcttttagcgaatggtgttcaccttcttaatgggggctaaaatagagtcttttattaagcctaattacagtgttctaagtgactggcccaagaaatggcagctggtggtctgaagctctgccctgtgccccttagctaaagagaatattgtgtcctccttttcctcttcaaccctactgagttgaggcaatctctttttttttttttttttttttgagacagagtctcattctgtcacctaggctggagtacagtggcccggtctcggctcactgcaacctccgcctcccggctttgagcgattcccatgcctcggcctcctgagtagcttggattacaggcatgcaccaccatgcccggctaattgttgtatttttagtagagatggggttttaccgtgttggccaggctggtctcgaactcctgaccttaagtggtctgcctgcctcagcctccgaaagtgctgggattacaggcataagccaccgtgcctggccaagttgaggcagtctttaagtcctaagtgtatgtccctggactgctggtaccttatttcctcagggacagagcacctcggtcacagtgtggtcagggttgggcaaggccagcctgccacactgtgccctcagctcatggg

SEQ ID NO: 58857 - DNA, 1049 bp, Homo sapiens
gaagggaaaatgtatttgccattcattaagtgaagtaggttatcatcaaggtcttcatcctcttcatcctcacactgagtaggttgaggaggaggaagaggaggggttggtcttgcagtctcaggggtgctagaggcagaagaaaacccatgtataagtggatccatgcagttcaaacattgttcaagggtcaaccgcacaaagcaataatcactgtcttctgtggttcaggtttacctcctaagcatggctgtcgtcttctgtgtttgtgtgtgtacacacaatgcacaggcgtagctgtgcgtgtgagagcatggcatcacagtaactacgtgtacctgctttttccaccagtgcttatatcaccatgcccctaacttggtgatttttgatggcggccacagctgtgcgcagtttcatcctatggctacttggtagtttatttcacctgtcacatcttaacaattttggtttctttcccacacagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggtgggtgccttctccctccttgtgtggcaggctcagaaaccacgtcggctcaaatgggaaaactgatttgagatgtggtgtcacccttaaaactaaacaagttctaactggtagagactctaggcaaagggggaggctgtgagagggagccctggcctgtgggacagcccaggctgcggcatagggaggccttagttttcaaacgggaagtttttcaaataacaaatgtgttgtcttattacgttaaatactaagtgttacacattcacaaaactgatccataaaaaagttaaattctgctcattctttgctgaagacctctcacaccatacttcttgaaacatgtggcctgattgggccatactgccttcatgccagcatttgagaagcacctaggttag

SEQ ID NO: 58858 - DNA, 1041 bp, Homo sapiens
ccaagtcaccaggattataggtgcatgccactgcagccagcttgtagatgcctatttaatcagatgataaaagaaggaattctggggctttctttgtccccacaaaatgttgtggttagtttaatgcactcatttatttgtaggagttgtatgtgtgtgtgtgtttaaggcctatgatacagtgagaataaaatgctttacaggatgggatagtaatgttgcagataggagtttattttgttacagtcttactcaaatgttaaaatttgtgtccagttgttgctaggctgtttgtttcactagaacagtctggttcagattgggactgcctcctgccctctaaaaaccctgacctgggtgttcttacacttaggtgcgaaggagcagtatctattttaccatcatactctgccctaattctagctgttgctacctgagacaattgccctgggttagcatgttcctggggcaaaagggtctaaaaaacagacttaatattctctcttgtttccaatttggctgctttgtcattttcctgagcatccgtgttggtggatggcaggggtcatcgtcaccgagcatgtgtggtgagcatcaggagaggcacgtgacccatgctgacgggcagggacagtgttgatgatgcgtgtggtaggccctcactgataagaacactgggctagaatccacttacgtccacccagagggtgtagcaggggtccgcacagccagaatacccagcagaacagtgagcattgtgagagacaggacccaaaaggcctcaccagggctgctgtgtatctgagaaggagggtcacaggtgagctgtcccaggttacttaggtaagactttgagctgtccttcctcttgggtctgttctctttatattctagatcatgaattgaatatctttcactagagctgatctgtaagaagtttagcaaatagtatttaacggcccacggaccacatcaattcattttggagcacagacatttctacctcagtcactcagagctgcagtgtttgtgttatttcct

SEQ ID NO: 58859 - DNA, 1011 bp, Homo sapiens
tgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggtaatttggagtaacatcagacacagtttcaaatatattcatcatgaggtgtggctgctggccacatatgttactgaaaataaaactactcacttgtgtttaaataagagaaatgatatcaaatgaatactcaaaatatatattttttaaaatttcaaatggtcacattttatcttatccaaaacagtggatgaatcaggcatctccttattgaaatagttccttttctgggaaaaaaaatatcagatttaggaaatgtttactgagcatgtatatcatgtaaaggggatataaaaatgacttacaaccccattcctgcccttaaggagcttatagttcaatagggagatgaaaaggaacaggcaggtatagagcaatctcattttataaaagggataaggtcctgccgctcactgttccagcctcaccttggcaagggtgtgtttgtttactagggaaacactaactgccatatggcaatagcatatattatgtgtacaattcatttttcagctttgaagttgattcttgttgaatttctaatttgagggagacttttattattttaaaaattgctggccgggcgcagtggctcatggctgtaatcccagcaatttgagaggctgaggtgggtggattacctgaggtcaggagttgaagcccagcctggccaac

SEQ ID NO: 58860 - DNA, 1072 bp, Homo sapiens
actctgtctccaaaaaaaaataaaaaacaaaaaaaaaaattgcatgaatttcgattttattttgcagtattttgaaattgcatagcatgtaccagccctgtactgtctgatgtgctaagcagtaggtcagggtgtcagctcagaggctctgggaccataactcaactcggggtgtcagagaagagcctgtgaccgtagttgtgggccgactggaaatacaggagtggtgctcagcttctctcccaccattgtggttcagttttgtagacctaagcaataggcttttaaccagacatcttttgagaaaaggaaaagggcattgttaagactaggcttcaattcctctgcccggttttgggatcaatcagtggcacagttagatatttcgcttcttcctgtatctggtgcagagcacgtcagcttcatattgtgaatcgatttaggagcagccttagtaaacaagtttcccctcccatgccagcctcagcaagttggtggtggctgcctacagttctgtgtcaaagcctctcccatcatgtctgagctcagcaaggaggaatctctgttcttgtagtcatgtctgcctggacggaaggccggggccttgctcagcagtggtggagcacagcctggtcacactgccacaggcatgtcctttgtcatgtatttgaggaagcacaggagcacatcacacttctgggactctgtgctgtgttcatgtgaaggtagcttcgtcatcttatctgctaagacctggttctcagacacattcatggcttaactgagtagagttttaactattttattatctcttttattggtatctaatatgctctttctaatgagcatgcattaaattggtggccgaaataacaagtgctatgtattcatgttgtaaatagcatgtatatggtgaacagtctgaaaagagaagaaacagtcaatgttagatattaaagcatatcactaaagtatattgtctgttgaaatgctacatgaatgttaacagttgacatcatttcatacaattacattgatctagaaaaattacatctataaaagatgtctgtat

SEQ ID NO: 58861 - DNA, 1804 bp, Homo sapiens
ggtcttgccatgttggccaggctggtctcaaactcctgacctcaggtaatccacccgccttggcctcccaaagtgccaggattacaggtgtgagccaccgcgcccagccattcaacagttatcttactttggaatgtcattatgctattttcaaaattccacaggatcctgtgtgacccatagtaagttcactacagaactttgtaaatctatgctgtataaatcttggtttaaattgactgtcataggcttgagcaaagtgcggtgtattcttttgactgtcttcttctgtatgtatagatatacatttatattgtgttcaatctctctgtaaaatacccatttcccctttgtaaatcttgtaagaacaatagtaaaatcacaagtaagcttgttagggtagaggtgtcagcatttgtccagggaggctgggttgaatgggcttccttagaaaacctggagctgcatcacttttcatccctgctcctgttttagatacatctagaactactaaataatttctaccccgctggccttgctcacctcggcaggtggcgatgcctgtcctgtgggtggggacatgggggcagcctggccatgtgagtgcacacaccttaccgggtgtggagcccacacctggtaagtgttgtggatcttgagaacaccccttcacgttgtcctttgaccaagatgtgggcttgtagtttggtttcattgcagttatttggcctttttatggaatcttagtatttcccaagcacaccagtcgttaacatgtaagcttttgatgaaagaaaagctggcgttattttctgtcttactgaataataaaatgagacatagtaatatcacttcactaagagccaagaagagaagcagtaatttgaacccttcagtcactaattattattctgaaatttactttatgaaaagcctctggcttcctggcctcattattcatgtctaatttatgctcattagttatattttatttttaatcttgaaagccaaaggctttgggaattagctagggccatagcctcccagaatccactggcaccacagtccatgttctatctttcattttgtttttaaattcagcaatgaagaaaatattccatatgcattagcagcttctactgagagagccataaatctttctagaccagcgtgtttaagtttaattaaataccagatctaatgctaaatagatctcctttgcattttccttgtacttctgcagagttgagtattgctggtgggacctgtcagtagtcagggaagacgacctggtgagatgtgtcagtcaggagaaggggcagctccagaggcccgcttgtcttctttcctccaagcagtaatgagtccccatggaaacatgcagggaaattatggttactttcatctccttttttacctgtagagcaaatttacaatgtccctctacagatgctcctggacttaggagggggctgtgtcccaataaagccatagtatattcaaaatatcattagttgaaatgcattcagtacttgataaacccatcgtaaaagtgaaaaaatcgtaagttgaaccattgttaagtccagatgctccttgacttaatgatgcagttatatctggataaatctgttgttaattcaaaaaatgtcaagttgaaaagtgttaagttgaaccgtcttaagtcaggaaccatctgtatggtgatagcttagaataagtagtttgtgctgctcatcttatctaaggttttaaaagctacttagtgatgttttcatttgttggccagtgatcttagtgttgt

SEQ ID NO: 58862 - DNA, 1298 bp, Homo sapiens
tggagttttattccaggtttgtgtttgcttgagttagcttctatttccccaaaatacaaactttaaaaatatgagtatttaaaggtttgacttagtaataaaattatattttaaaagtgaatgtcgatttttttctcaatttggaggtcagtttgaaattacttgttagtgcttcccaaggcattgttggcaggtggtgcggcttgatctctgcccccaattgttctcacagaggtttgcctttttcctcaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtg

SEQ ID NO: 58863 - DNA, 1876 bp, Homo sapiens
ccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgatacctaagagaaatggcccttgttttacgccccacatttgattttatttcctgtgctatcttgtgggggctgggggacagtcctgccttacgcactgcacatgtcatctgttcccttcccttcctcatctagactgtgtgtgcagagggcctttcgaagctctggccaccagaaatgtcttcggctggtctggcatcctttcgcttaatgctttgtgttgacagaattttgtttctgtagtaaactccctgcaggagcctcgaagagagtctggtggcgccatttcttgttcacaattggagatgggtgttggtgtgagcgggcgacctttcaaggacacgagctgtaaacaagcgggagctaaaacacggtcttaggtttgcctctggttcaagtgcccagaccggaagctaactgtctccaaggccttcatggagccatggctagtttttcctgtgctgaaagttctgaaggccagaggtgaggggaccatcctttccccctgccttgggaatgctgggtgagctgacgaacgtggagcagttcatcaggcgtcctggtggtggcactgcagggcctttcgaagggagttggcagcggctgccaggtagtcagccttgaaggaagggaaggacgaagagaaggctgggactccacctcctccctgcacagctctgaagggctctctgctgtgttcccatttctggggaagcagtcacaggttcctcacagtcatttctatttgaactctaaacgctcctcagcaaagaatttgttttaactccattttgctgattcatagggtagaagaaacatgtttctggctggcaaatatggaggctctgttgttcatttttatcctgttagaatagacctcacaagcaaagagagttggcccagccagctctccacatggcagagttggggactcagcttggggaacggcaaaatgctgggcttcagagagactgtccccactggacttgctgtggctccagacccccatcacctgacagatgtgcatgaatcacctgtctgtaccaggcacggagacatggccctggtcctcagggagctttctagtagaggacattgacaatgagccaggaaacaaataggccagggggtgatcgcggggttggcagcaaagcagacaagttcagtggctggagaaagaggtgatatttgaactgagacctgcctgggtggtgagaggcgcccctggaagggcctggggtgctgatccttaatgcctgcactgaatccatgtggcagcctggttttggctgagggcggacacctgaagggaggggtgggcgtaaggggagttgggtgagagaaggctcagcggggtgactttgcctgggatgttgccttgggcggtcctggacagtagtacatcagggggcccccaatggcacagacaacacacagccccgttctcgaccttgccctgc

SEQ ID NO: 58864 - DNA, 1004 bp, Homo sapiens
caacgtgcagtttcctatcccttactccctcccacccttccctgaggctccatggtccattgcatcattcttaggcctttgcatcctcatagcttagctcccgaaggtatctcttagtacatttcccaccctaggcagcccctggtctttgtctcctgtgtcttatgtcccttggggtataaaaacaggaactttggtaagtttctatcttattatgatggtttcttattttttctgtattttaaaacttttcatttaagctaatttctcacttacaaaaaaattagagaaaattaccatataccttttcccaaattccataaacattaatatcttacataattacattatgatgatcaaaatcaaggcattgattttgataatacgattttctgatttatgactgatttgtattttattattagaagtttacttataataattataagtaagtggttccgtatgtatggactccttctagattcttttcttgtcttttcttgtctttcttcttttgttttactattaccaacaatgatgaaatgaatgaatacacagctaaatgaatcttattttattaacaaagaaaattgtatttacttagaagcatttagaatgtcaacaaaacaaactgcaactttttttttgttttgcggctacagagtggtattcattaacagaacaacaattatttcatataagctgcatcagaaacaaccgaagatgaaaaaactaccatccccatacgttcctaatttgtgctgtgcaccaacaacaacctgcttgaaatatccatgccaatttacaaccccatactgtatcaggcaaagttagtggctattgaacatatcaccaagacagggctatctaaagacacattcagtaatgtgttaactatacaaaaaaaaacactgtacagttaagaataaatcttacacagcctcccatttcaatgtcttgctttaaaaggagtgagttgtgtacaggggggttaaatgctttaa

SEQ ID NO: 58865 - DNA, 1048 bp, Homo sapiens
ggcgatttaagttgtttccagtccttgctatcacaagcaatgctgcaaggaccatgtgtgtacatgtatcttttgcatgctgcttcaagtatctctgcagagtaaaatccttgaagtgcttcatcaaagctacgttcatgtaaaattttgacagagattgctaaattgctctccaaacacattgcatcagttcacactcccaccaacagacaagagtgtgggtttcctcttatcctgccacgctcagaattatccagtgtttaagtctttgctaattgttgtgcaaaaacaattacatctggttgcttcaattctttattagtgaggataaacatctttccatgtagctactgaccattgcatttcttttaaggaaatcacttttgtctatgtttctgtggggtgcttcatatttttcttattgatttggaagagttcttcatgtgccgatagggttttaatgattgaatcaccacagtgagaattcttttcgggctccttatatcagatttcccctgacctggtttatcatccgaatcatctgggaaggttcacaaagtacacattcctggaccccatcccagaattcctgactcagtttgtctgcagtggagccaaatatccgcatccttgtattttttaaagctccctaggtgattctggtgaccagaatcctcagtggctggcttaagggacagcagaatttaccactttcaggctgccctttgtgtaagacaggttcccatcttcttagggcaagtgagaagagcctgcagtatcaggtgtctgctactttctcacaaggtttcagaggacaaagagagcagagactgaaatcagggccaggttgagcatggttgactctgactcactaggccttaaacccttctcccccagagggaagcattgcccaaaaccaagagaggcagctagcctcctgcttcagacctcccaaaagggaaatagcaggttgcttgcttagggtcgttcaggatgtggctcaccctttttgtttgggtagattgtttccttagggcaccggttgctg

SEQ ID NO: 58866 - DNA, 1073 bp, Homo sapiens
aaagcatctctgatctgggcagtctgctgttcaatgcctcctaatctgctccttaaatatggctccattcataaggtgagcatccactgaaaacagagggaaagacttattcattctccttggtctgtcttcaagggcagtgactctgcacctactgaataaagccatgctttcatgcagagcatgccgcaatctggccacagcatgcctttagctcactctctcactttctctctcctctcctcccctttgcctttctctctgtctctctttttctttcctttccaagctctattcagaggcttcaagtatgcactgcatattctttccttgaggcatttgcttctatgcctgatacagatcaaacacacaataggcatgtgttgggcaaataattttgaaaatgaatgaatgaatggtgtgattctgtctgcctagaagatttccctccttgtcctcactaattccaaatccttactctcctcttacttcatcgagctcttctcagaactcacacaacactcattgcccaaacctctcctttgacctctttcctgtgttactacacacaccaccaagtgtgtcctcgtatgtccttgtgttccctgtgctttgctggcatgatataagttgttgattagtttattccactattttctacaattgtttactatgtaattcgtctcaataaatataacatctatgccttgctttacagcttatagtgttcttggccttgtgttaccccaagtggtacctataacaatgatgatgagttagagatcgggaccccattgacccaacaagacaaccaaggctcccacaaggagctgtagatgatgaaacagacctccagaggcaaaatccactgccccttccactggtccagtgctgccagatcaagcctgttaaggacagacggtcactgtgatgattaattctgcatcaacttgactgggccaaagggtgcccagatagctggtaaaacattatttctgggtgtgtctgtgagggtatttctggaagaagttagcatttcaattggtggacttgttacaataggtatttaggca

SEQ ID NO: 58867 - DNA, 1407 bp, Homo sapiens
cccgtgcgagccaggggccagtgcgcccctgcgccccgagcgaggccagtcccggccgttcccttgcggccccagcgttaccctctgcccaacccggcccccggccctcccgcgcgagccggacgtggcctcctgcgcttgcattttccatccccactccccgcttcagggagaatccctcttctgtggctgtgtttttaacatgctccaggggccgagtgatctggctgtggggaccgtgtgagccgctctgcggttccgcgtcctcgtgccgccgctccggacggccgggccctgggcattcgggaggatggtgagcgccgagaggagccgggacagcgcggtcctgcggccgagcgccggccgggagagcagggcgtcgggctgtgtgctggagcatgccggcaggggacgtttgtagtgttttactggctcctcggctttgaaagcagcgttatcttttccgaattcctgtaaccctcgttactgtgacatttagtgtcaccgcaaacccagaaaattctgagttaatggagatggactacgggtggttgggttggaacaagagagtggtatcctgaaacaagccagagggaactaactagatgaacagacttcagttctgaagtcagacccctaaatgtccacgccggggtttggctgcttcagaggttttttctttgcttcattcattcattcatagccgaagatgttaggtggaatgggtgccttatgtggtttctggtaaattacgtggatttgttttatctagaagggcagaaataaagccctctttccacgtgctgaatcggcctagcttctgagctgacattgtactcttagcgttgtttttgtaaaaaatggtataggtagtatatgtacgcgaagacttggtttattcttgaacagcaaagagcatgcaggcagcaaaagccgtgcagtccattcagagatataatcgtgtaaaactggaatgatttttaaaactttgcttcccggtaaactgtgccttggccactctgcatagcctggtgtgctggtgagacctggcaaagctttctgcctttcatgcaaagaaaaccaaacacataagccacccttggcgtttctctttccttagtctgccactttcattagtacacgtgattagaaagagcaagcgtgctcgttcgcctcccggaggctgattcctcactctggtgggcttcagttcctggatggtgtgaggggtcttccatgcagaagtcttcagacactcctgaagtgtgtgattcttagtttgtttttttttgttttgttttgttttgttttgttttttttaaagaattcctggtggcaatatagacaggtacggagaccaggtagaaaaagtgggggaaatgaacaattaattacacatggattggt

SEQ ID NO: 58868 - DNA, 1983 bp, Homo sapiens
ttttctctctgctgtaagagtgtgtggagcctgagaccccttgcctgtgtgcctgcatgctgggaggtaagggacggtgttagttgagggacatgatccggagccctgggagcctgtccactttgcacagtagcatcacccttattccctgagctggcacgagtcctgtggcccttgcccgagagtccaagggtgggggactttgggtgggatcttctaggaatcatgcggggaggcgggcaggttatttcttggaacagtgaaggaccttgccgggctagaccatggtacacatggaggggaacgttagggtgtaaagttggagaaattcagaactaaattgtaacgggcttcaaatgccaagctgaaccatttgggaactagtaatgtttttgagctagtagtagacattaaagggaaatggcacaaatccacttattggcattgagtgagacctagctgtttacctctttgtgcttagtgaccttcactgatgcattgaacctctctgaccctcagtttcctcatctttgcagtgggagtaatcattcttacctcatggccttgttcggagagttaaatactgttagtgggtgctgaataactgctatctctaaaagaggaaaatgaaaaaataaaagcctaaatatccccttgaaagtgtagtgaaccaggaatcttaagttcacggtattcctgatacaattcttgatttctggaaaatagtcgtctttcttttttttatccgttacccccacctctgagattgatctgactggttcatttggggtttgggctatgaatcttaaatgctgttagagacggactttttgggaagttgtccagacaccatgccagctctcttgtacccaattgtggtgtcagaatggggatcccagtagtgggcagccatcgggaatgtgggtggagggtgcagcttgccttggcggttaggcagttgtagtgtccaacagtggacagacgtgtccctgaacgaggggttcctgtggtgggatcccaggttctgagctccactgctctccctctgtagccctgcccctcttgttagaagggcaggtcgctgtgatccctggaagcatgcatgacttgaggtggagcatggggccctcacgtggtttaatgggtgccaaaaatctgtgagcatcttggtggatgcggaggggaacacccataccactccttgccacctatcatcagtttggagtttaaagaaagtccacttcaaatgagagtttgaagttgacacagggaggacagtagcagggaaaaccactgtatagccagataatccgacagtggcactgtaacataaacttctctctttaaagaaaataaagtttcccaattctggagtgaagctgtggctgcctctgggtcagcaaacataatggaaacagattgtgtgactgctgaacagtgcaaaagtaacgagctcttccctagacccttgagcaaaaatgaaaaagcaactgctttacccagcactgagtggggtcagcttgcccaggctctgttggaccttggggtgggggacacctgggaggctggtgaaggttttatgagtcttcagacccgctgtcagtttccccaccctagctcctgtttggatgaatgatgggtgagtggttggtctcctgtttggaacagaggaagaggtggtcagaaaaatgatgggagagggggtgggggagattgggttggggaagacataatttcttcttgctactgctcatgtttcttagggctttggggagagggaagtcagtttgggaagatactgattttagtgtcaaagcaggcaaggccactgtcctgcctaacttctagcaagtccagaggcagtgggcttagtgaaagcaggtgtggtggggcgggggtggcggggggtgcggtgaggctgcctgggacagagacacaggtgtaagcaggagtcgactgtgaggctctggctgagatcccagg

SEQ ID NO: 58869 - DNA, 1066 bp, Homo sapiens
tgcccatgaattaagtactctgttatcagtatttgggtaagtgtagatgactgttgggtaggggcatttgtatggctgtcctggatgatgagagggttggcccagtgtgggatgcctcccagtctcattgtttcctccttgctgcctctggggctttccccttgacctagatgttgagcttttgctctgtgaccttcaaaaggcctgccctgccgcactctccttcccctcctgcccttgtcctgccccatcccctgtgccagggagctcacttagttgtcttcctgtctcacttttgatcatcactaatttcccctgtgtctggaatacaactttttcatcaattccgagaggccattatttgtcaaacatgccattattttgtggaccactaggaaagaaaaaacactgtccattgacctgtgacacaacgggttcttatcagttggcattcttattttctacttattgaaagagctctttcagaccgagacatcaatttttccatatatcactctcgggcatagatagatacaaaggaaaatacaagtgaaatacattgagcaaagtgttctaaaagtttttcagagtccaagcactctgagtcactttttgactcagatgttagtgcctattttcttcaaacagagtcatccactgtgccaccaaaagcgctggtgatgtagcatttcctaaggaaaaaaatccataaaaatactaagagccattggttctggactttgaagacagcttggcaatgaagtcgaggtagccagcctttgactcttctgggaattttgcctaactcctcaattcaccatccattcctatcccaccatgatttggtttttagggattaagagtgcttgcttcattgtcgtttcttggattttcttctaagccattgacgtatatgtcctgcagatgtggatgattgagcatgggctggtaagaatgcatcatgggccttgcccagcccatagcattgccgacgtcattgattgtgagctgcattccagtcgggggtggtggaggaaagggcatcttagaattgaccaattacagc

SEQ ID NO: 58870 - DNA, 1053 bp, Homo sapiens
tattttattttatttatttatttttagagtcagggtctcaccctatcacccaggctggagtatagtggcatgatcatgatcatagctcactgcagcctcaaactcctgggctcaggcgattctccacttcagcctcccaagtagctgggacaacaggcatgagccactgcgtccagccagatgttttattatcttgactacacccttctcatttgccaggcacctctttatgttcagtctttctgccagatttttcactcatgctaggcagctttgcttgtggttataagctatccatcaggagctgtggatgacttgggaagctgagtgggagaccgttaataaatatgtgttagtccttttggttctcccaacaagatattgatgctaaaggctattttacgtggtatttgtcaataagagattttggcaaattatgatactgcgtatcttctgtaaggtataattcctggtacttcaaatttatgtcagctttgtctctgagatgtctgaaatgctttagagccattgctcatttgtcttgcttttcagcatgcctgggagaatgaacagctggggagaaagaacagcttttcttcccacattcacacacagtttctgatggacccacaggttactagcctgccccacgggtcatgcagtagcaaagttgggactagaatttcagtgttcctccacctgcctaaagtacggctctggagaaagtcagccctggctgtcctggtcttagtaaagctatagttcgtgaaacatcaggttacaaatagcaggtttccctcttgctgacgcagagctgcagcttcaggcttggaaggtgctgattactggggctggtgatctactaaccctttattgaaactgctgatgtggatgatcgagaagcagagagccgggaggagaatgtaattcaagtctgggttcttggatggtctaagctccaggcctgaggctggccgtcatgaaaggaacataactgtggctgtccaggcctcataattgggctcatggaggcagacgggctcatgaggaatg

SEQ ID NO: 58871 - DNA, 1044 bp, Homo sapiens
ggttggctggctgtagaggggttggtgactccagtgtcctgtggtggtagacagtctccagccaagggcatgtacttctcacctccctgcctcgtgaatctggtcagtctggtgtcaaacttgaaccagtagactgctgtggatgtgacactgggcgtggtgcaggctctgtccttgaggggcctggtagccccacctgggtcccctggggcccaactgccatgctagaagacgtccaggctgctctgctggagaaagaaaccgtgtggggttgcctggagggtgagacatgttggaggggagggagggagaggccaaggcctcagacaggtgagagagccccagccgcgaggcacctgtggtctcaccatgggacataagaacttgtttaagccatgacgttttgggagggcttttgtgcaggaatggcacccggaactcctgcttcccatgaacccagggctgtgggcctggctgctgggagtgagccatttgctgggccagggatttgccctgctgcagggacttttctaacccagccgggccaggctcacctgggggcccttttgattttgagaggacgcatacctcagcctgcattttggtgtcctcttgctagcacctgccagctgaggttgagccatggtggacaatttttccttttaagacgattctagttactgaaccaaagatattaattatgtgcttatctgtggtaattacaactaaagcattctttatcactgcagcttagtcatttgcttacgtgatttaaatgtgatatatgttaatatgcatatctcgtcaaagggagtcatgggggtggcatggttagagcatgctggctgagggcaggaggccagaggtgtctgcgtctccctcgtccatctcgttctcccctcccgccttccttcccctttcccctctctcccttctttctgtcccaccaggatttctttaaggtttgtgtttcatcaccatcatcctgtttgaaagtttttttttgttgttaatccatcagtctttctcaattcataattaatt

SEQ ID NO: 58872 - DNA, 1003 bp, Homo sapiens
tatctcaggaaaattttaaataccgtttaatagtggagaattatggtaacacgcaccaaatgtacattatatttttaattgcttggcaatttgggacaacttacaaattctgtctttaggtttggtcgctatacaacagataatgctgctatttctgctttagtttcagggatcaaaatgagttaatacgtatgaatgtcctttgtaaagagagaatgtaaatgtttgtcgatagaaccagaatacattctgaactttcttgcttgtattctgggtaggtagacatttaaagtagagatttggcataacttagttcttccagaaacttcaagcactttacactcactctttttagcccaggtttgaattatgtggggtcattcatggggtttatgaggtttgaagacatacttaaataacatgtgggttctctagaatgaatgtggaaggaaacattgtactcctgtggaatgctggcaccctaacaggagtgactttctcttttctctctcttttctccttttggtcaactctgtttgtatgtagtgtgagctctatactgtgggatagcattctttttagaatgcatgcatgtgaattgtgtagtgcagagatttgctatatccatttccagaatgtacatattgaacactgttttgcgaaaggcaggtctatgcaaactaccccaaagtccgaggaagctgagaggctgaaggaagagcctgacaaatcccgtttcttagaaagaaacatttaatagagacctacaagcagaagccgcatctgtgtctagggcagcggtaagacgagatgggggagccccacgccattaccccccagacccagggcttctatgccatagcggggagggaggagtggttccaaagggatacgtaggacaattgaagtaagataacatcaaggttgtttgatctgagggcaggatttactgtaagcacctgctcttacacaggaatagtagataaatgggaagtcttagagg

SEQ ID NO: 58873 - DNA, 1017 bp, Homo sapiens
atgcgtatacagtcataaggacgtttcagttaacagtagactgcatatatcacagtggtcccgtaagattataatcttgtatttttactgtatcttttctattttagataacaaataccattgtgttacctacagtattcaggacagtcacatgctatacaggtttgtagcctagaagcagtaggctgtaccatctagcctaggtgtggagaaggctgtaccatttagttttgtgtaagtacactctgatcacacgagcaagaaatagcataatgatgcatttcttagaccagatctccattgttaagtgatgcatgactggatatacacatacacatatgtgtatgcctgtatagatgcgtgtattctacatactcctaaatgtgtcatatggcaagggtgcctcattgtaattctggctttttccataaatgttaaacaagcatcttctcccaccgccagtccttttcttccttcaaggggacagggcctctggagcttatgcccagctcctgtcggatgcccccgtgttctggtcactcgtgtgcccgtctcttcacactcagttttcccacccctgagcacctcaggtgccaaggtgtgtttgttgaactgaaattcttaagcctgctgagtacattctcagtttgtcaagacagataaacaaataccttttttagatgatttaaaagattcttgacacagtcccagtggtgttttaacaacttttcaggtcctgatcagccaaactctgggccaaaagtaaatgtttaataaacaacataagagtgatggaggaaaaatgtatcttaagtggaactgtgtgttctgtaaatctatgacagattactgttcctgcttttgttgtgtataattattcttgttcctcctgagaattgccctctctttcatcatgaaacgtataagatggcctcctcctctggtaatttggagcaattggcctgggagaggattgatgtgtagtaaggacagtccgtaggagagatttagtggggg

SEQ ID NO: 58874 - DNA, 1490 bp, Homo sapiens
aaaaaaaagaaggaacactgttagggaggcagtcagtgagcctcaagtcagaaagacaaacaagctcattttatgcatttgctaacatttgacctcttctgggacgcgtaggtctctcaagttctgtttctgtttcctgtcacgcagatcagagatgtgaaacagacctggtgtacacccgtctggggtagcactgggagccacggcgtcctggcagagcaggtgtgcctcccacaggctgatgcagccgttctctgtgcagaggctgagccatcctaggagcagctgtggggtgaaagtgtccttccttaaacttagtgctcctgctcattctctcagtatggctaatagctcatttaaatatactatggtggtttttaatttttgtgactcattccctcccctcctcacctgtgtttttcctgtgtgtcagggacattttagggggaccaaaaggatctctgtctctgctctgtgcttgctctgaggttgaatagagaatgttcagggctgttcttatttgagtcactggagctgttgtgagctctgacggcctgggagccccactactgtcacatgaggacagggcgtggggtggctcaagcatggccgcttggggttgggtcctagtgctgtcatgttggaggtgtctgacctttgcactaagtttccccacttacactaaatggggataatcaaagctttgtgtggggattaagtgagttaatgtaaccagaacacttagaatggtgtgctgcatacagtgataatgcagaactactcactgctgctggagtgcgctgttatattctttattaggtcctcagactttttctatgcctaagccttgagggtctctctcagctgtgcttttctgttttttttttttttgtcttcaatagatttttctagggtcttttctggtaaaaagagactgggaatgcaaatacattgagcatgagttgagaggagtttggacatcagcctgaccgtggaaaactggggaggcgtggagtatatagtttcctctgggtgggttactgacagaccatgggagttctggggaaaatgtatgctcttctctttaagtacaagccaccattgccaggcagaagctgataaagtaattagaattgttgttcatacctgacttgcaggaatgtgtgtgcgtgtgtctgcatgcgtgtgtacgtatatatactgtgcatgcatatttgtgtgtgtgtacatacatatgtacacactgcatgtgtctgcatttatgtacatatgggcatgtggcatgggcatatggcacatgcgtatctgtgcatgcacacatgtacacagcacacatgcacacatgcagtgcatagtatgcctgcatgtacatgtgcgtaccatgcatgcatgtacctacacgtgtgcatactaatttgtgcacacgtgcacactgcaatgtgtacttacatgcaagcctacgatatgtgtttgcaggcacatacatgttc

SEQ ID NO: 58875 - DNA, 1012 bp, Homo sapiens
tactgtgcaggctggcttaagcagaaaagggaatttattgtggggacatggtggggaggtgtctcattactgagaggaagaaggctggctggcctcagaaggcatgagaactgggacctgggtccagcccagtccatggtggccacagctggatctcagctctgctcctccaggccaggtggctgctttctcctctctctgcagtgggattttctctgcccaggactcatgtgtctacctgtgggtctaatctcctagcataggctgagcctgcacctccttgagaaaacagattagcttagcttagtctgagtgttcactccaggcgcaccctgagagggagtgcagcctgcacatggggtgggtagttcttaaagggagcctgcctccagaggcgccgggggagggggggggcctgcatttagagtgtgtgcgtggagcatgtagcttgttcctgttttcatggagtcgcagagatcagaaagcatttatgcctgtttctgacagagatgcacacagctggtctgaatgggcaggattggggtgagggcagtggaggagggatctggccacacaggcagtctgctgtgagggccacttcaagccactcttcccttgctgagctgtgattcgttcttttccaagtgacttaaacagaggccttttctcttgtttgtggggatgaggatggcgaagggaggaggagggagagggtggctgagtggaggaagcgcagttgtgctgcggagattcctgctctgcagcttgtctgctgtggattggcccagggggtaggtggcacagtgtgtgtggcaggggggtgggggggaccaggcctggctccgctggtccactcttgggctgtgagccaggacaaaatcttataccaagcaagcatcttttccagtaaaatagagtgtctccatgcccttaggaactgcctgggacagcctcattctgtcctggattttgttctgggctctgctgcctgttgagcgtggaccagtgacct

SEQ ID NO: 58876 - DNA, 1056 bp, Homo sapiens
cctggttctctgtgctgggaagcgtttgcggttcgctattgggctcagggcggcctgctttcctgttcctcccctgtgccctcggcacctggccggagcatctccaagcgtctgccaccatacactgcagtcctcactagcctcttgcatgcgttgggggtgggggtgggggtgagtgggcggtgttaaaggctacacctgggattctccaggcctcagcagctggtgttgtaaggttacatagtaacagtgttaaccagcttgccctgtcttttctcaaagttccacccattcagttccaggggtccaggacgtgcctatcaggaacagcccttggatgcccttggatgcctgccttgtggatgtcatctgctcccatgtcagccatctccagggctcttcccgagaagagggcagtccccgccaagggtgttgcctctcaaacctgccaaactacaaaccctcttggtacctccacacatccctggagtcggctttggggaacactgtgttccatgtctaagtggagtcccgggcctctcccctccagtgtcgcctgtgccagctggacacgaagcagcagatcagtcatgaaaatggctgctcagctccgatctgcccttccttccgcaggactcagggacgcacagctccccagggctggtcacccaaacaacagcattcctttctcctcggcctctccccaggctgcttgggagagaaaacttccctcatcctcctccgcacacactaaatgccctgccggtatcttctttccagtgactgtggccccaggtcgtcacacatggccagacacagctgaatctcaggctagatcatgttggcactgcttccaccccttggataaaataaaattcccagtgacttccttaatattttgataggctgagtggcttatatgcaaactttgatgtaaacactaggccagaaattggttaactgtggtttaggactcctaatctttctccggatttattgaaaacatgtcttagaatggtacgcaccaagtggttctccctggtactgcatcctgct

SEQ ID NO: 58877 - DNA, 1094 bp, Homo sapiens
tggttatatttggcaaactatataaccaaaccaaacttgattatatttggctagtggaccagttcttttgtagttggttagaaaagaaaagatatcgctttcccttgaaagaattcattctccatgagattgaggttcagaaaatctgttaaataaatcccaagccctgaggcctccaaatcagtggctgctccgctgctcctctctctccctcgacctggtctctcagtgaccccctcatcttttcaaatcatagcatgttgggacaagtgttccagggaaggcctctgtcagtgtttagcttacatttcttgggtgtatctttttgacaaaattttccccccagggataaggaaaccagaaaaccacagtggatcagcgtgcaggaatgcataagggtggctctgtgtgtgtgtgtgtgtgcatgtacatacgtgtgtgtgtgtgttcatccgtgtgtgtgtgttttccttcagagcattttaaaggtctcagctattattaacatgaatttattatctatatttaggataagcccactaaggatgatttgggatgagctgtgaatctgtggtgtatatatagatctctgcacacgcgtatagtgcatatttatgtctgcacgtactcctgggcgttgacatctgcctgtggaatgcagacatctctgtgcagggttgtggcctgtcgtctcttgattggcagttgaagtgtcccgcatccccttgttattaataacttgcttggggctacattgagttggggatgtgcagtagtgatttatcaagacattgttataaagacacaaggctggttgtaatagtctaatcagaacaagtgtattcaaagtggcgagtttcaagcatgctgtttaggagacttcacacttattttcagcgttcagaacattgttgaacctctgcttttggcatcgtggtcacagctagtctatgagccttaggagaaattatacttgccatttggtgcccactgtgagtttctgaccaagaacaaaatttccaagcttgatcacctgccttattcgtgacgcttggctccaagtggttgttagctgtttccaaaaaacaaatgtg

SEQ ID NO: 58878 - DNA, 1070 bp, Homo sapiens
tttctggcctccacagctccacagcacctccagaagctttcacttggctctgcacctacaagaccatcgcttctgctcggctcagtcggccgtttggctctatgccgtttgaggggaagaggatcagagaatgttggccttcctctctaggtgcttctcctttctggaaacctgacctcacacctggctgctttgctagctctctagtgccttcaaatagattcttcagtgtatttcatcccgaatttctggttgcttttagtgagtaggttggtctacagcaaggaactttactgtcactggaagcaggaaaaacacctgagtgttttatttggaattcaaatccactctgaatttggcagtttataaattttgccctgagcaataatgtctatctcgaaggagagtaaatggaaatacaggcttgaagttgggatgtgttgcttttattaatagctcaaccagctgttagctcccagactgaggttaaaataatctctgtaaaccctgggtttcttatctgtaaaacaataatcatgcttgcctggcctgtcttacagcatttttattaggctcagatgtacacataaactacatacattaattacacaaattcaggacattaatatagtgactagtggcttgtatatatatcagctttaagtaaagaatgaactgttattttgttacactttgctctcaaaatgtgtgtgacatggctggcagactttcagcttccagtatgtgaatgcctctgtcacactgagatggtattggattgttttatcatagaaccaaaaacagttgtggaaatagctgtgaagcagtgatcctacctatttcagaaagaaattagaccaggaaaaatggagtcaacagagttttgcttgataaatgagatcaatcttcgagtcctaacaaactgtcctacttcaactatccatttaaaacccatcactttgccccccgtcgtggaaccatgaaactgaaagaacaactttctttttcagtggaagggttttgtatattttaggaaacagtcaaaatactgtaaaatttattttaacttt

SEQ ID NO: 58879 - DNA, 1005 bp, Homo sapiens
actgagcagaaaacagtggcagtgtggctgttctgaagatcagcttattgttagggaatcaaggcttggccttggcgcaagggtgctggcaatctaaccttgactttgccctctcctccctcccccctcttctttctgcctctttagaacccccatgattgctggtgggctgtttgtgatggataagttctattttgaagaactggggaagtacgacatgatgatggatgtgtggggaggagagaacctaggtatgtacaagcctcaaatctcaggacagagaagtgcctcagctctgcaaaaggcagggtgccaattggaaaaaaaatttaaaaggcttcagagtgaccattcactgggcttaatcgatccttgcaaacacatatgtaacaccccttttgctcttgaaagtctcatgagttgggcattaaaatgtgcctccctaggttagagtggaggatgccagaatacggataaagtctttgaagggaaatgcaaactctttcaaggcgtctgaacccaagtgtttggaatgttgcaggcttgcaaaaacagagggaaacagtccaggagctcagattcatgctgagtggtggagagtggaaaatgaaccccggcgaggctggtgggattgattgaattgaaatcatgaaaatccgatggggcagggaggccttggcacttaatcccttctcgactacctttgcgaatggttctcatttgtttttctgtttgtttgtttttttgtttttaaataccccatgcaaattatttttacccaggtttaggcacagcaaaattttgcacattgtggtctatattggtagccttatatttactgcataaaagatgaaaagatgtgttttgtttgtttagggtttggagtgggggagatcttttttgcttgtttcaattaaagccttttgtttcaaatgcttgacattctgagcgaattctcctgggctgctgagtgttgttaacttacattcgtccttgggtgagtgt

SEQ ID NO: 58880 - DNA, 1102 bp, Homo sapiens
tttagtggctcttctgagaaatgatatgtatgatccagtatcccccagcactttaagtactcattgttgtatctgtatattttttaatagagagaaagtaaaaattcatcagtctcatcaccaaaccagttgtgccataacactctcataatttgatgaattcgtctgtcagtatctatttctgtctctctctcttgtttgctcactggctctccttctgcctctacacacatatccactatatgcaattctgcaaactattttattttcccacaagtccaggacatcatttctgtcaacatgtaagatgcacactcatgtttttagtggtcacagaatatttcatttgattccttcctcatatttagtcataaagtttctcttttttttttttttttttgctattataaacaaagcagaagtgagcatattttcacatgtatatttcattcctaattgattgctgccttgagataaatttctagaagtagagctgctgggtcagagaataggtgcattcatatgttcttatctgtgttgaatggcattatggataatagtccatattctacttactaaaatgaaaaagtatatatatcaccttatatgaaagatataggccccatacagaaattattttaataatggtatctcagatcagttgaaagtttcgccattttaaggaattattttaaaaggcgagcattacctccttactgtatttattttggaagaacacagtgccttcctatggggttcttaaggagggctagctatagcctgaagtgggagtccaccttatagccgagaccagaatatgggagcaaagaggttagctgtgtgcttgctacttcatggatgctttaagataattcttggcagaatacactgctgatacctatgcagatgatagcttttaatgcatgtcagacattcaagagtagcttgtcccaggggctttatttatggcaaatcatggttctctctatgagatttaagtacatggttttctttccttctagaaaagccggctgggcgcggtggctcacgcctgtaatcccagcactttgggaagctgaggcgagtggatcacaaggtcaag

SEQ ID NO: 58881 - DNA, 1159 bp, Homo sapiens
tcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcc

SEQ ID NO: 58882 - DNA, 1316 bp, Homo sapiens
cctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttttaatcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccgctctttgctggccagagtctgtcctggtgtgtgagggctgggtggggtgggtgtggggactgggattggggtcagccttctgcagctcctgctcagtggctgtttcttatcaccttttgcagatgcgcttttattgctgtgccctttggttggttattcttacttgtaataataatcattatcatttgtggagtgtttatgatgtgccaggcacccagccaagcccttaaatacatttgcattttacagccacaggggaagctggtgaaggaagttgctagcctgctcaaggtcacgtccttcctgtgtacctgcctggagccagcccttggcactcgcacccagaccctgtgctccaaaccaggggacaaatatttttacagtttttcaagtagttaagatttatagacttgtttaccagttacctggggctcttcggttccatccaggcgtctctgaggttcttcaga

SEQ ID NO: 58883 - DNA, 1429 bp, Homo sapiens
ctctgctctgcaccaaaggcaggaagctctatgcccagagaagtgccctttctctgtgagtgggcccttacttgctagctgaccgtaattgtagctgctgtttattaagcacttagtcagtgcctggccctgtgttaagcactttacaaatgccatcccaggcctccttctgacagtcttgtgagcaaaggaggattatccctttcttacagtaggaatagtagcaatgaagttaggacctgcttattgcctggagaaagcaattagttttttttaaagagccagaaagaaccttagacatccctagtccaacccctttattctgtagaggagaaaactgagtcacctgcctcagccccagacctcgggcacagcattcaggctctgaccctggagttgtgtgtttgcagtgatccttgggatagaatgaacatcctgaacaatggtgataggagcggaccattcagtgacagtgactgccctgggggcagctctgcagagggcaggaaccatccaactgaaccatccaacaagaagccagaggccaggacctcaggcatctcatgcaggatacacagccaacaaagggccgattgacacccaggctgttggtgccagaatccactcagccactctagctggtgtgggaaggatcattctgaggtggtgttggatgataattctactttctgtagaattctgggcttccaagtgtggaactctggagcttggatacagcaggtcaggcgggctcagtccaggacgacaggactcctctgagacaggtgaaacaagctccaggtttgatgggaggcagggagcagcctcctgccagcttggagtcctcttcttagtgaagtgtgctaataaattacacagcacatcagctctctcaagtattcttggaactgtgcctgcatagaaaggaaggactccacgcatcccaccttggacaccctgtgactctgcccacgcttggctctctctgttgctccctgtcaaacaaagaggctgtgggatgaccatgaaaataacaacagcagcaacagtaggaatagctgctgtttcccaagcacgtgctgatatgcgctcactcaatccttacagctctgcaaggtaggcggactgaggcatctcacacagggcacacaaccaacaaaggccagattgacaccccggctgttggtgccagaatccactctcagctgctctagctggtgtgggagggtggaaggattaaaacaaaacaaaacaaaacaaaaaaaacaactgtagaagtgctcctgacagctgccaacactagtacgtgtctaggggatggaagaaaaaagctctcttctgtctgccaatgacctcctggatattttcctctttccttgtgaggttattccatgtactaaaaaaaaaaaaaaaaaaaaaaaaaagtcaa

SEQ ID NO: 58884 - DNA, 1049 bp, Homo sapiens
tttgatttctttgtgctgtgttagatcctgtgtctaccggagaggccagggaaggtgggcatagaagcagtccaatactaggtcccatgtggtagcttaaaatcctcatcaccaccaggaggaacatgaacattcccagaataacttctgctgctcttgattccagaagtaaaagtatgtttggtatttgtctgctaacgtgtgacatgctcacctgctgagctttctgtacttggactcaaaggagtagccagaaagggatctcaatgaggagtgcatgttttctattttcagtctgtataaatatcacattgctcctcctcagactcaaattcaagccagagttgcattcttatttggcctcactggtctttaagaaagagcctgattaccatgtctgcactgggaggcacatgcccaaaatgctagcattgcatcagacggcattcataatgatggccagtgcttatcccaaatgtatgagccggatgctgcactgtgctttatgcacagtatttcattttattctcacaatgactctttgaggtggatactctaatctttgccattttacagatggggaaatgaaggctgtgtgggattatgtaccttgaccagggcacctgttcggtaggtcagatatgcctgactacagaactcgagctctcttcgtgcaaagtactctcggggactctgcaggacctgagctgcagttgctcagcatagtgcccggccgggatctgcagccaagcgattcattcacaggtacagctgtcttagtaaggcccttccagctctgggcaagagatcttttcatccatgtgttattggcatcttcatcatcatcatcacagcttctgcctttatgaaggatttatcacgtgttgatgtcagcatttcacctggatggccattgcttctttgtgcctatgacagtcactgctcacctctctgattctgcaaaccacagtggcacacaatgttggaatcagggttaagtcatctgcaggacatctgtccctctcttctgttggaggtaaaccaccatt

SEQ ID NO: 58885 - DNA, 1129 bp, Homo sapiens
tgagggcacctatggctgctgtccagcgcgtgcccagtgctcggtgggtgctcagcaggtaggaaactgttaggagggattgtatcttgcccaaggacacctcgttcagcttcacatgccaggggcagaatttgaacctgggttggtctctccccagagtccctctacacagtctcaccacacttctgtacctgctggccaagtttccacacatacatccctcagatctcctctcccttccctatttcccaccccatgcagtcaaaatgtacatttcacccagtgatccagagtcacaacattgaaagtactggcaaatgttccctctttttactactcctgtttgttgtttttgttaacatgacgttcagtagtacttttaaatgtaacctaaatggttgaaatatatagcatccaatacttccccggttgctccgaccctctttgcaaaaagtattcccccaaagaaatcaggaatctttccgtctgtgcagaaaaccagcttgtgttaagttggaaggcttttcaactgtgcttggacggacgggacaagcacgctgtttctctgggttccatcaccactgttgcttatccccgaagtcacaggggaggaccgagcctgatctactgccttcacctgggcttctctcaccactggcttcatctcctcctctactcaccctgcccacccacacagctttgtccaaaggcatcagcacagtgtgacttttgctggaacaggttttgtttgggaagccagaaatagaggcaaaagccaggcaaagctcatggggctcaggccccttcagaagccactggctcccagtgctgtctctgctgctctccaactttgaggaattgggagtctctcgagagactgtggggttggcatgatggctcacacctgtaatcccagcacattggaaagccaaggggatgcggtggggtgggaggatcgcttgagccaggagttcaagaccagcctgggcaacatagtgagaccctatctctacaaaaaatacaaaaaattttaaaataagccaggcttggtggtgcacctataatcccagctatttaggaggctgtggtaagaggatcgcctgagcccaggagtttgaggttgcagtga

SEQ ID NO: 58886 - DNA, 1195 bp, Homo sapiens
tggccaggaagcactgaggttatctgaagctggtggcagctggggatcagccccatgacacatgaccaaggcactcttaagagaaaaaaatcaaagcaagtaggattttcgtttggagatctggtagtgaagcttcacagtcctagtaagcctcggtccagccttttcctatgaaaagttcatttcatcttctgttcctttctaaccgcatcattaaaatgagcaaacgcccagcaggactcctgtgtcgggctccctttgggggagaagggcagcttggccccgttctctggcgtaggctcgggccactgctgagcatggaagaaagaaatgcagcatggggctcgttttttattgaatttaacgaagatcagtgccaggtgtttggggctgcttaataattataaagtctctgctatttattggctactagaaatggtgaggaagaggtttatttttctggaaatagcatatcctcctaagtgcaccaaaatacagtaggagctgtgttttatggatggccaaatacaggtctctctctccttggtacctcacagtttggtcttggaaattgttttactgcaggaggcaaaagcttgtcactgaggtcttaaggtgtgaggaggagggagaggggtgaggagaaagggtctgatttgacgtttgctttgtgtgttatacttttccctgattccgggaaatttcacacataaggtacaccttagcatataccattttgtaatgatgcaatttgagaaattctctatccgtaaaacctctattacatccctgcagggaaggagacagcaaactcatattttttcctaggggagaaaatgagggggcaaaatcggaaaattgctaaactgtaatcccatgcgcaatttctgaatctttcctaaatgttttgatgactaaaaggagggtgagttgggactatgtctcaggccctcggagatgttaccatgaagtccccatctgctttgttccagatgtcagccacagcgacaggctggtagcagctccctcccgccccaccccccacactcaggcaaactgtcctgcctcggtgacatgccctggtgctttcctgatggactgagctcagtcgctatgactagtcactatgaaatggaggtggataaaaactggcaatgaggctgggcgtggtagctcatgactgtaatcccagtac

SEQ ID NO: 58887 - DNA, 1058 bp, Homo sapiens
gggcacagccaccagttgggtggtgatagcttctgagcaagaggagtctgtgcccatgtaggggacgctacccccaaagccagctctgtgctctcacatagagctggattcttcccggcagcatcctgtggttaagctttagagaaggcaagacacataaggaagatgtcatccaattcagaagctctgagcctgccgatcttccttgaggaggtctgacttcgctgtgtgtttgagctgtggaagagatcaccatcttaagtcacaggcccacgatttttgcctctgtgtatgcccaggcattccttgaggagatttggggaaaaatatcccagagctatttttatgtcagtgacatctttgggtaattaaaattacttttatatcattgttctcaggcatgaacttgataaatattcttaaatctcctcttgcttggattaatttgccatttaaagattcatctttataaaaatgtcactttatgtgtcaaaaactaggaattagaagactgggtagatttaaggaaacgagcaaatcttgattctgtattggttttgctatgcttcagaacttcaaaattatgaaagtcttacttttgctactggaatgctatggtggtgtttttactttgaattccataattagggagacaattagaaaatgtagccactgaggttagcaaagccagggttgtagttccacgtgataaagcagtacagcttgcaaggtgggcatccagatttctgagcgggaacagtgggaaggaattcctccacagtggcgggggtgaaggtgtggtgtgagcatgcaggcgcgtgtgcgggtgggcaatgggaggcctcagtggagtcttgattcccatctcttggaatcgggtcacagagagccgaggattcggcataaaccaggtgaactccctctccagtgacaacagtgcacctcccagctgtccttagaaaggacccccaaggcgtgactccaaacccctggaaagggccataggtgtgggacatttccaggagtgctctgacttccagcgtgattttaaatgtgag

SEQ ID NO: 58888 - DNA, 1109 bp, Homo sapiens
ttgttagagatgggatcatgctgtgttgctcaggctagagtgcagtggctattcacaagtgcagtcagcacactacagcctagaactctggtgagtgatccacacacctcagcctcctaagtagctgggactgctgacatgtgccaccgtgtccagcttaaattgtgcaacatttaacatttaacatttctaagaaagaaaacctctttcttagtgtctggcacatgagaaatactgagtaagtattggcacttctcctgctactgttctttggtgaccacgcagtggatagtgaagctaggttttaagtctttactgagcacccattatgtctcaggcactgttttgggcttttagaatacatcagtgaaccaaatagattctggcctccatgaagcacacattctagagtgggtaacagacaataagcagtgaaccaataagcagatggcatgttaaaaaggaaatgttgtagaaggaaacagtaggcaggtttagggggcttgagagtgtgggggaggggtggaaggcgtctgttgcagaattaaatagggtgggcaggcctgattcagaaggtaagatttgagcaaagctcccaggcggtgaaggagttggcccagtgcatttctggcaagtggagatccctcccatccaggtgaggtgcctgacagtgtgaggcccgaggcaggagtgtgcctggtgggcgaggcgcggaggaaggaggaaggcggtcagagagctgcagggtggaggcggggcacagagggccttgcaggctgtgggaagaacttggcttgcattttgaatgagatgaggagtctttggtggatttttagcaaagggataacatagccctgtgtaagttttaaagagatgctgtgagtgccaggttgagaacagaccctaagaggacaagcgtgggatctggctcccgccataacctggcaagagatggtggagacgatgagacgccttcagattcctgacgtgttgtgaagctaggaccagctggctgccctgatggatcgcgtgtttccaccgtgggaactgagtattggaaggatctgcggcaacgtgggcaggagaaataggcgtcattttgtgagttt

SEQ ID NO: 58889 - DNA, 1027 bp, Homo sapiens
taaccctatgctttcttctaagagcttgatcattttatgcttgcatttacatctttggtctattttgagtttttttggtatatgatgtaaggtttccattttttcttttgcatgtggatattcagttgcttcagcaccattaattgaaaaaaactgcttttcccccattgaattattttgacacctatggtcaaaaatcaatcgattgtaatttattttctattttaataactgtccctttcttcttgactacttcgcaataaaatatgtattgctctacagtcatttgaaaacagtatgctatttccccaggtaagactactttcccctcaacaagaccttctatatcaggaattcttatttaacttttatcatactcagtcccagagattgattgttcttttacattacatgcatacatacatacaagatacatcaaatatacatttttgtccaagtgggtaaatgtttgcttaagtcaagacgaagccaattatggaaggaatttctaggatacaagagtactgcctgaaattttgtttaaaaaatttatactgtattagattcaaaattataaaggttgacaatgtagtatagatataataacctctcatgctgtcagtggcttgattgtacctgtagtcactctaccacacatttgtgaaaattaagagcgattcagttgggactggggactgggcaaggcaatttgggctacaactgtgaacacagggtacttctgccagtgacgtctccaccattctctccagcagtagctctctaaggtaaagacttaccttcttttcatctcctagacttgaggatttgaccaatccacaggatgatgcagtttcatggacacaaacccatgaacaaatccttggttcactgcttagaggtattctttgaatatttttaggagtaaatttcagatgttgccccgattataatttttacttgtgatatttctgcatgcagttgtttcctctcataatcgcttgaggaaaaactaggagtgtgtcaatgg

SEQ ID NO: 58890 - DNA, 1086 bp, Homo sapiens
taaagcctttttaataaaaagaaaaatctttctctcaaaaccagaattaaactgagacccttggctctaaaggggtttgtgaactcagagacctggaaccctgtctatggtgttaagtataagaagctgctcctacctttagctctgtacaggattctgtggctccaggaggaactttgaagcttggtgagctgcaagataatcttaggcaaagctacatagtaatcaagtgcaagactgtgtgtcatcttgcagtggctgcacagaattcagagaagggagcttcctgggagagctgttttgctcttttcccaggagtctgttcatgtagggggtgaaactggagctgctactgctaaccctcagttctcatttgtcacttgcattttcatgcattattatcaaactcagtcttcacaaggactctgtggccgagaagttgccactgccatgtgactggggaaggaagttgctgccttcactttcccgggggtgatgagattaccagattaagtgatcaccatctaactagtcagactcaataattcaggaaatgtagtgccttttttttcttttactagaacctttttcagtaaaaaatatttatttttatggttatacatgaattgcttttagttttggggggaagcggatacagttctgtgagttttaactcatgatttgtgtaatcgataccacaaacaggatacagaagagtagaatcttgccagggtgttggtggtatagtggttggcgtagctgccttccagaagaggagaatctggatttttctctagctccctgtttaatccttgctgtcccgagttgtcctaatgagtactcagagctgtttttcaggaggtggggctttgcatacactggaacaggtggtgaggtctaacctagttttagagtccaaaactcactttgtagacttctttttagaggcacggtctcactatgtgcccagggtggactcaaactcctgggcccaagtgatcctcccgcttcagcttcctgagtagctgggactgaaggtgcattccaccataccttgctcacgcctttgtttttaaggactgtgat

SEQ ID NO: 58891 - DNA, 1558 bp, Homo sapiens
tcctattggctctttaagaattgtaccagtccacagacctggtttggcagactttatgccgtgagcatctgtgatgtaatttcgatcctggaacatttgagatccaggtccacctgggactgcacagcaagtctctgcgtgtctcagggcgaaatagagaacttgtgctaggtcaagcctagttatgaaaaagaatcctgaatgtgctgatgtgagaagggtgagcacacaaataaattttaaatccatcttatatttcttagtaaccttgaaatgggagaaattctgcagcagagccatttaatccagccaccgcagcacttacggtcatgaagagcaggatcgtgtgtcatttagcgttaggttcaaattctgcttcctgcagatgcccactgagttcacacctggaccgaagaatcaggtcctttaaccaaagacattagtggttattgccggtatttttacccagttttgttttcctgccctgtgtgggagcttgccttttaactccacatctgatttagaatttcctctttgcaaatttctccctgagggaaatttggagtggtggagaatggagggatgaggttgatggcttgttaaacttgaattcagtttctccaaaacaatggaatatgatttatgggggctgaaaatagatgcagaagtgtgggtttggtcagagaaaatccttgcgcctaccagtgtggagggagatggatgtgtttattaagaggctgagagctgcatcctggccacttggggagcaaagaggatcagcctgctagggtttaccagagcacagtatctaaaacgctacgacaagcgtgcgctccccacttgcaaagaatgcagcctggatctctcttccatctttgttccctgtttattaacaaatctcactgcatgggtagagtggggtagggaggaaagtaagcaggtggcattttgatctctaatcaggctttataatggaaaatttataattcaaattgctcttgctgctggaatcagatgaggaaagcacagaatcgagatttgatagaggcttcctgccttgctgcaactgtaaaaacaggtatatgtgtatgtacataaatgtgttttatggaaatgtgcgggtatgtaaatgtgtgtatgtaactgggtattgtatgcaaatgtgtattgcttgtgctaggtttttggtttttttttttttaatcagaaagataactctgatgacctagaaacctttgcagagtcgctgtgcatgagggaggtagacactggggaccattatgagttgtagtcggagttgccacatccccccacccccaccataagggagtgcacacagtagggagatacttggtgcccagctgggagagggaggaagcagtgctagttcccgtgccagccctaaaagcaacatttctgtagttaaggtgggaaatcctcgccattcttcaggctgttcttgtcttcccagccctttccttctgtttttcagcgtatttagcttcctagatcagctcctccggaagtgcggccagtagttatgggtggagagggccct

SEQ ID NO: 58892 - DNA, 1103 bp, Homo sapiens
atcggtctgactgctcctgggggctccgaacccgtgggtggagagggtaaggcggaggccgtggccagcacttttccagtgacaatgtcgtcggggaccttttccttcacttcctgggagcaccccagcccctgcatgggaagtctgtcacacctgtgggtcggacttttaggggtggattgaagttaggctttcctagttgagggggcttttctgaaagcccggcgtggctggtggaggcagggggagtcgttttttcactgacagcccaagagcaagccttacagcaggtgacgcgggcgaggcaggtaggagttggcccagtgagagttgagagagaggccacccgcggcgtcttgacttggcttagttttctccttaatctgagaaactttccctgtccgcgccattccagatctcttgttaagaatggggaggagtgaaggaagggaccgattgggcagcgttaaggtgcttgcttttccgccagaaggtactttcaggtgtgtcctgcttaccactgtggccacagacaagccccgaatacctggagaaggtggctagggtgctggcagctgcggctgccccactcctcttcactgtctgtttttgtgggagttggctgttgaaatatcaccacttcctctgcagaagctccgcagcctctgccttctttgaaagctgcagaccagccgccctctcatgctggtatttcttgttccacggccttctgtagcaggcccgtgctcctgcatgctgtgttcttccgtagaagtgcgcgcaaccggtgttgatgagggccagggagtggccgcggtgggcatgatgcggcttttcctgtggccttctctgattattgttcaaccggtcaggaacacggcacatgggaaggcaggcccaagggacctccagctggtgcctggacttggatctgggcatcatgctgcagcctgctgggaggccggtagggttagctggactctgagtagggagtggtctgcagacctctggcaggctgcggtgtggatgcgcggagctaaagctgggcttgcaaagtcacagttagctgtgcactgctttgggggtgggtacattttaaagca

SEQ ID NO: 58893 - DNA, 1126 bp, Homo sapiens
cgcccaccagcggcagtgaccgcgcacagggaggtgaagaatgcgaccacggtgatacgtccaacctggaaaacgggcctgagaaccaaagggccaacttctggccatgcataacgaagcagagcagtctcagggtagaaggcactggaaaagcgttgtaggacaatttttcccagtagaaacggtgggggtgggagggagacccgctcaccccttttgacccacccctgcagctcagccacgcctcctagggaggtgggcagccttgcaggagcccgcgcgaggctgcagtaccgccctccgccacatgagggcagcacggcctacccgtgcagcagcggcggcccccgcgcccctcttggccagagccaggcgcaggccggcttgcggtgccgtcgttcattggccgcggcgcgggcgctgccatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggtgcgcgcggcgtccgctccccggagccgggccatgagggtgcctctgccctgtgccctctgtggcggtctcttcggtcggctgctcctgcctgcgcacgctcagtgtcaggtcctccgccgagacctcgctgcacttcgcaatgagtcttttggcgtcaggtttggcgggtgcagcctggagaaagcacttctgtaaaatcgtgcgtgttacatggaaaggcctgaaagttctgggcaagtggttttgagctgcatgtcaaagccactgttacccgttcctgttaccatgcagtgcagtcagattgccagtccccttgtcggaaagaagcttgtggaccggggccttggagctcattaagtgtgtgttgaataaatctccaagcccacgtactttcctagggactcgggtcggaaagaaaaagaacttaatctgaagttttgcttaacattcagctaaagcttccagaatgggatatttagaagcttagaacattcttaccg

SEQ ID NO: 58894 - DNA, 1227 bp, Homo sapiens
cacatagtatgctcacagtaggtgacataagtaaacattcagtgcatgtgtagtgctgaaaaaaaaaatgcaaaataatagaaatgtcagtgtttagaagtccataagaatggcaggcaagaaataattcttaaaagagaggtctcaagttgtgccttgaactagcaaatattttcaaatgtttatgtcttgtttgattttttaaaaaagcttttaaagtacttcttcttggcatggaaggaaaatagtttttgtgatccactgttggattccacactctgggtggcttttacatggctcttgggtggctctcctgccttcttttcagtgtacctcttcctacccccacccttggagatagggtgttttccgagcctcagccctcagtcctcagccctctcctctccctcctctcctctcctcttctctcctctccaaattctctcccatggaggtggattcactctcccgaattctgctctgtcattgttaactgctgtctcacctgcaggctctagtcttttccttgccacctgccagcaccatatgctctccctccttccacagctgtctctatagccacctttttcctgattggtttagccgtagacctgttcttcctttttggcttccaactcatgaagctactctgtgagattctgcagtcgttgagaaatgagactatttctatcttgttcaccattgcatcctcattggcttgcacaatagctggcatttaataggtattttgtaacatttgtgggatgaatgaattcatttttctatagaatttttgtgatttctccagtttattctagtttttccattactttcattttggccctaatttctgattaattcattagcttctggacatgtttctccacttatgacctctccttttccttgcatcctgttcttgacttcttgattctgaattttcccaaaacaactttttcatgatatattagtacttaaaatgtgtagaatctggtctaaagtcttatctggtcatagccctcttgaattaacccttcctgttttatttctacttttgtccaaattgatgcctgcagtacccccggatgtattcctcactggtcctgaaatatgtcattactgttctatcttcctgccttgtcttctgataatcttttctctacgcttgtcagcatccacaaatttttagaatctacctcaagtctcatctcccccaccagacaccct

SEQ ID NO: 58895 - DNA, 1146 bp, Homo sapiens
gcctgggcaacatagcaaaaccctgtctttacaaataatacaaaaaaattctccagatgtggtggtgtgtgcctatagtcccagctacttgggaggctgaggtgggaggatcacttgagcctgggaagttgaggctgcagtgagccaagatcacagcactgcactccagcctgggtgatagagtgagaccctgtcctaaaaaagatggggaaaagaaagaaggaataaggatataatataagaaaccaaaaaaaaaaagtttttttaaaaattctgaaattgtgatagaatattgaaatatgtttgttctagaaagccaaaagatttgcattcttgggaattttgtgttatgtagaaatactaaaaatatagaatgctataggtaattttacgttgacttttgactttgtattttcctgtacttaggatgatgaaataagaaaattaagattaaacatgacaataacttttttccttaatttttatttatagatgtgtgtattgaggcttatacaagttattcggtcagttgagaaaattgaaaaaatcttaaactctcaaagttctaaagaaacctctgcactagaagcaagcaggtaagtattttttattaaataactcgtaaattaatacttcacatccagagtaaaaacttttttagttagaactcatttctgataaagaagaaaatcccagtctatggcttagtgtttttaaatgtagctcaagcaaagcagagtgcatgaaatggtaaagcttatacatattattatatagccttgatggtcgtaggccactgttccaacacagcacctttcagggagtcagagaacgtgtactttctgtggaaggtttttatttttgaaattgccttacccatggactagtgaaatccctactgaccttcaaggtgtggaatagcagtcatcttatttagacaggcccagagtattccagttgatgtatcttgaggttcaaaatgcacgagtgttattaagaaatagtacaggacatatttcactgaaatttataaacagcaaagaaaaagcttgcaaaataagcaaaagatgactgtttcctttgttatactgtagtgtcttattaccttcccacactgaatttaaaatcagtcaggtagttgagtga

SEQ ID NO: 58896 - DNA, 1032 bp, Homo sapiens
acttagaacatgctgtgcatatggcgtctggggaacattgactgatggcacaaaagacgctttagctttcaccttgtaacaaggtggccacataaaacactctgacaaaagtcaaaatacagtgggtatgaaagtctctcactgccaggcgtgtgatgtattctcgtggaaatagagaccttaggggttacacttctataactgttttctctactagcccccttttgactggacaaattttggagagaattgccacagaatttaatcagttacagtttcatgctgttcaaagcaaaggcatgcctcttttggacaaagtaagaccggtaagtgttgttttggatttccacagtttggtgtttagggacttgctaaataattctggtttaaactagtaatattgttgatctacagggttttgaagctaaccttgcattttttttcaatttttaattttttgggcgccagcttcctaagtgtcacacattatagattttgtgtaaagactcagtcacattctccagatgataagagtaaaattaattctgaatttcatggaattggacatcttatatgatgtagacaattaatttatccaaagcccttaattggattttaaatccatgatgtttcctcaagattgacttcgtagcttaagaggaaggtaacttttttctcattctgtaattctgtctaaattcttctttgatgaagcagagatttacttataaagtgattggagtgaggggttcattgttattctccaggaaaagttattattttgattttatatatgtcattatctgttggtgtaagaggcttgttatatatctacttgcagtttcagaaactgttacaactagagctttttttttatttacccaccttttcttgcagcgtatagctggcattacagccatgttacagcagtcactggaaggtctcctattagaaggccttcagacgtctgacgtcgatataatacggcactgcttgcggacttacgccacgattgacaagacacgggacgcg

SEQ ID NO: 58897 - DNA, 1049 bp, Homo sapiens
ggcatattaaattcagtagccacattgtgttttatttaaactcagcttatcttgtcatatcattcttgtctcccaattttatcacaaaaaataaaataatgaactaatatattttcttctgtctttctctgcctcaaacccttccctaatctgaatgatggtagaaaaaaaggccaggatgaagacagtgaggagttgtggtggcgaatcatgtgctctgctttaaatctttttttaaaagttgttattttattttcagactcccagggaagcagatgagagtgcatggtttgtcagcccatgtctcccccacagttgtatctgtacagcctaatccaaggaagtagttttgaatgtgacctgttatttacttcactgtttagaaaatgtgtcacagggaggagggtgagtgtgaggaagcagatttgtaaagttttctttattgttttctctgaaatagatcgtttgtacttcccttttaaatgcttttttaaaaaatgatttttcttttaataggtgattatagagcagtttgttgaatctcatcccaatggccttcaggtcatgtataataaactcctggagtttgttcctcaccattgccgccttcttcgagaagtcacaggaggtgccatctccaggtaatttaaacaaccctgtgtggacccccacctccctttcagtgaccgcacctgctaattgcaggtgcacgatggacgatgactgtcttgtatgaactgtcttgtatgaatccattatgaatcttgttatttcattgtttctactggtgatactgtgaggcagattccattagcctcatttcaaagttgtggaaactgagatgaagctgagactgaagaccacatttccgaatccaaagcctagcctttcttcttctctgcactttttcctaaatttagtttgaagtcagaattgctttccttccatgattctaatatgtcataatctgtctataaatattaattcagtttatttcaacaggttttatactaattgtgaactcatcttcaatttttcctccttttgtt

SEQ ID NO: 58898 - DNA, 1029 bp, Homo sapiens
tttgataggttttctgaatctgagaattggtatctttcatccattctggaacatttttatatattatttcttcaattgtgcttttctttcattcctctatcatctccatctagatctcttgtttagacaggctcaccctatcctctgtatttgctgcattctcgataatttcacagtctgtcttctaggtcactaattccttctttagttgtgtctaaactcttttccacctgcacattgagtttctggttaattatcatatttttttatttctagaagtcatatttgttgtttgtctagcctccctggcgaatttgtttattaattttttaagtgtagagaggcacaagataagcataaacagacagcctggggcccagcaggtttcccacagataagacaacacattgggaggtttaccattccagaaatgcaacttaccttatctgttggctgattgtcccatgttacagtgcattgaataacaggattgtgccattttcaataaattttatagcaacatttgtaattttaaaaagtagggctttttaaataagatagcataaggagagtgaaataatggctttaagcagaagcaattgtaagctttaagcactagcaaatgtgaagacgctttacaatttgctgtgtgctttagagactcgtattgaccatgtttgactcaggaaatgtttcagctcagaaatgaacctttctgatagaacttgactttagaattttaggctaatacttaacatttgtgagtatagtttccagcagatagtatccatttatttccagaaatactttcagctttaagccttaatgtaatgtgtttcttgtaagagggcaatatctttatatttgttttagcatccattatatgcagaggtatagttttgtcccaaaagggaagaataatccctatttttgtctcaactccacacacctagaccaccctctgggataacataagtttgcccaaaaccatttgaaataaatttaaagcctgtagtttttactactgta

SEQ ID NO: 58899 - DNA, 1044 bp, Homo sapiens
ggtgagccagctgtcatcagggaaaaaagaacgcacatctaggaagcgctggtacagacagccgtagaacccgaagggcaagtaccatggacgtgggagagggtcacagattagaagagcaccaagcagtgagttctagttttaactggccacttcctgtgatttttctcaagctgccaacacaggtacagaatgcagctttcttagcttggggacgtttaccttcctgtgatggtgttaagatagatgggttggaggaaccaaagttttatggccttgaagtgaatagaggatcataatcaggtgctgctcaccagcaacaacttcttgatggagacttaactggcagtttgtttaatttgagaaacatggggtaagttatgattcagaccagctgcaaataacagagaacccttatataacagtggcttagtcacgatttcttgttcagttaaaaaaaaaaaaaaaaaaaagcctgggagaataggcattccgaggctggacttaccagtgagtgacagaggaagttcctgttacttaggaaaaacagagaatggatagggaaaggcatctgtcagagtcataaacattaattcttcttcttgtttttatctcagatttagagaaatagcgggatccttagaagcagcacttacagatgtcctggaagatgccccaggtaactcccttaaagtgataagtggcatggtatcctaaatgagttcattcagttcaccaagtcatctggattgcagtattctgagcgtacttttactgttttttttttttaatcatacagtaagttggaccttaaaaatcacttagtttgacttcttttttttgctttttttttgagatggagtctcgctgtgttgcccaggctggagtgcaatggcatgatcttggctcactgcagcccccgcctcccaggttcaagctattctcctggcttagcctcgaaagtagctgggattacaggtgtacaccaccacgcctagttaatttttttatttttagcagagacagggtttcaccatgttggcc

SEQ ID NO: 58900 - DNA, 1096 bp, Homo sapiens
ttgggggacccgtgggtaccccaagagagaacctctcactcacctccctttctaggtgtctctccagcttcccctgacaggtcatgtccatatagggtttctaagggtgtgcacttctcctcctgtgtggagtgcattctgtattgtattcacctccaccctgcttccttttcagtagtgatgggacaagcttgagcagccatgctcccccactttttttttcccattagctcaccttattctggtcaggcatgatctttagtgggctggattttagttactttacattaatttaccccgatattttctgttgatgtttaatcttcagctatactttgaaagtgctaaaatattaaaacttcttcctcttttttctctgtatagatccgtatgtttttgcttgtaacatcaactctgtggggtgaatttagtggttaagtcctctgatacacaattctgctttcctcaagtttagatattttgtggtgcttgaataaatactgttttgaattttaaaatttgtatgttttcagtaagaatatggtctttactgtgagctattttcgtattatggagcgccatagagtagaaaatgtttttgcttattctctgtgcctgttaatagccattaaaccatgtgatttctcatgttgttgaaatctttttatagtaaaagcattaaaactgtttctttcctttgatgaaaattactgaaattcctgattttaagttcaccattcattagcaaattctagagtttgtagatgcaaatagaattgcctcttcctttgatttataaaaagtaactgaatatataaagtgcatatttatttcagcttccagaactcttggaaataatcaagccaaaacttgaaatgattggctttaagaatttttcttctatctcaggtaaaaatgaatcttgactaagcaaatctttgaataagaaatgatttaaaataaaatctcagagactgtagggtatatttaacattttcttctgtagttgtaaatccttggttgtttctctattctgtattataacttacctaaataagatgttttatttaattcatttgatctgatttattatagt

SEQ ID NO: 58901 - DNA, 1004 bp, Homo sapiens
atacatgaaagacaaaattggtctatagttttctccatgttcaggattaaaaatttaagcaaaatccacacacacacatatttcttaaattctgagggaatgctatgttagacacttaagaccatatgtgtgtgtgtgtatatatatatacgtatatacatgtatatatatacacatatatatataaaatgatcttaagaaacttaaatacttaccgtggttgaattttcgttggaagtgaatttttatcttaaaaatctctttttttggtccacaaagccagttactctatttggtgttacacacaaatgcctcttttcaccaataaacgtgtcttctattcaaggtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcaggtaacccatcagccgccggcagctccagcgagcctgaaaccaaattctgagagccgggcagttacttggtggctcgcgtgatcccagagatgctgtcgcagtggctagggaattgcttcctgtgttaagactaggagtcggggctcccaaattactttgcccctaggcagtatgagacggcaatatgagaattcccgttttgaagtctggtggcgtgctctctggtgctgttgccatctgcttgtttccccagtgcccatgctcacggagctcactacagtgagactttttggtccagtgcctgatacttaattggtgcgaaccccaggcttttgaaatgcttgctggtttagcttaaaataactgaaagcattacccctctatggtgcatgagaaatcctttgagcataacttctctgcttccctgcttggcctttgtagctttcctataaaacacaaattttagaatcatggcac

SEQ ID NO: 58902 - DNA, 1087 bp, Homo sapiens
aaatgagaaaactgaggctcaaaaaggctgagtcatcttcccatggccacacagctaatcattgttcagggctgagtctgtgcctgattctgctgagaccatcaagccctcatccactcctactcatctcatctgtctgagtccattggggggcctcaccggcattccctgttgtctgtttggctggggaggggagtgtctggcagcctcagcgggaaagatgagggagcaatctgatcaagacggtcagcgcattatattgagagtgtcaaagcatcaggcttgtttagagccaggagttgggattattcctaagttttggttcccccacggtcctgggtggatatttgcatggggtatgtctgggtttgaatttcagacttattctcgattttttatttcaggatctaacttggcaagatgagcactctgcccctttctcctgggaaacaaaggtaagttggattaaatttagatctatttgttcttttaaaaagaactgagtagttgtatatttttctttcagcatttgatggactcagaagacagccccctgactgccaggctgcaggggatgtgtccattgttggtagaaaaggaggggatgggaggagcatggtgaggaattaggaaactattgtgtgtggtttggtgatagtgagttcaaagtagtagtgctttctgccagggtccaatgacgccccatgatgcccattgtctaggactcccggccagcttggttaagggggccagccctcttgggggccctgtctctgctcatacctctggttcccagcacttagcaccttgatgggagatgccccataagacaaagctttgagcaaatgggaggtgacgagctgattgatagacatagacatccatttagctaattcatcccaacgtggatcactaattctgtctcccagtcattcttcttctcatcattatcatcatcatcaccagagttgcttaagagcatcaagcttcactgattttaattcattttccccatctcctaagttgccccagtagaagtacattcataagcaaaatgactaaaagacaggtgtctttaacccaaggg

SEQ ID NO: 58903 - DNA, 1237 bp, Homo sapiens
ggaaagaataacaatgctaccttacatcctgcagttaacgctttacagcgtaccttgaaataccttatctcattcagagctcatggtaactttgcgagttaagaacactgtccctgtgacagatcagggaagtgcagcctagagaagtaaagaaagctaataaggagtgaagctggacctgaaacctgtgtcttttgattccaagcccagcatgcaccacagctggacatgtaaatcagagtttaattttctttttcaaagctctggcttaacttccaagcgacttgtaacgtgttggctgatgccgcaggccgttgttgtgagaggagccattctgttcacagctcctccctgcctttctaacactgtttgatattacaacatgaatataataaatataatgataggaataaatataagctctgccctttttttgcaaattttgttaattttcatgccgctactttgtgtttttctttttcagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctat

SEQ ID NO: 58904 - DNA, 1050 bp, Homo sapiens
gggtgggtgtgggtgtgggtgtgaatgaagttctccagttagtggatataatcctgggtactcttcagaaaaatcagtctctgctttgagcactagtatgagcataagttgcatttttgagttacgggatgttaggtacaactattctgccatgattcaaggttgctgcctactaagatggacatgagaaaacattcaaagggagctcttagaagtgagcagtgccccttgttgacgaagagaacctgtgagcttttggtgctgaggttctctgctggcctctggtaggagctgtggggagcgtaacctgggctctgttggggcctgaagacaggcagagatgtccttggccaccaggccaccatctcttgtatcagatgacctccttggccctttttaaaaacatgtaaggtagagccagcactacagagttgcagttggggtttacagtgaatgaaacactagtaacgtgaattttctttttccctgaaagcagtttaatactaaaacgaaggatgggttcaccgtgaacacaaaagttcccagccttaaagaccaagggaaggaatatgatggattcacaatcacgattacaggagacaagtatgtgcgcttcttaatgtgggtgtaaactagagacgaggcaggaagggtgcctgtgcttattgtcactatagagttttgtggtgttgaacttttgctccatcctgaaatgaaaagtatcaaggtccagtgagcagttataaccagttatttaaaaaaatgtgacatctaaagtattacaccagcagatacattttctgactgtctaaatctaaggactttctagatactatgtatgatgtagtttgtgggagacattcttctgggttcttgaagttccttgggggggcgagggaggcttttactaataaaatgaaaaaagatgagcagttggcggattgaagtccattgtagatttaaatatatatgtataaaagccaatctatatatatatagagagagagagagagagagaaaacagctttaataattaatgagtagtataat

SEQ ID NO: 58905 - DNA, 2085 bp, Homo sapiens
atccccacctttgcaaacacttctacatgttttatttggaatgcttctgaacacttctggttttataaaggtctctgttttataggattgctgacccagaccagcccgtgctgtggttagatcaaatgccagcacgaagtcttagcagaggttttaacaaccacattaatttaatcaggtacgaaccttttgtgcatctttcttcttttcctaggagtttattctcaagacacaggccatggagaccaggagtgacccattgctcctttcctggtgactttttgaccagggaacatactgattgactctgcacctgtggagtcctgcctgcattcctttcctctagcccagctgcagaaagaaacatagcgcatgccatactccttccccaggcccttctgtctggtgtagagcacaaccgaagggtagattgcagatgttttcctagggcgtcagtctttaaggagtcttaaaatatagaaaattattagatggagaacattacagtaaccataatattcttttgatagtacatggctcaaataaattatttgacaagtctctcgtggtggagtctctcacggtgggcggctccccattccaccccaacacacaaagggcttagataaataacactatctggtaactaagctgccatctggggagggcaagtcaggttggctggaaaacttctgttttgtccagaggctctgctagttggggacatgggtgaaatgctcacttcttcactctttctttatgtgcctagctgccttctaaataaatggtgaacaaatattaaaggatatcagtttcttggggacctatattatcagcccatcttttagtgaatttaattttagataaaatgtatagatatggtagttgtgtcacctctaaaatgcttctagttccaggaagctgaattaagaaaatatttttctatacacctttaagtttgggttttaatggaaatataatttgtatgtatatttatttttttaatttctagaaaacaaatttcttttcaccttgtgacttgtatattcctatttctcatggaataatttgtggcatagataggtagactcaagcaactaactttaatcgaaggctaccgtagatcagccagtgtgctgtgctgtgctgtgtgttggggatacagaagggagatacagccccacctgctgaaagctcacagcagacagaccagcagacaactactatgcagtgtgttaagagtgagctgatcacatgcacaggatgccatgggaacctggagaaggggtgcctgataaagccttctggtgctacagggctatttggaaaaatggaaaacagagagaggtggggtgattaacttggacccatggatgagttaggtatggtcaggaaactgtgactaactcattacgcctggtggtgagtttgcaattaagggagtatcaggaattaaggctagaaagataggcagaagtcagaacataaatcattttatagtccaagctaaggaattttttcccctgaagacaatggtgagccattcagggattataagcagagaagtaacaggaacagatttgcacattgggagaagatggcaaaatagattggagaggaggcaggaacctcggaggtaagggaggaggttggaaaattgtgtagttgttcaggtggacaagtgcaaaggcctcaaaagctgtgtggtagtgagttggagaggaagagctagactcttagaagatagaatcaggagcactggcagtgggctgcagtgggaagggcatggagctagaggaaggccaccttccctcaggtacgtggttgtcccattaggccagagagcaccagaacgaaaagtaggtggacatgtttagtggggaggctgggagaagtgtgggttgcaggagggaattcttacttgacagtaacctttgaggtttgagatgcctggtgggaacccagggagcgatgtcctgggagcagtcggctgtgtcatgtgactcagcatgttggctgaacatggagttctgggagtgagtttaaaaggaaaagatcagaagggatagaaatgtgaggaaaaga

SEQ ID NO: 58906 - DNA, 1103 bp, Homo sapiens
ttcaccgtgttagccagaatggtctcgatctcctgacttggtgatccgcccgcctcggcctcccaaagtgctgggattacaggcgtgagccactgcgcccagccaatcaattcctattttgaaaatattagttaagtgtatgtcaaataataaagatgccagcaatttctaacaaactttagagaggaaaacctaacttggaaggcctggtgttagcaagcaaaacagggttcatagcctgttagctaaaacagactgacgttatttgacaatgataagacttatagtttattttcactgagatgttagttaccttctccatttaactgcaatgtcaaacatgtctctccactgcatcaaccgtgtcttcccattcattcgaactttcgagttggtccatgtacgctgcacggcttgcatgacctccaatgcggccaaacccatagctacgagaaaggaatatcgagaagagttagtacactttagagggactgagttccacctactttacagagtctcagtgataactcaagagttaacacataaagggtcagaagtattggtgatataacaagacccaaggcacgtttcagtcatgatggtcctactaaaattaaaacccatcagagttaactgaagacaactcaagttgtctgctcccaactctgcctcctactgaaacaagtggaggtttgcattcttcctcactcctatagtaaggaaatagctccctggatcagctgtctgattttgagtaaggacttaagacctatattctagtttatactacagcaatagcaaaaaagccaaggatggaagcagtcttctttcagaattcagtttgaatgattctacacatttctattctgatcacatggagaatttgaataagcacaataaatactaatttattaaaatgcacaacatggcttaaccacccttcctcttatgccaggaatattttcattttcaggtagtttccagaatacctctgtgtattctcttgtttggcaggaaaccaggtgtttcatattgcatcagggatcccaaacgatcagccacacaaatcagctcctgtacttcaggcttataactctcaaaat

SEQ ID NO: 58907 - DNA, 1110 bp, Homo sapiens
caggcggatcacaaggtcaggagatcgagaccatcctggctaacacggtgaaaccctgtctctactaaaaatacaaaaaataagctgggcatggtggcgggtgcctgtagtcccagctactcgggaggccgaggcaggagaatggcttgaacccaggaggcagagcttgcagtgagccaagattgcaccaccgcactccagcctgggctggagcaagactccgtctcaaaaaaaaaaaatgtagccaaagtagacccagactgactgacttatatttgaccttgttatctcaagtcagtggcaggttacctctatcatatactaatagtgacttactaaaatttagaaactctttagaattcttataattgaagaacagcttgttacaaagtatttgtatggcagctagccataagaaagtttctttagcagtatttggatgtgtcagatctcatttcctttctgcagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaagtaagtgctttaaatgaagatgatttttttttcctttctcaaaactgagctataagctgggcatggtggcacgctactccctgctacttgggagggtgaggtagaattgcctggggccaggagttcaatcaagcatactatccttgtgcctgtgaatatccatccatcgcactacagcaacacagcaaagaccccatctctaaaaacaaaacaaaacaaaaaacacctatagcaaacatcattttaacttatgaaatggtagatacattaacattaccattgggagtcaaagcaaaaagcccagaatcagtgcttctctgtaatactgaactacaagtcctagacagtgcacagagagaagaaaaagaaatcagtgatatggattagaaaggaaaatagaaagctgtcattgtttgcagatcacatagttttctacaaaggaaacctagaagatctacaaattataggaaatgatgagagtttag

SEQ ID NO: 58908 - DNA, 1361 bp, Homo sapiens
agtgaaggagctcatgacttagttctgccttggtcgttctgcaggtatgagtgcttaacttccctgagcttctggcttctcacttgtaaaggtgctacaaaagctagaaaagaaagacagcgacggaaagtccctttattaggtaccttattcaggaaggattacattcaagagcttatttatctgatagtttgaggagctcttatactaacttggaagaagtgtgtttggatttgtttggggtttaagggatgatatttgtgcttcctgtctcacagaattattgaatataaattgaaaacagatttgaaagcaccttgtaaagtgctgtatgaatgtaagcaggaattatatttttaaaaaatgttcactatttatagagaattgggtcccgcttttcaggaggtcaagtgggagcatcgcctgagcccaggaggctgatttcagcctgagcaatgcagtgagacccggtttctaaacctatttgaaaagcaaataaaaagcagattgatccataacaaccatttccatcctggaatggttacaattctaaaatacacttcttttttcagaattctaaattatataatgatttactagattttaagcaaagcaactttggtgaccaaaaaaaaaaaaaatgcatttttaaggctatgaatttgattgagaatgatgaactgtttatgattataattggtatatttttttccaaatgggaaaagtgtgtttctatccatatattaacatttacacagtttttagggtttgggactcattgtgaataatcaaggagaggggtttgaataagcgtctgcctttggaaatcagcagatgaattttccccacagaatttcaagagctctgtggttatcctatgagctggtgagatttagaagtaagtgaaatgtaatgtgtcagaggctataaaaaagcaacaaagggaacactcccatcaaggtatcttgtttacatattggtccataattctgaggatagcttattctgtatgtttcccgtaatatctatactgtattcataactattattaaatacctagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaaggtgagcatccataaataagaacactgtaattggaattactggattattcttcattgaagtttagtgaaatgaatagagaagggggactgagaatagtgtttctactccaacaaaaagaaagagaagaaatcattgctcttgtcctgtagactagtttac

SEQ ID NO: 58909 - DNA, 1073 bp, Homo sapiens
tggtgaatctaggagcctttttgcttgttttaggaacagtttcacattgggctttcttttttgtctcttggttcaattttaaatgttgccagttatgatcattttaaattatttcacacagctgttaggcttgcttttggtcctagggcctttcttaattaaggatatgatattaataatatgaaggtgaaatgattagtattcaaagttttaatgaagtagctagtaatgaagtagataaaatggaaagctgatgtcccattgtaaaggggagaaatttaaggctcatatttttcatagtaatgcatttgtttactgaaattaaatccttctgacttatagtttattgcattttctgcctctcttttttaaaagtcctcctaaaagaaaatctgtcagagactaggatatatatttaaatccttttatgatttaagtgaatctcaattttaacaattatgcaaatgaaataattttctctacactttttataggaagctattgaatccttcaaagaagctttgaagcagaaagttgactttattgatgcatataaaagtctagggcaggcatataggtgagtaaaataataacagttggggtaggagggaggctgaagagtggggagacaagatagcttcacataatatttaaaagaaatagtatttcttaaccaaaggagatgggtattttgaattgtgcaagtatgtatagacttgttgatattttctctgaaatgcagaaaaataaattgtaccagaggatgtcatgatgcacagtattctctcttaacttcagcgtgtgtattggtctagaaaacgttcatccttcaagggttgttttgaatagtggcattgtaagctattggggtgtagacgctgctgctactttcttagacagtaactaaggtaaatttcctatgatctctttgaagagtcctagaatgaagggatggaaaagttgtgattataatgtacatctgctgagaatgagaagttgtaactagaacttggcttcctgacgccatgcattgccctgatgattagagccattgtgacttttggcttaaaaaa

SEQ ID NO: 58910 - DNA, 1144 bp, Homo sapiens
agagacaagtattaaatggaccagtgagtttgagctatctttatatcctaaaggtggtctctcttggccaacagcaatttagaaattaattgagtgggtgattgcttatttactatatgatgtaatacgttagaagtatattaggcaatattacattacaaattttacaactatctaatccaggggttatatcaggcattttggatcttcccagggaaacaacaaaaacttttctattgaattccattgttttatctatgttgtaaggatatttcacaaaccatgcgtcccaagcaccatcagtcttcactttgagagttttctgagagtgttctcttagttacaaggaacagccctagggtggtggttgcctgtcaactagtaagaaagatggggactgaaaatggtgggatggcatttgccaagcaaattaattcagagccagttcatatgcttagagattgattcattcaaacgtagtttctttgttcccaacgccttaaaatcttgattctactatgtcccctctttggcagaatgaggtagagagctgtgcagtgattagacaggaaccccgaaaccaaagactcttaaaagctgaagagaaatcagactttgaagaactgtggcgtccaagcatgctgtaagtggagtgggcagccccctgggcgtctccacctagctgtccacaagcactccagacttaacacgccccgatgggctcgttattccctcctgccccaccccatccccacctgcagctgccctttctcctgtacttccttacttggttaatgttcttgccacccacccaagctcttcagcttaaaagcttcctaccctttcttctccctcatctcccatacccaggcagccaccaaactctgttgtagtttgcctttcaaaatgtctcctgaggttgacccttcttttctctcctcagagacactttattagtttgagctttcattatctcttgctccaactactgcagcaactccctaattggctccctgtctccattcccttctgtctctagtctgtctttgttgctgctagtagtaatcatctctaaaaagtacatttcctgaggtcatgcacctgtgtgaagccccccagtcctcactgcctacactgcttggcc

SEQ ID NO: 58911 - DNA, 1034 bp, Homo sapiens
ctggtatccacatactcatccattgagattcgttgattccatgtttaagtagattaagtttagataatatcctgccatctgtggaatttgtgataggtagccgggtctaacatgttattgttgagtaagtaggtagacttgagtgagttaaataattataatatcatgactgatttgacatggcacatctcttacatagaagtgaagttcatatttatttttaaacaattggttacatcattactaaattattagttttctcagaaaattttttcagcctggttttgagtaacagtatgtctcatactaagctaatgccttttcaaggacattaagaatgctgagcttgctctgttcgaactgagccgagtaattaccttggaaccagatcgtccagaggtatttgagcagcgagcagaagtgagtgtggctttctttttccctctgtcattattggattagttgaatctcaatttttttcctattactttattatttgtaaattttaatgctcccttaaaactcttatgtttttctatgtcggtacttaatgcctttaagcatggttgaaattaatagaaaactatggattgagtgatattcctgaactaacatagaagagtaatatttagtatgaaaatatgtggttgaaaatatttagtatgaaaatatgacgtgtactacttctatagatattcattgaaaaatataacacataatatttgtgttatattttgaaaaatataacacagaaaaatacaacacacaaaagaaacacagtttcatccatgtccctacaaaggacatgaactcatcattttttatggctgcatagtattccatggtaatatgtgccacattttcttaatccagtctattgttgttggacatttgggttggttccaagtctttatgtaacaaacctgcacattgtgcacatgtaccctaaaacttaaagtataataataataaaatttaaaaaaaaacacaaaaaatataacacaaaagaaaaacacataatattcattgaaaaa

SEQ ID NO: 58912 - DNA, 1081 bp, Homo sapiens
tggcagataccctagctcagatttgaaactgaacagtagattaatctatcaagtttttgcagagtttctttctggagaatccagtgccattctattaaatcccttagcagtgcaagacttccacccaggaccttatagccagaggcagctgtttattcttctttcttaactgtatagcgaaccattcagagaagtaaaaattgtagaggctaaatgtagatgagaggcatttcattcactcaccaactaacctgtgtgtaaggactcaatggccggggtcaacagatgttttgtccttggtcctgatagatgtttcctccaccccatctggattgcagaataacaggagaaagcatgggagcaggctgcaaaaagagtctggttttttatttcaacccattagtatgaagggttgaattaatctccaacagatttcagtgcagcctcatttctagttcgtcattgtgttggcactgagtggttctttccttttcaggtaatttcatggatatatgaaagaaaacacattagttacaggcattacctaatcctttgctcacatctctttacccctctgagcctccttcttctctgtaagacatgattgctgatgctgccagagttgttgagaggattgcattttaaataagatgaccctgtgaaagaaaccagcatgtttctgcgtaatgttggttcccttctctctctattatttttttcaacatgaaacttttatcacatttcatacaaatgagctttaagaacatagacttttcaggttggagactgcgtattgacttacgagtggtcgtagcataaagaagtagagctgtcacttgcggcattaacgtgctttaagcagaaactgattttttgttttgttttgtttatggtttttgacgtgtttttgttttggtctgactaggaggagcctgatctggttagtgcaatttatggccgagggatagcctatggaaagaagggactacatgtgagtatgtaatagttacgattgccatagcgcctacatgacctgacacagaccagggttttgctagaactgctactgttcattgaccct

SEQ ID NO: 58913 - DNA, 1012 bp, Homo sapiens
ctaacatggtgaaaccccgtctctactaaaaatacaaaaacaaaattagctgggcatggtggctggcgcctgtagtcccagctactcaggaggctgaggcgggagaatggcgtgaaccctggaggtggaacttgcagtgagccaagatcgcgccactgcagtccagcctgggcgacagcgagacttcgtctcaaaaataaaaaataaaaaaaaaaggaaagaataaattgaatagagaaaacctaaatactttacagataagcacagtaatcaattcagtgctgtagtaatgatgagaccatggggtgacttgaggggaggcccgtgcgagggcctctgtgtggggcacacatccaatcctgcagtcaagatgatgatggctacctttaggaagttgtcagtgttcggatatttcagctgttgcaaatttttgaatggctgttttttttttttaatttaaaatttttattactataaaaatgttccagctgcaagagctggagggccaccatacgtcattcactgtggcacatctgtcatagagctttgccttcctgttaccctggatcgggctcttgttttccattgacctgcaccccactattattagccatgttgtcctgcttgcttccctttgggaagaataggcttagcagagctgactttgatctgataggcaaatctttgtcttctgtgttggtttttgcttgctattcctagtatgtggcaagaatagcatgactttgcatggtattcctagcacatggaacctgagatagctaacagtaggccctgagtaaataattgtggaatgaatggctgacatccatacagtgaacagtgggaataaaggagaaggagcatatttattttccaggggcgtctggaaggaatccaaaggtggtgtttgaactgagacttaagggatcaaaggaatttcttggggaccgaggcaatgggtgagtgtttcagacagaggggatagcatttgcaaatgcactgcatttgggaa

SEQ ID NO: 58914 - DNA, 1139 bp, Homo sapiens
aatttttggttttcttgagttcattaactcttggcaatcttttttttttttttagacagctcatgagctccagtatgaagcagcagagcatggaatattattctgtttatagaagcaggcaacaaatggggactcaggggcttggattttattagaatcactgttttgataagctcatttaatatgattttcaaatctacatataaagggtattttaactccagaatgactttttgatataaagctcttatacctttcctgttgtcttggtttcaccatcaggttacaaacctgggaaatatttccataatcctcggtgtttcaaagtgtttattggaatgtttattccctgtggtttgattttcctttacagaagtatcaaggtttctaactgagcacaatgacagggtttaatagatgttggtctgcattggaaactcttgatttttaaagcttataagttagtgttgcttctatgccaatgccctgaagtcatttccatgtgtgtcagtgcatcagtaatagtgttcttgagttgaaaagtagaactttttcctgatttctgtgctgctttggtcctcatgcagggatgggtttaacataaatgcttcaacaattttatgagataatttggcctttgctatttattatgtgaccttgagctcatctgattttgatctgattccagtggaactgaacttgtaaaagaatattacttcctattttacattagcatacaaaattggaaacattcctctgcatagaattttaaataacatcctttatgtaaatatgtgtgttcgtcacttaggtgaaatctaatcctcattacattgcttatctactgactgtttcgacttgtttgtttttagatccagtgacttcccagttttaataaaaaagccagccttgtagtggtaaatacagtaaatactgtaaaatttaaagtcactatataagtaatgaaatgaggataatatattagactcttttttttttgcgaattgagacatctaagtagacacaacaccatttaggcaactgttataccatgattttgcagttgcataaagtaaaattggaagattgaagtattcattttcatttcagtctttttaagagtatagaaactttttaaa

SEQ ID NO: 58915 - DNA, 1082 bp, Homo sapiens
taaaggagccccagcgtttagacagtagaaggtatgtatcgattaatactatgatatctattggtatcattgatgttggtggcttatttgattctttggcatcaggctaaccaccagtatttaagaaccctgttcaagccagctctgacttgtattacgatatttccctggaggatgaacactgtatcatgaagctgtaaacataatttatttagatgtttctaccttctttttctctctcccatgtagtacttattttttctagcttggaatttaaaatttactgttgcaaatgaacgacctgagtctttcagatcacctcccctggctgtgtgagtagctaccaacaggtgctaaagtggggcagctgccgctgtggtcacccaagaagtcatttccagaatcaactacttggagctccagctgtttccctcagctttcctggctgcagtatgcgacaaaagccaactctgttgttgtaggggctactgaaatacttctcatttctccctcttcgccctggacaactatgtagaagctggaccctatgaaacctgtttcatttcttctctgtcctaggatgtggggatgaattcgggatttacaactaaccgtgccatagcctgaggggcagctgatgctctgtatccggagacccatttgagcaacattagggtctagacaaatgtcaggatccagaactagtcagttcttcagaatcatacagacttggctttactaagcattgatcatgccatcgtctcttgcttgcctgtccagccacaaacctgttcatatcaatccagcacatatactgaggacaaacacagcagcacaaccacttttcagaatctttcccacagctttcaggttcaaatggctgagctgatgcctgcttgggtctaaatttaaatctgcataccttcttacaagcagtatatgtattcccttgagacagaaccgccagtgattgtacatacaaggacagtggctggtgggagcccaccaatccaaagacaacacactagcaatggctggcccagctatgcacaccaccgtcacatggcatccatgtcccaggg

SEQ ID NO: 58916 - DNA, 1034 bp, Homo sapiens
aacacctccaaaccagcctgcaacccatactgctgccatgtaagtcttcatggagcaccattcctgggggccttctcaatttttccataatttctgattgctgacataggagtttcttgtgtctttctgaagaatgtctttagttttctctgagcattagtgtggccctctgtaatgtcatcatcctaattcttctccccaggcatgttcctacttaagttccacatccaccacaggtcctctcttctccaaacttgccttatgctctccttaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggtcagatcttttgtttctacttttcataagtgcatctgcttgtctgacaatcaattataatttatagttaggaaaataaggtcacatatcttgaatcacttgaaagccattaccctgttttttattatctcatgttttatacttatctatgtctgtctggtattaaaatttcatgtgtttatgcctcactctcccagcctgttcagaagtctggtgctgggagaggcatgccttgggttcctttgtatccaccttaactcagggcctgccctagtgtctgtcagtttgattttcagcagaatgtggcattctaaatacatcctttatttttcacagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatg

SEQ ID NO: 58917 - DNA, 1132 bp, Homo sapiens
taatttcagtggaacactcagccggcgatctgcgcctgccagcacattccttccacacggcgcatgattcagagcatcactcggatgctttggatttccagttttgagaacaccttaattgtgttatgcccatacctcagacgttactcattgagtccagtgaggatcgcatctgtggggcaaccagggcagcctgcagaatttaccctggcgctcctgagtgtgcctgatgaagcaacagcactgcatattctagtggccccacctgctttcactttggacgccaagaaacgagtgtgtcacttcctctcccaatcagactcggagaagacccacattggccttccctgctactgcgttaggatctgactgatgcagtcattctcaactcccaggggcaacagaatgccctttgccagtgacagcagctggccaacgtgacatccccctggagcacccacctctgtgcagttcagtggtcagaggttacactgcctccctctcctccaggcagggtcagtcttatcccagatggttctgggatccctccccagagtaactgactgaatatgaggaagccctggaagatgaagggctctacagttcctcctgaaaactagccccacaaaaacaagcagcaaaagaacacagaacatttataaaagtcatatacttgtttatcttccagttcctccctcccccaccacccatcccagagaaaagagcacggtcacagtcagaacaggaaatgcatcgtttacaccaataccaaagagagaacagttaagcctcttggaaatgcagcatagaccagcatcggtgcctcttaacctttaaagtgcatgagaaccacccggggatcttgttcaacaagcagactctgattcagtgggtctggggccactggatggctgtgcttccaccaagcccctatggtgattccgtgctatgctgctgttccacagaccctgctctgaatggcaacgggaagaaactcaagaagacaccaggggacctgccttcggcttcttggcccctgagcaaggtatttatcaccttcatctccgtgccttggttgatggcaaaatggaacaataatttctcttatggagctattagggcaattcaatat

SEQ ID NO: 58918 - DNA, 1119 bp, Homo sapiens
aataggaaaagacttgggatatcttacctcaaaccccaaaaggaggaccttccaaaccactgcactcctctccaaaccaatacgattattttatacaaagtcaaagcctcccagcctggaggccccacagagcccttgatgctgggtgtgacagctgagcatccaaacagatctaatttaactctctcctaactactaccctttaatctgaaggtcatttactttccaccaccccatgccctaaaacaaaaaccaaacctgtgttcttctctccaagctaaatatctcaggcccttcccctattttcattatgacctctcgtccactaacacccgtggcctttcctctagacttactcctgttttccaggattcctctgcagaattgcatctggatgccatcaacatgcccccaggagtctgactcggccagctctgacgtccctatctttgctaggatttcataaaagaaataataactttaatcgagaaagccacactctctcggggtcacatagtatgtgctcaaaaaccatggaagaagatcatctggaatcctagatctactctcctgctgagtccctctgacaccagtagggtgggtaaacccaagactcgatttcttaccccaggaatgaataatggaaaaacacctaagtagcagtgggcaccctggtatcagagcaggtctgcttttctccttcctgggatggtttgaggtcggcccaggtaaacacaggagcctgaacgcttctaggtttcaaaggctctgactccccatgaccccattccagccagacacgtggctccaggcttttctcctgacagtgccatttccaaggtattcccaggcccaccgaggtgatgcacccggcagggagtcgaaagcaaagaggatctctccctggacacttctgcactgtagcacccagatgactcacaaagctgccttgtcgtcaggtggaacactggcctagaaaggaatcctgaccgcctaggaatacagcgcagccccgcacacacctattacacaacccgacacatggcaaaagttcagacggatttaacaaggattagacgcacacacatacatatgcacacgcacacacacgcctacaca

SEQ ID NO: 58919 - DNA, 1056 bp, Homo sapiens
tgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtatatgtgcctgtgactgttaagtaacagatggttttaactcatacttttgtgcccacattcaagtgaatgttatttctatcagagttgtcatcacctttgcagccatatacatgtttttaatgatattgcccttgcttaaagtgacagcaacttctcaaagcttgtagcacatttaaaaaggtcttcgatgatggtgacaatttgggcttttaaaaatttctgttttttcaatttttttttttttgtgagacggagtctcactctgtcacccaggatggagtgcaatggcacgatctcagctcactgcaacctccacctcctgggttcaagcaattctcctgcctcagcctcccgagtagctgggacaacaggcgcacgctgccacgcccagccaattttttgtattttagtagagacagggtttcaccatgttgcccaggctggtcttgaactcctgagctcaggcaatctgcctgcctcagcctcccaaagtgctgggattacagacatgagccaccacgctcggcctgttttttcagttttttagagacaaggccttgatctgtcacccaggctgtagtgccccagcacgatcataactcaatgtggcctcgaactcttgggctcaagtgattctcttgcctcagc

SEQ ID NO: 58920 - DNA, 1021 bp, Homo sapiens
gccaggcacggtggctcacacctataatcccagcactttgggaggctgaggtgggaggatcacttgagcctaggagttcaaggccagtctgggcaacatagtgagacctcttctctataaaacattttttaagaattagctgggtgtggtggtgcgtgcctatagtcctagctactcgggaggctgaggcaggagatcacatgcccaggaggtcaaggctgcagtgagacatgatcatgcctctttttaactgtactccatcctggcgggtaacagagcaagaccctgtctcaaaggaaaaaaaacaggagaaagatgttgtgagagatggtgtatggtaggagagcctccatagagctcctttgaccacatgacagtggagttattattcctgtacgctgtcattacagagcggtggatctgaaatgcattacttctggcagtatgtttttttctttggagttgttggaatgcacttgcgtctgattatgctttgtgtccgcaggctcgtttagaagtgcaccggtttggtatcacgggttatggaaaaggaaaggagagaatcctggaacaggaacgtgccattatgctgggcgctaaggtgaggggctgctgctacctttcatcactagacaacatgcaaaaaaagcaagagcaaggaaagctaagagcaagtcagggcaagggacactggaacatttttgcagaataaaatatgatggtttgtttctttgttctttcattacagcctcctaaaaagagttatgtgaattacaaggttttacaggagcaaattaaagaaaaaaaggcagcaaaggaagaagaaaagagactggtaggtgtgatggtctgtcctttattcaactagaatgggaagatggatgctctttgccacagtggaatgccggaagccgctgcttggagagcaatgaaggcaccagagttaaaggatcccatgctccccatttcttcgagttagctctgtttagtaataccagccaagtaatctggcgtacttaca

SEQ ID NO: 58921 - DNA, 1006 bp, Homo sapiens
gactacaggtgcctgccaccacgcctggctagttttttgtatttttagtagagtcagggtttcaccatgttagccaggatggtcttgatctcccgacctcgtgatctgcccgccttggcttccccaaatgctgggactacaggcgtgagccactgcgcctggccccaaatgtttttaatttatctattcacaagaatatcataatggctttgacaaattcattgctattccatttctgtaacatcccccacgtcctgcaaacctttgtctatcaacaaagaagtgaggattgaacgtattagtttctaagcctgctataacaaattaccacaaacatggtgacttaaaccaacagaaatgtattctcttacagttccgtagtccagaagtccaaaatcaaagtgttggcagggccatgctccctctgagggctttgggggagaatcctttgcctctgaccagaaggtagctctaacagtttccttggcttgtggttgcataactataatctctgcctccgtcttaatgtggttttcatccctgtgtccctgagtctcatgtttccctctgccttcctctttgctttaggcccaccctgaatctgggatgatctccttttgagatgtttaattataaagatccctctccaagtaagatcacattcacaggttctgaagaggagtaggacatggccatatgtttttagaggccacaattctacccactacgaagatggtttggcttgcattgttctttatgaatgtataaatgtatgttagtgtccagtgtttgccacatctttatggttttaaaaaccatctgtataatcttttctaaaattcaggtagcatttcatatcaagcttgctggcatctcttcctcaaagatcgttagcgcattctgcaggctgagcgtggtggctcacgccagtaatccgagcactttgggatgccaaggccagaggattgcttgacttcaggaagtcgagactgcagtgggctgtgat

SEQ ID NO: 58922 - DNA, 1132 bp, Homo sapiens
ttcaacaagtgaaatatagaaagaggaattaatagaaaacaaaggcattcaaattgagccagttgtcttaggttcatcttaattcctaactgtgaaagaaaataggaagactattccatgttcctgtaacccagaaagtgttaaaaagaaacagtggctgcagtgcctgatatttttagtataaagccaattgggattaccagccctggggactattgctgtgatgacactttgagtaggaaccaaagtggagactaaagtgattgtgctaataagggtcaaagacatagttacctaggaaaagatgactacattttggattctctgcattttgcaaatacacttatttgaaagaaaacaaatagtttatttctttgtgtgtgcttctaggtgcatatagccctggaatatgtacaaatacattcgtaggatttgatactgatgatagctaagactgaaaatatttattttccttcttgtgtttgaacaaacaggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggtaatgagttggttagcttatatatacgtggtgaaccccctggtattgtagtattaggtgaatagctctttagactgtggcaggaatgcctgactatcctcaggcctgcagatttgccaaaaggactcacaggacccaagactcagcatatagcccttatcagtcatgtaggcctacagactgaccttagttattcaagttctagacctccagtgaaaagcaggtattcaccatcaatcacattgctagtataaactgtctgggaaaacttggtacagcagtggctcaagacctcaggtatgcaaa

SEQ ID NO: 58923 - DNA, 1148 bp, Homo sapiens
aactcccggtctcaagtgatccacctgccttggccttccaaagtacatttatatttttgaaagtctgagaagactataggtttctggtgtgattatctgtataggtaacctgttttgcctaagtagagactgtaggaagagaatcaggttgggtagggaatctgatgcataaaagtggagatcagttagaatgctattgcagtaatccagagaagtaatgaagcagtaacagtgagcccaggaagaagggaaattgatgaatttatgtgatatttaggacagtaaatcatcatcctttggaaccatttgaatgtggtggctaaggaaaatagcatagtctgaagttcactgttgggtttctatgatttggcaactgggcagatgatgatgcctttcattgataagaaatatggggagaggagcaggtttggtcagggtaatagaattcagtttggggtgtgttcagtttgtgatgtaagagagaaatataatgatttttaacttgtggattatcatgttatgagccagatacattccatagtgtttggaagagatccaagtagggttagaaatatggtgccagagcaagagagggggtctggcctaaatgtatagatttttcagcatgtaggttgtatctatagcattcggtgagcctgaaatcattcagtgagaccctagaatgaaaagaagactgaggatgggtaaccactggtgtgccataatccagatgatgacttcctgttaaagtccaagtgaaagatgcagatgccttactacagtgtcccacaagactgtacatgatctcttaactgctattgctctgactttactaatcttcttgttcactgggctttagccaccctggccttctgtttctcagacagtaaaatgctcttccctcgaatgctcatagtcccttctgtgtggcatgctatgttttctcagaagttttattgctggctctttgtattattgaggtcccaactcaaatatcacttcctcagagaggccttccacaaccattgaatctaaaacagctatccaatcactattcctcattttcctcattagttgcctaattttctttttttgttgttgttaatttttggctttttaattaattatttttagagccaggatcttgc

SEQ ID NO: 58924 - DNA, 1266 bp, Homo sapiens
gtgacttgatagatctgatgtagtctgagtcggtaatttcaatgtgatcttgtatattaccttgtaatagcattgagccagctggtggagcactgcagcaatacactgagagaagccactatttgctaggacactagaccatgggcagcaacttattttagagtttggatataaacttattaacaaaccaaatggaaaggtgaagtgttttcttcactctaaaatgctatcctagaaagccatttttcttttaatttctggcctttaaacttctttaaataggctcatttatctactatgactgtgttgggaagttgtcaattaagaagacactatctttgagttatagaagattaatccatttggaactagtcatactggtttgagtaaagctttctgacttttctgttattgttgttagaaattattcctgcttttcctttccttttagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaagtgagtattgattattaaaaaaataaagaaataaaagtctcatcttaaaattaaacaaaaaaaaaaacagtctctttttcaacccctcacaatttaatcaactcaaggacagctcacttggtcaatcaaaagcctagggcctaatcatcaggcctccagtctaggcagaagaggatgtgcatctctgaaggttgttttctgtttttttgtttccttttaactgcagacctacaggcttcagactaacttagtcaagtaagacttatagactaacttaatgccagatattcagtaacgttacaaaagaaatacaaagaattcctgtatatacttcacctagattcccttacagcatttcctttatccttttcctaatactctgctgtgtttttcctataattaagggcattatcttatggtacaagtatcaaaataaggaaattaacattgaacaaatactagtaatactgacctgactcatatttcaccagttgtcccagtcatgtcctgtctagctaaagaaaatcgtagctcatgtgttgcgctagaaatcctagaaagtgttcaactttcttctgtatccacttccatattagactcttttaatctaaaataattccttagtatctgtatttgtg

SEQ ID NO: 58925 - DNA, 1082 bp, Homo sapiens
ccattcaccctggcagtgagtccagcacatagagaaataccattcttctcaccttgtcctatgaatttgtagattttttttaatctctccaagagaagctttgttttctcttactacaaccaaccaattcaatacagtggttaacagttggctttttaagtcagactgacttgggttccattcacagctctgccatttattggatgcatgaccattttacaaacaagaaagctaaggcttagaccttgttaattatgtggtattaaacaaagcacgtaagataactgtatataaaatgatgctaatatagtgcccaactaatatatgttagcgatcatcactgttattattctgatccataaaaatttacatttttaatattcttgcattatgtgaaattgtttaactagaaacagtacttttaccttatcagagcaaatcgtttatgtgtatggcaaaaaggcagaaaaagaggatgggtattccctctaaatatagacttattcttccgttttctgatttgagatgtgatttgataacatgacaactgaaattattcaaaatgtaacatttactttcaagctacaaagagccatccaggagcatcctgttgttctgctgcctagtcatcgaagttacattgacttcctcatgttgtcttttcttctatacaattatgatttgcctgtgccagttatagcagcaggaatgggtatgtattgtttttctgtttttttaactgtaaaaattaaaaagttcactggcatattctagcagtactgaggtatttgaagatgatgatgaaaatagcctctcctcctttcttccagtcctagcactgaataacttgagttatgtcctttgtcctgtgctttactgtgcctgaacagacatctgcaggagttcatgcacacagggttctttggtgtaggcttaaaaaatgagactgcactacttacaggtattagctgccttttgctttttttatttgataatatattaatggctacctctctaggcaataaatagatctaactttttaaagtttatttttaattgtgataaaatacatataacatcaa

SEQ ID NO: 58926 - DNA, 1741 bp, Homo sapiens
cttgtccttttgtgactggcatatttcacttaacagaatgccctcaaggttcatccatgttgcagcatgtgtcagaatttccttcctttttgaagttggaaatgcatctgctcaagaccctgctttccatttttttatatatatacaaaaatggtatatatggaattgctgggtcttgtggtaattttttttcattttttgaggaaccaccatactgccttccttagcagctgcaccattttacattcccaccaaaagtgcacaagagttccagttgttctacatccttgccaacacctgttattttctgatatgttttataataattttaatgagtgtgaagtggtatctccttgtagttttgatttgcatttccctaatgattagtgatgctgagcatcttttttgtgtgcttattggccatttgtatatctttggagaaatgtctgttcaagtccgttattttttaattaggttgtttggggctttttttgttgagttgtaggaattgtttctacatcctggatattcaccccttatcagacagatgatttgcaaatattatcttccatttcatgggttaccttttcactctgttgattgtgttatttgatgcatggaagtttttaattgatgtagtccaattgatctatttgtttctttggttccctggttccctgtgcttttggtatcagatcgaagaaatcattgccaaatccgaggtcatgaagcttttcccttatgttttatcctaagagttttatggtttcaggtcttacattaagatctttggttttttgagttaatttttgtatatggtgtaagttaagggtccaacttcatgtctaacattaattttaatagccatataatattcagcagtgtggatatttcataatttagtagttttgctgttataaacaatgtcataatacatttttatattggtgcttttattcctgtaagatcgattcctaaaagtgggattgctaaggcatataagttgtttatccactcccttttagggtagccaggaaagccaggattcaagtatacacgtttgttaataaatgcagtgaatggtaaggttaaaactgccaagaacttaagcactttaaaagcattttcatctgaacaaacttgtgaggaagttatttgaaaactaggggaaatgaagagaaagactattttaaaactgctggtagcaatcttcctttcttacaagatttgccttatttaatctcttccaacaaaagtaggttgatgttttttcctggtaggcaaaagatgagagcgggtttggcctggctgtccagagcatgaagggcacatattggtctgttgtcaggctcagcagcatggctgactaaagacattgacatcatgacattgtcatgttgctctgctgttgcccctggctctagctggcctacttgtaaagggagtggtgcatggagaagcacaaggtaacctcccagtgagcacctggcccacagaatcccttcttttctataattctattaggtatctcttatgtattttaatgtcaaagtataataatatcataggggtgtcttacatttatgaaatctttcttaataatgtttgagtttaggccaggcacagtggcttatgcctgtaatcccagtactttgggaggccgaggcaggaggactgcttgaggccaggaagtttgtgaccaacctagccaacatagcgagaccctgtctcataaaataaa

SEQ ID NO: 58927 - DNA, 1307 bp, Homo sapiens
ataacctcagcaattggtttaatctgtgtgactctcttgtttaattttcactgtaagctgtgtttgttcaggaagcttgggagggagcttgggaaaaggaatcaaaagaagcatttatcattttgagagtaggcaatgggttttgtgttttgtttgttttctctttaaagaatggttatgctcctgttgaatttttcctcgaagggacaagaagccgctctgccaagacattgactcctaaatttggtaggtcactacagattaaaaggaaaaatacaaacccaaagacatcagctgctacataaaacttgacgctttatttaacaagatattcttttcaagtgtaaatgtataactgttgatatttacgggattagtgtataatgtatgcttttagtattttccgtttatgtgctcatgtttgctctgctcttcaatatgttgatgaagcatttctccctgtgttttgcaggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgtacgtgagcttgattttagcttaattgagagaatgtgctgactgacacatcaactaatttctaaatttactgcttttcgttttcttccccccctgttatggtactattaggggttgctgaaagccagaaagattctctctgaaaattttggaagcatccatgtgtactttggagatcctgtgtcacttcgatctttggcagctgggaggatgagtcggagctcatataacttggttccaaggtgtgacctgtgttttaataactgtcttagaaatgaggattaaaatccaaaggtgtgagttgcaatgctggagttgaccacttctcttgatttacttaagattacagagaaaatgatcagaaatgctgttatcattccgttttcatcagtggaaaccttcaattaaagaagaattatgtgtttgtcccaaaaaaagataagctgtgagatatgtatgtcaaatatgcaaaatcagacaatgatcatgtttctcaagggaactaaagtgggaataaataatgccattattaacaagtatatgtgcaggaattgttgagcactattggtaagctagccaaagtatgtactattatttttgaccctagaaaggattgcataatggtaatgaatgggagtgagtccttagtctctagagagttatagttttataggcaagaaaat

SEQ ID NO: 58928 - DNA, 1022 bp, Homo sapiens
cttgctgttagaaaactttagattcccttggttcctgaagtacacagaagtggtgttcattttcagagtagaaactgatgtgcctttcagaatggctgacaaattttgggggtaagaaagtatgttacatgtccttagagagagagaaagaattgatttatgaaatagtacttttaaatttttcttcagatttggtatcattaccgtaattggtagacagtaaaacctgtcacttgaaaatgagcatctgtcacgttaccattaataacgttaacgtacgctaggcctaagactccctgcagtgacccatcttgtttgaatgaattgtctttgtgtgtagataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaaggtaattttcaggaatgcaatcttgacttttagaagaggtctggccattccattccatttagggagccacatttgaagccttgtaatgttcagcctcacgccggtgaagagcaggcctatcactgagaaaaagttagctttgttccccaaatacttgttcatctgcttcgaattttggaattgggaggacctggaaataatctaaacctttccttctataaatatggaaaatgaggcctagaaagttgcataattactgagagaaggatctggcatttgagtacagttctccacttcctggtctgcggcactgttttggctgtgccagctccctgatccagcaaaggcaggtgggcagatgagcagtcagcagtcgatgagtactcccgagatgcatggtcttgttctaattgtatcaggagtataaaaatgagtacagt

SEQ ID NO: 58929 - DNA, 1044 bp, Homo sapiens
taaattaaggagtggttctgcaaagtaaaagaaaatccatcacccaggttgtgatttgtaaggctcagaaatgttgtgtttgaaaacattttgaatgtagagcagatgcttctctggctactatctcacaaccagaattgttctggaggttggggaaatagctggtattctgttgtctgagggcatgtggctgcatatattcagataggcagtgtatccattaacctagatgagggggtacatgtattcagatgggcactatacccattaacctagatgaacattatggcttcctcttcccttctaggactttgaagaaggctgttacctgctttgtaaaagtgaagccatacaagtgactacgaaagacatcctagttacagagaaaggaaatactgtgttagaatttttagtaggactctttaaaccttttgtggaaagctatcaggtatgtaaatttggcaagttctccttcatgccccccatatcaaatataataagacattctcaccctgtgcttatttccagtctgaagggcaggtatcttccccaggcaaatggaagaaggagagagagtgactaatacgatcagtgatttcacctcaccagtgagaccttgctccccgcattcaggaggaagcttggttcattacagacccaagaggacaacagcttagtgatgccatggtcacagtattcacaggaccacagttacacccacgcatcatctgtcatactgtgtctcatgtcttaatgaggccttcatgtcagtcaatatgtaacctcgaggtttgatatatatcaggcactcagtaaaggcaagacttgagtgatacataaagtcagttacagattaccagatgtttatgttggaaagaaaaagttcaagtgcaagttctgaaagcgtttgtcagagctcttgggagtagttagagagatgggatggtatgttgcccagcaggaattgtggcaggactcaacgggagagaaagagtctgaaacataaactgtaggaaggacttccacatgcttgagagaagagga

SEQ ID NO: 58930 - DNA, 1879 bp, Homo sapiens
taatcactgttctacagtagaaatcatcaagtattttagggcatggtactttcttaggtgtatttagagaaaaaaagcaaagttattaaaatctgacccctctcttcccaagtagcataagagatacgaagctgatggtaattaacttgtaccccttgaagtgagaaattatactttaataaatgtcattattattttaaatctttttctaattgtaaaatgtaaactcaaaggagatgccctaaaaattctttggtttttctgggctcattccttggagggtctttatgctgctctcttgtgatatatccttctcttaagaggggcaatgtaaagttatttactattctgttgaacttggctatcctttttctctttctgttcccctcatccttcctcttaaaatcagataatttgcaagtaccttttgagtgaagaagaggaccacttcagtgaggaacagtacttggctgcagtcagaaaattcacaagtcagcttctcgatcaaggtcagtcactgctctgtgggtgctgatttcttttagttgagaatagaaactggtcaactaactcttcctcacccccaattttaggtacctctcaatgttatgatgtattatcttctgatgtgcagaaaaacgccttagcagcctgtgtgaggctcggagtagtggagaagaagaagatgtaagtactgtacaagatcccatgagtgctcaaggaacaaggaaatgaatgacatttgagctcaaaatccagagagacatagaaatggatgatctaggaaatgctatattctactttccttatccatcctctaattagttaagtcagtgtgagttatcctgaaaattgtatgtggttatgaatagaaatgcaactgaagcaaagaaaggaagaaataactttaggccaatatttttgctttgacttaatgttgaaatttataattacaagaaagattttcgggagtgtagtgggcatatgagtgtagacacacataaatacacacataatacatatatagatacatacctgtatatgtatatataaacatatagatgtatgttcttctaagtggttgaatttaacagtgataaagcttaatagtaaactctggcagtcatgtctcttatgtggtcagaagaatgaagcaagaagccaggaggtgggacaggagcctgaggcctttcgactacttaggcccagccttgaggaaggcaattgaaaagtagtcttacaatagctacgtcaggaacaaaatataaaagttgtcttttccccagagtttatgtaataataaagcttattattttctcctagaaataataactgtatatttaatgtgaatgaacctgccacaaccaaattagaagaaatgcttggtaagtgcagtttaataaaatacaagttttcacattttgttgatgaattaaaataagaaagtatactgtggcaccaaatactttatcaaaatgatcagtaagtagtagagttctaacataaaagggaattacttatgcagtctggaattttctcaaggaagctaacgagaaagcacaaagaaaattaacaaaacacagcaggcataaaagaagcagtcttacacagtagaaagagtcagtccctaacatgactggtctcagccagaggcccagacccttcacatccttgcctcagagagagtacctcatctccactctttgtttgatgctctcactgtctgtcttgcattgcttctttcccaagtgagagattagtgtcagtgtctctatcatgtagactttctgaactcagaattagggctgatagcacatccttgggagaataatccaacccttactcttctctagagcctatcagctatgaagaaatagtc

SEQ ID NO: 58931 - DNA, 1395 bp, Homo sapiens
atacgcatataagattgtaattttaagatgttttgtgtctcagggtgctacattcactcttgccttaggtatactgtaacccaggttctgcctgtcgtgtataagttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatcttttttaaaaaaaatattttccatgttatagggaaaggacaaagagacttttatcagtttgctttttgtcttgtggctgtacatgctgttggcatagccctaacacagttgttcacaagttttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgag

SEQ ID NO: 58932 - DNA, 1069 bp, Homo sapiens
cccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccag

SEQ ID NO: 58933 - DNA, 1032 bp, Homo sapiens
agataaattgtacctaatatagaaaaattatcccaaattcaaacttgatataaaaaagggagagatgaaatgaactcagctagataacagatctggcaaaatataagaatgaaaaaaattctacacagggcacttatttcatatccagatgtaaaaaccattttcaattagtagcttatcttcctcctgtaagcaatcacagatttgaagttgatcatgcagtacaaagtcacagcagtcaaaatcttctgtttgatgcaacacaaaaagttgtttctgtttccttattaaaatgcgaactggttgtctatttttctttatcccatttattcgtattcacaagttaacaaatagttaacaatattgtaggtgaagtggggtattgctggatcaaaggctctagaagacgtctttaccgaccgaatctgaaggtttattgagttcaaccctcacacctttttcacctgcaaggtaaaaaaaaaaaaaattttcattcattcactaagcaccagagagcttctgctactgcattccactgaattcctaagagtatggacaatatttcaactttgcaaacatcatctgagaactatcacgcttgtacttccaaaaacttccctcagcattctattgtgatgaggtttcaaatagtaaaccttcaaggataaaaccatcctctacacagagataatgattttgtctttttattttaaaagccatttgagtttcttcaacagagtgttcagtgtctctgaaagcacactgagcttgtgccacaaataatggctttaaaaatacatagaaaatgcatgaatattccatttttatgtaaggtcgacgtgcgattagcaatggctctggaaaacacagctaatcagtaatgtgaatactcagtggatttttggagatagaaagtagagttaaagaaaagaaggtaagtggtccatcagatgggaaacagaccccctgctcttggagaggcagtccataagtggaagagaaggggaactggcataattaaaggatcttcag

SEQ ID NO: 58934 - DNA, 1028 bp, Homo sapiens
acatgatgtgcccttttcaatcccatgtctcttcccagtggcatcccagtgctgtctctgccccctgctgcttctgtaaagattttctgacacagtaactgcctcatagaccttcctttttatgaaatcctgagtttggtttggttacgtcctttttagatgaataaataacagatacttgggagtttatagtaaataaatgccagatggcatggaggctaagtgctacaggagttgaggaacgaaggtggtgctacattggagagacgggcaagtgcgctttgaagggagaggctcagctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttagaatgacataaggtaagttgttgatccagatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtctgtaaacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatttgtagcgtactttcacttcctatagcgtttatacattttccccattatttgtatcagaaagtatgtcttttgtagtatttaataaactagagatgcctcacttattggtggaatgaaatattctaa

SEQ ID NO: 58935 - DNA, 1022 bp, Homo sapiens
caggagttcgagtccagcctggccaacatggtgaaaacccatctctactaaaaatgcaaaaattagctggacatggtggcgcatgcctgtaatcccagctactcgcgatgctgagacaggagaattgcttgaacctaggaggcggaggttgcagtgagctgagattgtgccactgcactccagcctgggtgacagcgagactccatctcaataaataaataaatatccctaaaataagaactaaatttgtccttgcatcagtgcatatacttttaaaattgcagctcatcttcatactttattgagacgtatttgtgaataatccaattaagacattgaaattgtctctttttttccccctaaatttaatcttgtagcatttttggttactcctgcttacatatttggctcttttcctaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagagtaaacgtgaaagctttctaatgagtattttcctgccaggtacttttcacagtcattttaatttgaataattgtataagatttatgttgcacagtcatctgaattcaaataattatataagactcattaacagttagtactaaatgtgtctttctttgcacagccactctgaagaaagggaagcacaggccttcccatctttctagcactctctccgtgctttgtgcatctcttaactactatccatgctttgatttttgtaagagtattttacttgggagagagaaagatcaagaaggaaaagggttttttaaaaggtggtgagggacaacataggaaaatggatacagagtagaaaaatcagaggtaaccagagagtagaagtgaagagaaaaacagaaga

SEQ ID NO: 58936 - DNA, 1049 bp, Homo sapiens
aaaatcttacatgtcatgggaaagaggctgctgctttgtttatgactttatatagtttctgattataaaaataatacagtgctccaaagtagatgaagcaaaatctgatagaaatgaaaggcacaatcaacaaattacaattatagctggaaatttcaatacttctttctcagtaattcttaaataggaaatcaacaaggatataaaagattctaacactatcaaccaatttgacctgattgacatctgtagaatattccttgcattaacagcataaaatacgttatttgcaagtacatatgagacatttaccaaggtacaacaggtgctaggccataaagcaggtcttaataacttaaggattgaaatcatacagagtatattctctaaccactatgaaattaaattagaaatcagtaataaaatgaaattttgaaaatctcatatgtggaaattaaacagcgaatttctaaataacctatgggtcaaagaagaaatagatgtagagcaatggtacagggtgaagagttcagaaatagacctacactaacaatatcaattgattttttttttttaataaagatactaaggaaattcagtactggctaggtttttgttcttttttttttcttctgtaaatggttttggaatacatggctatctatgtggaaaaaataaaccttgacccttatgtcccaccatttataaaaattaattcaaaatggatcactgacctaaatgtaagacctaggctgtgtgcagtggctcatgcttgtaatcccagaactttgggaggccgaggccggcagatcacttgaggtcaggggttccagaccagcctggccaacatggtgaaaccctgtctctactaaaaatacaaaaattagttggatgtggtggcgtgcacctgtaatcccagctactcgggagggtgaagcaggagaatggcttgaacctgggaggcagaggttgcaatgagctgagatcgcaccactgcacttcagtctcagtgacagagtgagactccatctcaaaaaaaaaaaaaaagt

SEQ ID NO: 58937 - DNA, 1114 bp, Homo sapiens
caggaattcaagaccagcctgggcaacatggcaatacctcatctctattaaaaaaaaaattattaagaaagaaaggggccaggtgcggtggctcacgcctgttaccccagcactttgggaggctgaggcgggtggatcacaaggtcgagggattgagaccatcctggccaaccaacatggtgaaaccctgtctttactaaaaatacaaaaataagctgggtgtagtgttgcatgccttttagtcccagctacttgggaggctgaggtaggagaatcgcttgaacccggcaggcagagattgcagtgagccgggattgtgccactgcactccagcccgggcgacagagcgagactccgtctcaaaaaaaaaaaaaagaaagataatggatttggttctgccattagatctgggttggatcctgggtctgctatggtttctgtatccttagtccagtttcttaatttcttgagtcgtcagttgctccgtttataaaatggtgttcagtgatacctgtgtttttagcttctcaggcttgttgtgaggtgaacatataatgtttcatgtaaagcaccttttagatggtaaagcgctatgcagaactgttcttaactattacttctcccatttaaaaaatttgctatctttctgattcttttaagaattctgtgctttccctgtctcattcccctccgataaactggagaaaaaagggcttagaatgatcacccatttttttacctaaccacttttcctgcatttacacatttttttttaaaagagaagaaataacatttttttaagagaaaaaagtcccagagagattaacttcttcaaggtcatagagctggtgacaaaatcaacagacctttgatttagttcattcatatctgtaactttatacatatttctacttaactaattttggcatattttacgcttttttttttttttttttaaaggacagggcctaacatgcccaggctggagtgcagtggtgcaattatggcttactgcagcctccagctcctgggctcaaacaatcctcccacttgagtctccgtagtagctgggactacaggcatgtgtcaccacacctggataatttcttaaatt

SEQ ID NO: 58938 - DNA, 1073 bp, Homo sapiens
tgccttgtcctcccaaagtactgtggttacagacttgaaccacctcacctggccacaataatcttaattctgtgaagtgagtagtgttattcctaatttacatttgagggattttcagctcagacttggcagaggtctaccacttactataaccctggctggtgttcaaacttaagtcattcagatatcaaacccatgctcttttttaactacgctagttataggtagaacattaaatgagatgtagattatttagcacactgctggaactgcaatttgatacatatattttgttgaaagtgggtgaatagcactagctttatatgtgagtaatcatactctatggttgggctgtgtaaaactttttattaggtgactgtacaatgtttatttcagatagtggcttaaaagccacttttgtatttatccacctgaattatgcgcctgtcagtatactgttaacagatgtcagaatatggtttttttatgtgattgcagagggagacttcaattcagaattttatccttcataacattatagtgattttaaaagttatatgcagcaaatgtgtagtatttttctcatttcaactttcacagcagtaggcaggtggttgtatccctttttttatagattagaaaagtgggactcaggaaaagttagttcacttgttggaaattctgcagcatattaggacttaaattcaggttttctgactaagaatctgatgttcttttttatttacatcatgtatattgcatgctctttatgtcagggcatggtaatcagatgatacatgatagtctgtggcccattcagtgtaggctttgttttcccctgaatttctacttcaaacatgcttatctggccgctgtttatgcaactactttaaaaaaggaaccataagggaaaaatgaagtcatacaggagaaaaacagaaatgtaattgtagccactgatacaaccaagctcctgtttccactttctctggtctttttgggattttctcctttttgccgttaccctgccctttgatcctatgtccttgcttatgcttgttttcatcaagaag

SEQ ID NO: 58939 - DNA, 1021 bp, Homo sapiens
gcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatct

SEQ ID NO: 58940 - DNA, 1048 bp, Homo sapiens
tccttcagtctccgctcgtctcaccgtaggctgtgacgacatgagcaacaaagaaggtggcgtccttaacaacacggggcgttatttatccggagggggaggttctccagtctttctatgcagttttccccttttcacccttgaaggatgccttcgtcccttgtagactcgggggcggcccctctgtttctctccccggccagatcggccctgtttacacctccttttttcttaaatttttgaggtgtgattttatcctagttcagtaattgctgtaatgccagatcatagcaccagttggtggaaacttggatgatttgcttggaaaggcctgggcagcgtctctgtcagtctgcggagaaagcctctaaggcgagggccctgtgggtatctggttttaaagcaaggagtaggtttgtctatgttgtgttttgcaaactcttggtgatggaagatccctctctttttttcttctctatataaggatcaggagggttcaggaaaaggaagcatgacaatttcccacataaccaaagaagagaagggaaggatgttaattcatcttcacccgtgatgttggcctttaaatgtaagttctctgcaatgtaagttgaagaaggggagagaacaaaattatttagccatggttatgcgcaagaaaacagtccctaagaatttaatgtgaaactttagctggaggttttgtgatggcgctagatgtaccctaaaagtctggattacaaaggccttcacttttatgtcccattaagagaaatattagtaatcaggtaaacatgacttaaacacaagaaacagtaaacattaattaatatttgacatgtcacatactcaagaattgtgtacctgataatatttactcatctgttatatgctaaaatatattttcatttagtgtgtatttgtttcctctactagacttgaagacagggacggtatctttgttttaactgtaacacttagcacagagtgggagcttgtatctattagtgaatctcgcatatctatatacacatattttcacagtccc

SEQ ID NO: 58941 - DNA, 1050 bp, Homo sapiens
atctctgcttgttagtgcaggtgtttagaccgtttacatttaatgcagttattgctatggttataattaaatctaccatctattcttctctccttcctgccttattttggataattttttatgatcccattttatcttatttgtaggcttattagctatgccttttttgttttgtttttgtagtgattgttttatggttcataatatatatcttattgtcaactattctcactttgtacaatactgtgtttactaaaatttgtgcatacaagaatcttttcactttgcatgattttttggtaacagttactttgccagtgaaggtcacagttttgatgtgcccaagtttcagttaacacagtaccatgcaaagtaaggactacttatcatttcgcgtatggtataaaaatcttatacttccttttccatttcccctctactagcttggccttttgtgctactgttgtgattcatgttatttctacttttgttgtttccacaatatgttatgatttttactttaaacagtatgatttaaaaataagaaaaatatttatccacatttaccaatttttgtaaatgttcattcctttgtgtatagattcagatttttatctggtatcattttccttttgcctaaagaacttcttttaatattttttgtagtgtcaatctgctgatgataaatcaattctttccggctctgtgaactaaggggattgttctgcctgctcactttgggcaattctttttccagccttaggtagtttcctcacatgcctgcactgatcagtactcaactgaagacttgaggaggttgcttctataaatctctgaagctctctgtttatacagctttctcctcattgttactctgctctgcaaattttagctgtctcgatcccccaaaactcccaactccttttctactcaggctgactcccaggctccacctaagtttcctgtctctgtactgtcacttggaagctttccaggcaataagatggggcagtcagagggtatatgttgttctcctccctttccccaggg

SEQ ID NO: 58942 - DNA, 1050 bp, Homo sapiens; identical to SEQ ID NO: 58941

SEQ ID NO: 58943 - DNA, 1050 bp, Homo sapiens; identical to SEQ ID NO: 58941

SEQ ID NO: 58944 - DNA, 1050 bp, Homo sapiens; identical to SEQ ID NO: 58941

SEQ ID NO: 58945 - DNA, 1058 bp, Homo sapiens
ataaagataaagagtttaaataagggccaaggccatatagataatgataccaaaagcaacctagaaagctgtacattgtcttacagaacagagaaatggagagaaaaaggtgaaagggaaatattcagtagattatttcctaatgcaggaaggaagtgctgtactcttggaaagataggacattaagaaaatgggaatgatagatcttcagattttcctacttcactgtatcattgaggattattataagcacagtggtctcttttaggccttcgtttatgatttgtaagtttcctttgaagataacttactcatggattaaaataatgaaggattttctgtatcttttctgtaaaaagtctttaaaatgagattctttgaattgaagcaataaagatgttttttcttaaagttaaggaataaagcagtcaagtaaagaggtgtctaggaccgaaaattttgctgacagatattttatttgataaaataaggttatttataattggattagcattaacaatatgatgcttatgaatagcttgctgcttgtaattgttaaatgcttgttttggtattactccaaatagttgttcttttgacttgaagataaaacaattctggcaatgaactaaaggagttctgtgcttttcctcattaagaatagtgctaatggcacgcagagcatttccctaagggatacttgtgtgagctcaaacattgagtatcctaataattgaacaacaacaaaacgtcaggtctgttttctacacatttcttatcagagtagattacagattgtcccaagggatggttaaacaaatgaacaaataattagctgcttgaaataagtctttaaaaaaaaatttgtgtcctgtcattttttttttccctcttgttgaaaaattaacagtttgggggaaatgtcctccatttcaaagaagaaatacatgtttttttcttaagtttagtttatatcactgataatgataagaattgtcattttttgagacatttcggtacacaaaactaagtttatatcctaattaatgttttaattc

SEQ ID NO: 58946 - DNA, 1058 bp, Homo sapiens; identical to SEQ ID NO: 58945

SEQ ID NO: 58947 - DNA, 1058 bp, Homo sapiens; identical to SEQ ID NO: 58945

SEQ ID NO: 58948 - DNA, 1058 bp, Homo sapiens; identical to SEQ ID NO: 58945

SEQ ID NO: 58949 - DNA, 1996 bp, Homo sapiens
gtgatccgcccacctcagcctcccaaagtgctgggattacaggcgtgagccaccgtgcccggccagaataagcttttcttaaatcctaattacttaaactcttaaaaaaattttttttctggctgggcacagtggcccagagattacaggcgcccgccaccatgtccagctaatttttgtatttttagtagagttggggttttactgtgttggccaggctggtctccatctcctgacctgaagtgatccacccgccttggccttttaaagtgctgggattacaggcgtgagccaccgcgcctggtccccaggccattctttctattctaagtgtctagtctagtactggcattgtagtaggcatccattaagcttttttttgaactagatgatgatcaatatgaagtttttttattatgacattcttactaattaagtgcttattcttagtaattttctttgtcacgctttcaggactacaggaatatgtggaagctgtctcttttcaacacttcatcaaaacacgatcattaattagtatggatgaaattaataaacaattgatatttacgactgaagacaatgggaaagaaaataaaactgtgagaatttaaaatttatttcacatttgttatataatttatgtaacagtatgacgattctagtagatttactggcttatgctaagattgagatgggaatgttctttctaaagtatggttttgtagagtctcaactaggaaatggtctttttaaatatttcagttagtggatagaacaagaacaactctgggcatattgggaaagtaatgctctttacctaaagcattatggagtgcttactgtaagtcctcttttggttttactctctatttttcacttgccctttgtaagcactgtcttatttaatccttttattaaccatatgtggtaagcattattactctcattttacagagaaagaaacagacttttagagaggttaagtaacttgccagaagccacaactaaaaagtgtggcagagctaagatttgaagttaggtattttgaatccaagcctgtgcccttgtccactctgccagcgcttctcacagtgtgctacagggatcccttgcatcaggtacctacctcaaagggttgttttaaaggatttgacttaaaggttattaattaggcaatatacagcagcacctgacacgtaatatacattatatacagcacctgacacggaagtgctcagtagtttgccattataaagtagtttttatatagtgagagctgttaatcatttactcaattcataatgcttatatctgaaatttatgtagcttttctgaattaagaaaaactttgcagtttgacttttaaacaaatactatttttttccttctgggtttcaagatataacaggcagtaaggtaagctgtattgactatttgatactttctgagataccagtacacttaaaattaaatattttaaaataatttatattatttaaataattgtttaaatattaaattattaaattattaatttaatttactaaatattaaatatttaattattttaaaaattttctttattttttcttttaaaaattatttttaaaaacaccatatattaaggataggtaggcaggagatggaagacactgtagaaataatattttcttgaatatcaactaaaatattaatacaaatgagactaatttggcatgacaggtataacttactttaaggaagccatgtattaactttaagttatatgaagtgtattaaggaggaaatttattttgagaagtaaaatttcttcatattttttattcatatagtgtagactgaattacacaaagaagtaaagtaggtctatttgaccctgcttctcacgtgatattagggaagttaccacactttcctttaaagttctctgtgtatcaaaatgaaaatattggggaaaaggccagaaaattgagagtcaaagtactgttttcag

SEQ ID NO: 58950 - DNA, 1279 bp, Homo sapiens
taagggaattgaggatgcagtgagagaataataaattgtgatggtgagtgctgaatagggaaagacaagaagccagaaaaagactgagcttcttaggaaaacattaatggatcacaaacttggagggctgtatggtttttcatttaagaaagtaattgtcgtgcaataaagttattaagccttgttcaagaatatttttattttgtacatcaagtggagttggaaatagttggtttcataatgatatatttcaaaagtatcttgaagtcatctggttcatttcactacccagggcacacattcctcctgtaacatcccaagtggttattaagcaaaacagatttattttatttagaaaaaattagtatgactgatttgctattgattttgtacttctataataaatgtgatacatgctatattcactctttttcacagtgttctttcttgtgtgtgtgtgtgtgtgtttttgttttgttttgtttttttaccagccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagtt

SEQ ID NO: 58951 - DNA, 1045 bp, Homo sapiens
aatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgcaaaaaaaaaaaaaaaaaaaaaaaattggaaatgaagtaaagcaatatatattaaaacatgcaaattataaagaagcatttaaagcttgactactcttcacattgtcgtatggcaaactattttttttatctgcagtctaaatttcatgacctagaatctctcgttttctgcctgatgctttgttgcatgacattggatgacattgagaaaatgaaattgaaaccctgcttgggctttgaaagaactggcaatcctgcttttaagagtggaaggaaaaaaaatggaaagggaaggaggaaaatgggacatacatggaatactaaagacaagactgaagaaagagaggttgaaagctctctctcttctgattatgtttctgtgggtctctactgttttgtggccttcaccctcatgggcagagaaggctaaggtgtaattctcaggtaaccatttaatctttccatttaaaatggtcatttacaaacatggagtccatttcctttgcataatggcaacgagatggcgcctgtgctccttcgtggaattccttgctctgggtgatggactggacagctaatttgtttttataaagtgtctgggcacttaattaaatcttgcatcctgtctaataaaaaatcaatatcaaatccactaccaacacgttctggatggcagagaggcatgccagaagaaaatcttgagtggcggttccttccagatttagcaagctctgcagtttgt

SEQ ID NO: 58952 - DNA, 1027 bp, Homo sapiens
aattcgaacatcatttctatggctttagtaactgtgactggctctatctggatgtgcaatttctgaggaaatgttaaaatcaaaacttgggcactgattttttttaaaaaaggaattatataaaactcaccaaaattatagtttttttccccaaaatgctcattgtgcttttaaaataattaatattaagtatccctctgtgtgaagaccataattatgaccatcatatcactatgtcaacaatgacctttgagagttaaaagaataaaagataggagagccatcttgttggtgcaaagaagattcttagaagtaccaactgagagatgaaagtgctggcctagaaactagtaaccttgtcatgatgtcattaaggcaaaggttcactacaactggagctaagagacaccggggttatctattttgcatttcatggttcttttttcctctctctcatcattttgggtttccagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcagtgagtacttgttattgtcaccattttcccctcatgtttcttcctacctctcagctcccacatagtgaagagctgggaggagcttagctgtagagacccttggctgcctttcctgggaagggccctttgttggttgggaaggtggggattcttccagagtgagagatggcccatgtgggtcatgcatctctagaaagaagacttttctgccacttgacagagagagaaccttctcaagtgcagctgcatcccaggtctgaagcatctcttgggaaactacccttctaagaaggtgggggtaatttcctcttgttgaggcagcttggtgtcctgtgatcatattaagcctgtaagataaacagatggtcccctctgaccgagcgatgaaaatccatcctcctcc

SEQ ID NO: 58953 - DNA, 1034 bp, Homo sapiens
agccttgaatatttatggaaattaactataaacatttaattattgtggattccaatgtgtgtgtttatttaaagaagggtggaatgaaaaaaatcagcaacttttacagtttgctacatctgcttttttttttttttttgagacagagttttgctcttgtcacccaggctggagtgtaatggtgcgatctctgctcactgcaacctccgtctcccaggttcaagcgattctcctgcctcagcctcccaggtagctgggattataggccagctaatttttatatttttttagtagtgacggggtttcaccatgttggccaggctggtctcaaactcctgacctcaggtgatccacctgcttaggcctcccaaagtgctggaattacaagcgtgagccaccgcgcccggcctacaactgcttttcaagttaaaaggacagccctcagatttacgcagcagtttttcaccatcccttgtgtataaattggtaatctgtattgtactttattaatattgttgatttcgcactgtaactcagctataaaggaaaccgacgtcaaggggagagatttaatcacagaataatcaggactagaattttaaataggacatcattagcatgttaatgaattttcccaccttatgccagctgcctgagtagaaaagatactgcagatgtagctcaaaaatctggctggttccctggcccagtgagctgtcaggaatctgtgtagggtgatccataagctaagtgaagggattctaagtgagaataccaagcagcaagattttgtttttctgagaacgatggctaactgtgcccagcctaaactcatttgtctttcggtgagtaagaggggaatgggaggcagagaaggggcagttgaagggcaatgaggttggagtagaggcacctttccaattatggtttgggattaggaccttttgctttagatagaaaagttgtaagttcgcaatgacaagatcctgccctaattcttggcacagtctcacaatttttgagcttgaaatagc

SEQ ID NO: 58954 - DNA, 1034 bp, Homo sapiens; identical to SEQ ID NO: 58953

SEQ ID NO: 58955 - DNA, 1034 bp, Homo sapiens; identical to SEQ ID NO: 58953

SEQ ID NO: 58956 - DNA, 1034 bp, Homo sapiens; identical to SEQ ID NO: 58953

SEQ ID NO: 58957 - DNA, 1052 bp, Homo sapiens
acttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaagcatgtcttcgactttctagtcgtcgtgctttgtatggattcttctttcaaccttgacgaaagggtataattaatctgtaattaaagtcatgatagtttcttaatacgaggaaatgttgtcattgcggttctctgaacacaagagggcgctgtggcaaagcttaccgtctgctcatcctctgccgcaggagggtacaacttcgtgggacaaacttcaaaagaaagatgccatttctaagacctcatttatcacctcgggatagccagtcttcatgcctttaaaatacagaataaaaataacacataaatcaacacaattacattccttcttgatagcatcaccagtcttcttgaggcctggcgtcaaacctctgcttcagtgttacgttatggggtgcgcatgcctccttaatacccaccttgctggtattctccagatggctgtcttcttagcagtagatggaattaagcaccataatgagggatattttatttaaatctgctttaaaaaaatcttccatgacttattcacatgtctggttagctatcacactgccattccatgtgatcggaaatgagaaagatttaaagaaagtaattgtttagcatgcaacggatgtacctcttttgcttcagatgagaataggcagcatagaagaactggggctgattcgtggaaggtttcccgtagctagaccctggaggctgtaaaaagtggtttggaactgtgtttaaaaaataataataatagagggaatagtgaggtacccaggaggagcagagagcgcctgttccagccatgggagcatccccatcagatacatagatgctcttaattaattaggctgctagtaaaccctcctgagtgtgcaagacaggaggaattcattttcaagctttaaaaaaaa

SEQ ID NO: 58958 - DNA, 1053 bp, Homo sapiens
ttgaaaaacattttgactgtgtgcaaggtctcctccacgctcaaaatattgtaaccaaaagccttccaaattaaggtggatttttaagcaggaattttctcattttcttcctccttcaatttctacaacacactttcaaaggaaaagaagtacacctgtgatatgtacatttttggcatatttcaaagccctcagggcagttctgcctggccctcagtcatagacgaggtagagacactctgattctatttgtggttgtatttacatccatgtctgggaagcccttatggaattctgtttctctggttatttggagtgcatggtgcccaattgtttagttttggtggtgcttgagggcatgctctaaatacatccaggtttgtgcacaaataccacagctccgtaggacccttgtttagttcaactttccaaattttagcgtgaacagacaaaggtaacgagagttttgggagactgtcctgcctccttggagatgttttccacttctagagctgaggggctggaagagggatcatgaggatcatggagctccactcatgtagtttatagataagaaaatccagagcctggccaggtgcggtggcttacatcttaatcccggcactttgggaggctgaggtggatggattgtttgagaccaggagtttgagaccagcctaggcaacatggcaaaaccctgtctctattaaaaatacaaaaattaactgggcgtgatggtgcacacctgtagtcccagctactccagaggcgtgagaattgcttgaacccaggaggtggaggtcgcagtgagctgagactgcacactactacactccagcctgggcaacaaagtaagacactgccaaagaaggagggagggaaggaaggaaggaaggagggagagaggagagagagagagagaacaggaaggaaggaagggagaaaggagagacagagagagaggaaggaaggaagggagaaagagagagagaaagagaggaaggaaggaaggagaaagaaagataaagaaagaaaaagaaagaaaagaggaag

SEQ ID NO: 58959 - DNA, 1053 bp, Homo sapiens; identical to SEQ ID NO: 58958

SEQ ID NO: 58960 - DNA, 1053 bp, Homo sapiens; identical to SEQ ID NO: 58958

SEQ ID NO: 58961 - DNA, 1021 bp, Homo sapiens
catccaggaggcagctggagagcactgggaattttctcaggaacaagtagcttgttgatgaaggagagcaaagctggagaaaatgctaggcagacaatagagagccagaataagtgagatgggaaggaaagcttcccatcatttccttctgatcaatccaatcaccgagccggaggtcatgaagtagaaagatccccaggaaaccgaacagtacaattaccaaatgataagatgtgattcagaaagctaatatcttccctaaaggctaaggccaaatgacttgtttgaaacagccaggaaggaagggtattgctcttcgtgtcttccttttcaagtccatggttatttgccttttctcgctgccttatgagggcgcttgttaaaaattcaggaacaatgccagataccaaggtagacagatctggagtatatgacaaataaagtaatctagcactattattaacagcaggtatgttgctcctaggctattttatggctcattttgaatgcattatctccatccgaaaaaggtaaatgtgattcttatgtctagggcagttccaagagtctacaatgaatggggttcctctgacaaagcaatcaacttttccatggttggcaggtgagtaaattgggttttactaggagttattaaatatgggttttggttgatttactacctgctgggtttccatggaagttgagtatataatacaccaggccaacaacattaatcttttgtccttaattcattgccgttttcaacgtgaagacgggcgcagcagtacggacgttacaggaaagccattgctagctctgctcctttaacatgtgtaaaaacatctgtgggtgacaggcagcaccccagctcctggggtcgtgacagaggctctcaggactccttcctattgagatgcacagtggtctaggtgttccccaggcaggaacctgtggaatctttggcttttccttgacctagcccagcttgacccctctctggacttttgcattcctgtccctc

SEQ ID NO: 58962 - DNA, 1484 bp, Homo sapiens
gcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataagaaatggtgttgtcaggtgactagattttttgtgatctaacatgtcaacagtctgactgtatgtgaatttatttcaggtcatttagaaccttgatttgtattaaatactgttcagctcctttctcatagaatcccagatcgatttcaggaaggagtacctagcagtttttaatagctgctgtgtggcggacactattctctgaacttttcatcc

SEQ ID NO: 58963 - DNA, 1036 bp, Homo sapiens
ctttgatttttatgtagtgtcaagtcttcattaatgtcagtttttaagggcacttttttttatgttagccttatttcctttatacatagttatttttgtacagaaaaaatgggaatttaatcagaaatctattcattgccaagttttttttcatttcatcacagaaaatatctttagaaccaattcgaacttcataatacacttagaagtcccaggctaaatgaaatcaaagttctaataatatttccaatgtttaacataattggaaatgaaccttatctcataaaattcttaatctacttctttaagtaacataataacctgcctgttataaagagtccatttacctaaattgaagaaacctttaaacgccttcttgacaaccatgtgaaaggtcagccagacctaggccactttcctaatatttctccagctgttttctcttttttgtaaaaggtaacttcaatgtcctcttaaaagcttttgtaaaaccaatgaacctctattttcctgcaagtgttatttcatttacagtgtttgaagtgtgcttgtgaactctctgtggtacgtgtgttatgttggtcttacattctacccttcattttgtttccaggtgaaagatgtatgtccttttttttttttttttttttttttttttgttagcttcacttaaaaaaaaatagacttcttagagcagttttaggttcacaccaaaaaatacaggggttttccatatacctcctcaacacattttccccactgtcaacaaacccctgccctcaaagagtggcagtggtacatgtgttataatcgatgaacctatgtggacagatccttatcacccaaaggccctggtttacattagggttcgttcctggtggtgtacattctgtgtgtttctaaaatgtgtaagatgacatgtatccgccattacagtatcattcagagtagttacactgccctaaaaatcctctgtgctctgcgtgttcatccctccctcccctctagctcctggcaaccactaatctttttacta

SEQ ID NO: 58964 - DNA, 1003 bp, Homo sapiens
caatctcttaagccactttgctaaacaatttaaagtactgaaaaggacttaaaggcgatttagcccaatcaccccatttagcaagtaactgaggccccagatggtaaaatgtgagctcttcataaatatttggtgccagagtcagcaactgagtccttgtctctcacttctaatccagcactccctcttgttcatatgaaaaggaaaaaggaaatcaggtattgccatactgaccatgatcagggtaaactgcaggtctttgtgcttctgtcttccctatagtaaaacaattctgcaattaacctaattgtgtttttagaacaacactctaattagacactactgcaaagctgctttaatctgatatgcctgtaatcaagttctgaagaacctgctggtggtgtgtgaggagggaatcccataagaactccatcataatgagtcttttttaaaaaacttacatcaagtcatgtacatgatactgtataagcttgggtgcaaaggcagactgttgtacaaagagtgtaaatagcttttctttttggagggttgaacttcttgacatgtgttttttcttctaagacaaatcaccttcttttcatgatgtaaatttaactttgtaactcacacacattccagttacctttcatcagttggaaagacttgacagaatggaaggaacacacacaataggaatatttttagacttactgctacattcataaatgtaaatagccatttctttgtttgatgatgtgaacattctggcttttactattgtttacctaaaaggattgtggttcagtatgcaaaggaagtagttgaaaattcagatttgatttaacttttcttgagtatttgaccactcatttcttagtaagaattttccttaccctatctgtaattaaacacaacaataattttaatggttcatttaagtctggttatgatccattattgtaactcaattttcaacaattatacagactttggcaagtgatac

SEQ ID NO: 58965 - DNA, 1024 bp, Homo sapiens
gcatagcctacttggaagccagcactcccgtgtgcatgctggcaggtggcacggttgagaaaggacaggctcaactctgtgttcttttcaggtgccagtcccctctactgctcgaacaccagggctcaggccctttggaatgtgacggagccagggagagggaagacaccatggaagcaagcaggcacccgggtaataaggaactcctggaaattgacctcccttgctccccctttccccctctctgccccctcctctcccatcacttcattttattcattcactcattcaacctatgtgcaccaagttgaggtgatcagctgggtctccagatgcaggagggggtgtggtcatggttggttgtggttgtggcacctgcagaaagtgaacactttatggtggtggttctgtatacttttgtgacatatccattggtaagaccagaaagtcccagaaccacaagcctgttcatgtttaccaaaccacttgtctgactcctggttttctttactcttttggtaatactggaaattggaaattcaactcctctctttttatgtgacagaaaccaaatggcatggcccaccttccaaagtcctgggttcctataaagaaagagctctgcagaaagatggaagttgcaaagattcccccaataagctttctcacgtaagtcctttgttcataagcccttcactggcctagccaggactgatctgtctcagcacacagtggtacagcctgattcctggggatgctcaagagcacattacctcacagggctcttagaggtgaggttaaaaaaggaaactatcttcctgatttataaaggacctcaaagaaaggttgcacagcaaattagtggcaaagccaaaattatatcctcagccttttgatcctcaatatccagtgcagtagttactaaatcatgttcccatttgtaatctgttaaccacttatccatttagtggcacaaaacagaagcagaaactgctaatcggtgtgtgtggtcagaggaactctg

SEQ ID NO: 58966 - DNA, 1020 bp, Homo sapiens
caaattgccaatcataaaccactgatatccctgggcatcaccgatacttagtttatttttccatgatttattctgtttcacatggcaatatgtttttcttccttttctttgtcattctcaaagtatatttatttgtgaaacaaaacaggccaggtcaaggggcttggcagatagttcagtgccctgttaatgattctactcaacctttcagaagctcacccagcaaccagtcatcctccagcgaccctggacccggcgggagcggaccctggagaccacaagtgggctacgacgggtactgttcatttttatcttagttatccactgggaggaacctgttttctgtgactcattgaaaagcatttactgtgtgccttctgtacctggggccatgtggggaatataataatgccagacatgcttttaacaagtgacttgtccaggttggaaagctcattatttctgtgtaagtagtgctcacttgtcgatgttctcagcctgttttttcctttttgatgaggaaaggttttcagaacatgaaaattaaggatgtgagggcttagttgcctcctgacttaaattgctgatgaggaaacgccgctcaaaatcagagaagtgggtttagcgtttggcttttttgcttcctgtctgagaagtactgggaggttgccccagcacacctagctgagagctgccctttatagtatccacgcagtccagtccgcagtagccagcagctcaggcagagcctgaggacttctgtgaacaaagacactgagttgaccaatcccaccacctctgggaagagaagagggagcatggcaccagggtgcgctcctgaggagtggtctgctggggccactgtgacttggtgctgctttgggttggagttaggagctagtcacactgattgagaggagagaatggccggtcagtgggaaggactccactctgaggagcagcttatatcactgctcccgcaggtgcactgggaaatttctctccatatgtagtctgagt

SEQ ID NO: 58967 - DNA, 1064 bp, Homo sapiens
ctatgggcatgaattaagtaggccacactactcagccatctgtcttctctttcttttttcctcttaaaaaccataccaaacaaacttgaaggccaaacaagcactggaaatgcaaagatgtctttgggttcacaagattcaaggttcacgttcctttcattcaacatataactccaggatctgtaacttcaatggtagtcagttacagttcctgatgtgcactactcaggcagctggaacctgtgagacaccaaagcctggtgttcacctgaacatccagtgacgcttagagcatcgatttgagtggaagacaaaagtaggttttcttcatgttttattatctactgtcatatctgacccttgatttctgattaggtctttggctatggggatgaatcagtagccctagggatgtggtatcttaataaacagaaaacacttggaagcaatataaatccatgaacaaaacttatagagccttggcattttataagaaaatgatgcaacccaatgtaatttgcatttactcagtttgaccaataatgtaactgttaaactcagtaaatccagagtaacttaaactaaataagagaggtgaattttactttcaggaagggaaacagagttaaaataaaggataagaactaacctttactgatgcacagagaaatcactacctcatgttctataagcaggtgttaagatttctttaggagggtgtattcagtccactctactctattaacgctaccatgaatttggtttcccaagccaaaagttaggatgttgttttttattttttctctttctctgtcccaagctccaagtactatggatttgacaagttagaaatcactttcacccagaattttacaaggatttcctttgttatattttgtaccttctagtattgttgttgagaagaatggaactattccacgcccaggtccttagacccttaggctcccacccaccctgtccccagaaccgtaggcttacttccttaacccaggagtctgaattcctcagtgatgtgttttcatgtggaccattttttattcatt

SEQ ID NO: 58968 - DNA, 1054 bp, Homo sapiens
cacatttctgcaggtcatgaaggctttaagcctagcctgtatcatttaaaactctttcaattcagttttccaattttctaggaatctgaatttgtaaatttttaaatccatatttttgttagttttgatttgttttctgcctgcaactgtctgggtgccctgataaaagtatttggtgttgtgagacaacctctcataaccagataccacccttgcaataccagccctttgctttagaccgcaagtgtaagtatgaagtgtcattttcagtttcaccctcgcgctcagcatgtttagccttctgcattattagatttgttaagaaactgtagaggaggggctaaggggaaatgggtagcacttcactccttttaaaatttaaaatacaaaccctttaaatcaaacatcctttagtactgttaaccatatagcaacacataacaggatgtgcctcaagctaaagctatacatttgacttgcagcatggaaaatgacctccaactttctcagatggactcttcgtgcttgtgagggaggagaaatattatttaaatggacatgtatatgcatgtgtgtgtttctgtgtgtatgtgtgtatatatacatatacatttttacagtagtttttaacataaacactatgaagactacaaaaatggccaaattaaggaattatgagatattttagtctcataaatgttgtgaaaaatgcttcagttcatttttgccatttatcaactcccgttttagaaaatcatttgacatgggagcccagctcctcctgtgggcagcatgagtggcctgtcatttaatagacagtttttcttgtcctcaggtcaaaaggtgtttggttttgactcagaagctgctggaataaatgcagtctttagtaggaaaagtatttattaatctgttgaatccaaagccacctgtgttttgaattcccataaaagtatttatgttcaacctaaagccacctgtgttttgaagtcccatttgccagcctaagggaggtgacagtctagcttgtccctcagcgtgaagggaagtcaga

SEQ ID NO: 58969 - DNA, 1071 bp, Homo sapiens
taagatgggattattatatcgcctacctcctatgatttcaatgaagatgaaataaagtaacacatgtaaagcacttagaaccttctagcataattgccccacacatttaatttagaaaaataaaactttaggggctgggcgctatggctcacacctgtaatcccagcactttgggaggtcgaggtgggcagatcgcttgagcccaggagtttgagagcagcctggacaacatggcaaaaccccatctcttcaaaaaatacaaaaattagccaggtgcagtagtgtgcacctgtagtcccagctactcagaaggggaaggtaggaggatcccttgagcctgggaggtcgaggctgcactgagctgagatcgtgcctctgtacgccagcatgggtggcagagtgagactgcatctcaaataataataataaataaaactttagcatattcattttaatttctttcatatgaaaaaataaattctgattatccaaagatagtaggattgttgggtctactttctggacttactaacctaggtcatactctctcctttctctgtttcctttcttcctcctttaagccagcactctccattagcactttctacagtgatctgtgtctgtaccgttcagagcagtagccacaaaccacatgtggctattacgtacatgaactgtagtgcaacttaggaaacgaatttttccttttaattaatttacatttaattggccacgtgttgctagtggctgccatattggatagatcagctaaaccatgatctccttttaggaaaaaaagccacttacactgtcttcctctatggttaatgtgcaaaatcttgcaaaaatctttctctattagttatcttagcatttgcctccagcctcactttctgtggccttgtttcctgtatttgcccagtgtgtttataaaataaggatttaagaaactaagttttctctgtagagtatcagtcccgtgttaagatgtttcttattgccttgcctgattctgcctagttgaatctgtctgcttttccagagtcccatgaatcacatgtactgctatga

SEQ ID NO: 58970 - DNA, 1060 bp, Homo sapiens
acctgttgtaaggatttgggaaaatggcatggagcaaacagtgtcctgcaaagtgttaacaaccattcataggtatttgactttataatgagtgattttctacaaagttatatcaaatgaaacttttgtggttacaatatattgtaaaatatattcctataaccaccagaatttttcatttaaatattttctaatataaggacttactgcctaatatatttgtacagtaatttgttaatttaataatatttattaaacatctgccacatactagaaacagctccaggcaccgtagataaaatggggaagaaaacaaattcacagaactttctcctggggagagacacacagagagaagcaggaagtccttagaaggcatggaaatgggtgtttgggaagtagaggacaccatgggagtatgttgtggagtcacccagttgcggggagagagatgatcatgaatggttgtcagttcagctcaagcagtggatgctccatttagagggaacagctgggacacaagcctggagagtgggctgtttgaagacttgaaagacgcttggtatgtctggggcagggcgtagaaaacaagggaggagggagagagattaaagaaccacagagtttccacaagctacagtagagcaaaatctcaggggaggagttacaaggagatgggatccgggctgcatcccaggaccaataattgtggccagggaaggaggtattcttaactggccacgtgttaggtgtggagttagcctcacacaaattaaatgattctccaaagcaattcaagccaccattaccagaagaaaggggagtggattttagataggaaaaatcagtagctgtccactaaagctaatgttcttagcacaaacaagttttcaaaattcacaacagaaggaatattctgagatacctttaggaaagaatttcacatgctctgagtttgctatagttttcatcctttgtagtgaacctaatgataagattcagcataaattcatctatttttaatttcgtatattatttatattgtaaaatctttatttga

SEQ ID NO: 58971 - DNA, 1035 bp, Homo sapiens
ttattatttaatagtagctacttatcaaattgtcttatagctttgattttcgtattctactgtaataggaatgtgagttaatgggttgttttatagccatttggttataatttcacttaataccaggcttagtttttggtaaatgcattttaggtgatcagacctcaagtgcgagcagcacctcagctcattgattgtcttcttggccacagagagagggtaaaagtgggatcagtttgttcttccttttattccctgtcctattatccatattagtattagagctgttgggatactggcatgaaaaataagcattttttttactatagttatacttgtattataaatctgctatataattttaaccattttttcccttgaatggggctcgtaatttgtgcattttgtggttttcaatccatttgctacagctgcattcctgataagtggctcaattagaactctaatattggtcttaaagactcactgatgtctcatggaaaacgtcgaaaaacatcttatttaaagacaattatgcttaaatatcaaatgctctccatttcttttctatccctttaaaattattaccaagacagttagcatgagaacagctccttcatgctctaaaattcttcaattttggtcggtggccttccctagcccttcctcacttgggggcaccccactacctgtggggtttctgtctgggtttttaaagtgcttgcagaatgttggtgataattatttatttttactggggagcaaagccatagaattttatgaaatgcaagaataattggaaactatggggagaagaccagtgcccctcacagtaaaaattagcttaaagaacagaaagaaaactgtatgtagacaaaatctagagatctgttttaattagatcattcgaaggcaaactccgtcttctcaccaccctccagatggtcagaatctaggtttaggaaattacctggaagaaaagatattcatgttgctgacaaggtcacaggcctcatatagaagattagtctgtca

SEQ ID NO: 58972 - DNA, 1089 bp, Homo sapiens
agaaaaattctgagttctgtcttatagatagttaagtgtgtaatccctcttcaggcatttgatcagctattctctatttctgcacagaaatgaaaaagaaattcactgtcacagttatcaccatcacactgtatgtattaagagtctctgcccgtgggtgaccaggcttcagaatgattgtagagcaccattctttttccctgctggttattataatctaaggcagcggtggtatagtcaattagcaacataaacaaaacaaaaatgatgaagaaaaataatattgaccagtgagttttatgtcaaaacttgaaatgtaagttggatcagcagatttttcagtttcagaaaaagcttagtttttcctcccttatttgtgcctcagattcctctcctcaatcctccctcccccagttttaggtgaatggtggtaccctgcctcacttatttacaatcattagggaaaaagtgtcccacttaacggaaatttcccacataataggagctcccatcaacatcagataacatgctgatttcagtcattttacatgttaacaattcttgagagttttcttatactacctggcttcttctctaccaactgcttacactctaaagtggtcagctttaattctatataccttttctacaaccttgaggatttggctttcagatctcctctttgggattaattagagaaaaccactgggaagagtgacaggcaggttgaaaaggatgatagtgtaaggctaggaacatctgctgtcgagtcctaagaggaagaaaggtggctggtcaaggaggaaggttctgtgtcagctaaaaggagggtgctgggaggtcgtccaggcaggctggaagtgagggcagtggagtggggacttttctggctgctcctgtcacctctggttgggggaggcctcacttgggttgtgtggaggacagggtgctggtggcacagacccagcatgaaagctccatgtcccttttggtgtgcaaatcctgaccagtaaggggaagctcctcctccttctgtttcccaggttatttcttgcagaatcccctttttcagtgttattcaagcctctg

SEQ ID NO: 58973 - DNA, 1077 bp, Homo sapiens
tattttcttttatttgaaaaatcaactgttagacacttactatttctatctttcatttagtgtacttactcattatcaatttatttactttaaattctgggatacaagcacagaacgtgccggtttattacataggtatacatgtgccatggtggtttgctacacctatcaacccgtcatctaggttttaagccccgcatgcattagctatttgtcctgatgctctccctcctctcatcccccaccctgagacaggcctcagtgtgtgtcattcccctccctatgtccatgtgttctcgttgttcaggtcccacttatgagagagaacatgtgtacacttattatttattacttctcccatctatattaatatgtattaatttattaatacttctgggagaagagtaatacttctgccatcctgtccccacaataaaaacccagagtaagaatctcttttcagataaatatattgaaaaaaggaaaagtaaacgctaaattaaaattggggtttgaggagtgttaacatgtagcttttaactttgtactttcttatgatctcatctgatggtttcttgtagctgcctattgtggcctgattttcattctgtccaggagtgctctctagaagggtggcactcctggcctcttggtggcccatcccttgcaggcaggcttcatgcttgatagtgaccccctccctcctggtttttgttttctgcctctgtggcctgagcagtcgacctgatggggtctaaaaaacctttcttggccaggagcagtggctgatgcctgtaagaagttgcagcgagccaagatcgcaccattgcactccagcctgggcaacaagagcaaaactccatcatacacacacacacacacacacacacacacacacacacacacacacacgaaaaaaaaaaaaacctttgtcgttcagtctggccaacatgatgaaacacacacacacacacacacacacacacacacacacacacgaaaaaaaaaaaaaacaaccttcgtcgttcagtctggccaacatgatgaaaccttccttggccaggagcagtggctgat

SEQ ID NO: 58974 - DNA, 1590 bp, Homo sapiens
ctctttggaatgggcatcttatgatctacaatcaaacatggtagttcagataatttctttatggccagtttttatacagagagcggggaagagttaatacgtttaggttttatagctagctttgggcaaaagggattctagtttctatgacctgtctttgggaagagggattctagtttctatggcttgcttcgaaggagaatgagagaccagagacaggagggcagagagagctccttctgaggcctttgttacatcattttctgagccccagcatctttcagtgtcagaaacagagatagtactattagcagagttatcagtttgagacataattacctttcatggacacctgtagttgtttgagtgaatttagacttccttagtttattacagttgcttttagtagctgtccttaaaatagagaatattcttgaatttaacacatacagtttattctctcctctctttattgatttaatgagtactatttcaggtttataatagaattccccagtcttgaaatgtttatggcattgaaacatcattaagttagagctttattcagcctacacagagaatggaggacactatggttttcactgtgctccatttgaccatggatggtcttcaggctgtatcactattcaactcttaagataactaatataagctacaactttaatgagtgatattttctcatttttagtgttttgcttgtctacaagcagatggtaaaagcaaactagtaaatgatggaaaaacctgtatcagctatatatgctaaattttatgtcctgtttttttcctggatagtcgtgcttgtgatgatgcctattacttcctaacttatatcttttctgctaataaaattgtccctgcttcccatactaaaatgatatcattatttgtaatgttttacaaattgggtggaagaggtgtgtgttcaccaagcagcatcatgacttttcactgctccaccctttacccaggcaagttggaagaacaactatttgagtgtgagaacaagagcaccaggacaagaagctggaaaaataaataggagatattgctagtggcctggttgccttgactagaaatttgcgctttgtgttcattgtggagtagttaaagctttttagcttgaatttagcagggatgtattggtttccaacgagtcttccttatatatcttgtttgtgggaattactgaaagagccacagaattttcaacaccacatggaggctatcccaataatcacaataacttaattatttattcttaaaagctcagagaagaattaatgtaaaaaattatgggaacccttatacactgttggggggaatgcagattagttcacccagtgtggaaagcagtttggagatttctcaaagaccttagaactaccattcgacccagcaattccattactgggtatataaccaaaggaaaatagatcatataccaaaaagacacatgcactcttatgtgtatcactgtgctgttcacaacagcaaagacatgggatcaacctaggtgcccatcagtggtggattaaataaagaaaatgtggtatatatacactatgg

SEQ ID NO: 58975 - DNA, 1919 bp, Homo sapiens
tttgggaggaagccaggtgctcttcaattgccctttgcagtaggactccctggtaataactgtggcgatgatgaacttgtctagataaaatgacatctgataaaatattaataaatacattgtagtggacacctgcttctgaggatgtggatgtgtgaaacctagacattcaatttatgaatgtctttttaattgactcctctggacacagagagaggacccacatgatcactgagaaaatatcagagtacaggtggcagaactgtggcagaatcccctgtgcaaactgtatcgctgtgcggagacagagctaacaaacagggtctcaaggagaaaccgagtcttgtgctttgctttcatgagggatttttctgagttagctgatgaagccaagctaagtaaatattatcttctttttgtgttggccttttgttttgaaatattccaactctatttccttcatagttttctctttattgctgttattatttttacagattagaggtaccaccttttccagtcttgctcatcatggtttttcctacttcaagctgtgaactatttaattcagttcagcaagcatttttggagtgtttgcaagtcagtagctgtgttattaccaaacctgccatcttgactttctgctgttgctataagccctttgatttgcatgttcagtatcagcactcttagcagcttcttctctgtgtttgcctcccttggtaggtttttagattaagggaaccttgttatggagaatgaggcttccaggattggccttcttcctcctttgttctctttgtatggtttcattgttctactttacccttttacatgtgcacagagcttccagtatcaagctgttccttggagtaggaagtagttttggagatgagaaacacagagagaggaggagagagaatattagagaagaaaattattctctttggatcagtttccattaggcattaaccattggcctgtccctttccccactgccccttagacactgtaggtcttcatctgtgcttatataatgaggtctgaattgttctgtggtgatcctatgaccatttccatatatgagattgtaaatatcttcttttactgtggggagaaaggcacttagctagaaaataagagtaagcctccagaagagtatattctgctatgtttatagaactgtcatctttggttctaatacattgctgctgagaaaattgatagaagttgtgtttacttgaatacagcaaattacccaaatggataggtaaagattattcacttttattacatttcaaatggtttcattgtatttccccaaattgtacatttattacagaagttagctttgtgtttctacttttaggtgtataaaaatcaagatctctaccccaattgaggagatatataatggtttaaatctgaacactgtgaagtaatgggggcttaaatgaaatatccccttactacttagtgaatgtttgatgtaaatcagccacaatacttcctctctcccccatatatggatggcaacatagttatataaccttctaatgatggatttatttattctcttccagaagtgctcaagcctattgcagacaaatttctacaaatttatttttcctttttaatttttcttctgtctggttgacctaactcttcacaggtttccatctagcgttttgtataagtagtcatttaagtatgatttaagaagttcatctgagaatggatactttccctttgtaggggccaagggaaaacttccctgtcaccctctgaaaggttcactgaaaatcattgacaagaggtagattaatgagaggaaaggcatacaaatttgtttgatcacatttttatatcacatgagagccttcagaatgaagacccaaagatacaggataaactgtcca

SEQ ID NO: 58976 - DNA, 1043 bp, Homo sapiens
tgttttaatttttatttatttatttttgtgtgtgcgtgtgtgttactgagaatttgtatcttttcatttaatttcaacaacttgttggaaaatgctggccactctgacttctaagatacttagtgacattttatagatagtttggattgtttctatgtaatcatttgaacaaaaccataacaaatcgttttatgaaaagcaccctggagatggtaaattctgaaaccaaactaaaattggtttcagaattcttattctgcgagctacatttaaaaaaatgtaatgtctccagattaggccttaaaatgaagcgcccccattaatatcctgcttatgttcaggaacatctagaaaaaggtgtcagtgcagaagctgaaagcacacagcccgtgcgtgctgagcgggttcctcaccccagcctttctcccaggctgcagaaaggactcaggaaatgtggcccatcattattacttatgcttgttaaacaggaattgaccagatacctcattttaacattttaaagatatctctatgagagagttgaatatttgacttaggacttttagaaaaatatatattattgtttttcttaaatgtgatgttttgtgtttgttgtaaatacgtgatacaatatgtaataatttatgcagcccttgaacacgctgtcttcagagtcgttttgcagctgctgtctgagtttcctaagtcatttggatttacttgggtgtgttcagcccagataaaaatgtggatctacctgaatgtgtccagcacctgcaccactattaaaaccgagaatttcctgaggtcaggaattacagggaactgattctcttcattacttgggactaatttccccttcttccatttttccagtcgtacagcagaagactatgaaatagaggatttaaggagagaagaaaagggcattttcacctttttttttttttcctgtgaacattcggagaggataaactgaagcttgaaatattagtgctcattttaattttatattaaattagttttattacaagttttctaag

SEQ ID NO: 58977 - DNA, 1022 bp, Homo sapiens
cgaattacatttaaatgcagtggctaaaaaatcgcaggatttggaagttttttttttttttttttttgaggggtagagggtttgtcacatacgtaacaggtttgtttcactggagttgagctgcagctgaggcctgtttgtcttgttcatcttagtctgctcaccagtctctacttgcttggtctgaatatttatattcccccaaaattcatgtgttgaaaatcctcacttccaaggtgatagtattgacaggtggggcctttggaaggtgattaggtcatgaggcctgagctctgttgaattggataaatgcccctataagatgcccaagagaggaagagacccatgtaagatggtgacgttctgtgaatcagagaagtgggctctcaccagaccctgaatgtgctagtgccctgatcttggacttccagcctccagaactgtgagaaataaatttcttggtttataagctacccagcttgtgctatttttgttatagcagcttgaacaggctaagacactgcataatttatttgtatatttctgatgctttatggatgaatcaaaagacaacaggtgtctttgagttagctacaagctgtcatttttggttttcttttagagagagggtttcattctgtcactcagctggagtacattgatgccatcaccgcttacttgcagcctctcaaactcctcagcttaatcagcaatccttccactttgtcttcccaagtagcagggactacaggtgcgcaccagcacacccggctgattttttttttttttttttaacagacagggtttcactatgttgcccaggctagtctcaaactcctgggctcaagcaatcctcctgtcttggcctcccaaagtgtcaggattacaggcatgagccacagagcctggcctacaggctgtctttaaaaggaacattgactaagcagagcaagcttctctttgggagccagataatgaaaattaagagatcatggccaggctgaggatgaggacacaattat

SEQ ID NO: 58978 - DNA, 1052 bp, Homo sapiens
tgagattgcgccactgcactccaacctgggtgacagagtaagactcgttttttttttttttttttttttgagatggagtttcgctcttgttgcccaggctggagtgcgatctcggctcaccgcaacctccgcctccccagttcgagtgattttcctgcctcagcctcccgagtagctgggattacaggcatgcgctaccccgcccagctaattttgtatttttagtagaaacagggtttctccgtgttggtcaggctggtttcaaactcctgacctaaggtgatccgcctgcctctgcctcccaaagtgctgggattacaggcatgagatactgtgcccggcgtttttttttttttaaaaaagaggtgaaatatgggaaataagtgcagatgggaacatcaccatgtaaccctacctgtgtgcctgaagactttgaacaaagcagcccttctcttccatggcactggcggaaagattaataaatacgaggagaagtggggacagttttcgttaatgctgagtgctccaagcatggcgttccttgtcttcttggttaagctctgtgcaacttttcataacatagaaagttaattttatggggatttgggatgggcaatttaccccacgaaataatcacaagtggtctaaaagatttatgtataaggatacccaatgtaatatttgttattacattaaaaattggaaaaaatttgatagtaagatattcaattatgatactgcatatgatcaagtaatttaaatcaattaaatatcttgttttataaggctatttaatgacatgggaaaatgttcacataatattaaatgaaaacattttcttggtaagcagtatattaaatatgcatatgcattaatggaacagggatacattaaaaaatttacaatggttattacttgtggttgtgttatgtgtaattatcattttctttttgcatttgttttccagcttttctaaaatgaacatattaattttataataggaaaaaacatgctgttaaaatatttgaatgactgaattatatgtaatcttt

SEQ ID NO: 58979 - DNA, 1013 bp, Homo sapiens
ttcttgaatgaagacatgcaaaagaatgaaaacttagtgataaggatgcatttgtcactttccactatcaaattagaaaaagaggcagaaaactcttggttaaaataaatgacatttcaaatttttgtaagatggaaaggctaaatggtttttaacaggagcatcatggcattttgataattcgaaagttgcattcctttccttttgaatgctgctgtctgctcgaggtgtattatagatgggctatgcatatattgctaatttttgccaataacttaatcatggaaggattccgggaacctcccgagcaataagaacacagctgagcatttcttgagcctttcatttgatttgggggcagtagctgcggctaagcagctgcagatggtatgttttcaattcatgctgtggcagtttgggaattctttttacatctttttgtttatagtgaacaaaagagcagtgtggaacttaatcagttagatcaaatgtatataaattctgaggatggtgtttctactctatctgaactgaagtacgaaacttgtgtgtgaggaaaactggcctgctgatttatggtgcctgatgaaatcctacattaacatgcctctaagatgtgtgtgctttgactttccattaatgggtaaacatttacacaggccttggctgatggaataatgagttattccatcagccaaaaccctttatctttctcttcttacgctgttacacgaagtatctggcaatccctgtgtggagtgtgagcctatgcttttcatgacagtaagttagtgtagtctgttggttggggattttggaggaaaaagggaagccttctacaggagggtgaaggtttctcagagttcatgtctttgtgggaagagtgggaggagatgccaaagaaattgcaaatatactaataatcctcagataagtggtttctgcacaatgccctcctgctaagtgttctgttattgttggactcggaataaagacttgctggactctgcttc

SEQ ID NO: 58980 - DNA, 2043 bp, Homo sapiens
tctgtttatctttgcaaaactgaggaattatttctaattaattcaaattatttccaattatttcaaatgcaacaattattaaaactaaaaaaatttcctgagttcagttttatgataatatgtgaaggagactaatcaattagccctgaaaaaatacagattttcaatcacttatgctgaagagaactggctggcaaaatgaaaacctagttgacctaaaaataaaattctagacttagttaaccacccgcttttctatttcttctactactgaagttctgagttgctaaacctctccaaacataaatgaaagtactaaaacgttttcatcagctgtaccgggttaatggtggttttgcatgtggaatgtgccatcaaggtgggaagacttttccttagggctgtattggttaaggtagctctgcctgctctaagagacactacaaaatgctctggcagtggaaaagctgatttctttctagggtgacagcccaaagtccggacaggtaggctgctctcctccacctgacacgtgtggattcaggttccttccatctgtgtctgccaccatagggcccagcctcactgcattgccctgagtggtctgcgctgaggcttgttgaggtggaaggggcacccaggtgtgcatcacctaaagggctggcccagaagggtctcctccatcccttccactctcattcttctggagctcttactatgacctgacctaatttcaggggatgctagggaatgtcgtgtagctggttatccctgggcttctgttctagtcttgtggaattagcattgccaattgtttggttctgctttgcccagcgggttttatgatgctttgtgtgatgctggatgttagaactcttgtgttgggggcttccctagttagtattcctctctactgtaggataaaagtccttgtgatcttgagctctttttgctatactgtactcccaagatgcagaacacattttggatagatcagacatgggctaagactgaggggccatctccatggctatggggcctgtatgtcagtcagcggcttcctctctaaaagtccccatttctgaacctgtaagtgcaaaaaattcagtctgtgtcatagtattatggagaggatttatcgagaaaagctgcctatcgtatagctggtgctcagatgtattcattcgtcagctatttattacatgttctttttttaccagacacagttctagggactcaggttatggtggtgagtaaggcagacagggtgttgcccttgtggtgctcttattctggaaatacagtagattttctaataatatttctcaagatagagtcctccctgccccccctcattggaagtagtttagttctgggtggaggaagggagggtaaagtctaataattagattgttgacagattctataacttcgaaagaaatgttactggagacatggatcaggggatgtaataaaagacctagtccctgtttaaaattcagactcataatagaaggcttaagagacacttgatgaatggaataatggtaatcacttattcaggagccagagggtttcttgggagcaaaaacctttcgaatgactgcagggccctctggctttcctgtgattcagaggaagttccactggagtccaggggccatctcatactctgaggagctgggatggggtcggggcaaatagtaaggaagcagttgtgtgtgtgattttctccttctctaatgagctcacgttgtgctgctttagcctgaaaggaccttcagcagactgctggctagcaccttgaaaaactcttgaagtgacgattctgatcgattttagtggccactttggagaccgtgtggagtagattccgagcctgtgtccaagctcaagggcagcaagtgctgtggtcagtgcaccatggtgtcaggggcaggagatggagtgtggccaccattcttgggctcttgagttttgtgtctctagagttatcttgtggtttccaaggatgtgtagcagtaattctgatgataccagaca

SEQ ID NO: 58981 - DNA, 1001 bp, Homo sapiens
attagagggatgtcattctaactcctatttgtttacatttgtgtataaggtatgctgtgataagtgctgtaagcaaggcatacatgatagtagaagcatccaatttatcaaccaattttatttgaggatcgttgtaactcatttgtttggaataataggtcatttttcccatttaaaatgttttaatttgggcatagtggctcatgcctgtaatcccagtgctttgggaggctgaggcaaggattgcttgagcccaggagtttgagactagcctggactgcaaagcaaggccccatctctacagaaaattttaaaatgagccgagtgtggtggtgcacacctgtcgacctagccactggggaggctgaggagggccgatcccttgagcccaggcgttcgaggttacggtgggctgatcgtgccagtggaccccaacctgtgtgacagagtgagaccctgtcacaaaaaaaaaaaaatgttttaaatgacaagaataagtgaaggagactaatgttgatttatgaagagaataaagaattggggagagatattcttaaaggcgagtgtaaaatgttaccgtgcttgaactttcatttgtgttctctcatgtatacttaacgagaaccttataaggctggtgggatttttttcccttttacagatacaaaaactaaggtttaatgaaagtgtggttttctgaatctgagtccttatgttttaaacccatttctcttggttccagctatagtgttctttattctacagctcacttgtaaggtatggtaggtttcaataaatcatgatgaaaggaaagaatgaaaagacagaaaggaagaagggagagagggagggaactaaagaaggtgtgtgcatataagaatggcggaattaccgactcactatcactgaaagggggaagtggaggctgagggttgggctaatgagctcattgttctggtctaaaaactgccctgttctctcagccagtgaattgtctgtta

SEQ ID NO: 58982 - DNA, 1043 bp, Homo sapiens
ggctcttggtgtaacgtgacccgtgaacatgacctgtgtagagtacagcaggagtgtcttgtcataggttgcatgttgcttgcactgatgtagtccaagtttgcatttacttttctggtggccagactcaacgagtttccttttcgctaaaacctgccgagccgttaatcacatgctgccattgaacctcgtctttccatcttgcgctgatgtcattgcaaaacctaacatttattgcgctgtggttttgctttattttagctgattctttccatcatgctttttagaatttgattatattatttggcacctttacctgtcctcccaaagaaatgctgtctgtacattattagatcagactcttttatatctttacttaagccggtgatgaaattgttaaactggctgaacaacacgaagtgtgtctctggaagcttccctcgaggcttacaaggagtcacactctcggttatagttaactactaatgctcttcatatcttataactagcccatatagctccacctttccacatggatatcctgaaagagtgtgtcaaacctcctttgctggttctactgaccaagttatgctgagtaataatgagttcattttcagtgtgtccctagtaacgagcactctcttctgcatatgattaagaaaatgtgttaaatgactgactggattgagacactagggtcacactgtgatctgtgacctccggaggccttaggaactgcagtgcttctaggaaaaatcagaatattgttggactttcttcagcttattttttggtttggtattctcttgtgttgaattgctttcagatagtggggaagaacaccacagtctcttccggttttgttttaattggttgatatacttctcttcctattttactaataaacatttagccaaaaggggtgtcttgaactctgcccattagattactccatatttttcacttctacatatttgcttaatcttctgagaaatatccccatttagttgagttcctcaagaaatcagaacagtccgaagtaa

SEQ ID NO: 58983 - DNA, 1049 bp, Homo sapiens
cactagatggctttcttatgacagacatttagtaaactgcccatttgagtcgcgtttgtgtgcagcctaggttgtaatttttctagtgttacaattagtaattgaagaaaaaagatctcccaaactgttgctttttattgctttcctagaaaacctacacataccgatatttttgcggatattgagaggtggcctattatttttggcattcccaaagttgaatttcaagagacaacttggttactgtatttagttacatcatttaagaatgcttgtttcatgtttggacttatttaaagaattcagagttctgttagttttgtcattctgtttagacaatatttccagttaaaagatgtttaccgcttgattgaatttcactgcttgattcagagttataagagagtattattcatgagaaaaatgcagtctttcttaagttttgggtataaatcacattgattcttcctaaaagattccattgatccattttgggaagagatgcagttaaagtatctgcatgattcataccagggattgtgttagggacatctccccagaggatgtttgattttttcatttctaagcacaagcccttttatgacaagcacaatagcccgtagtttcagcagtaacagcagcagcagcagcagcaggctcccagttatgtttttaagcacttttattctaaagcaagatcacggcagcctgtccaaatcttgcctaggtaggcaaacttatttatacgctgagtaaatatcttgaaattatctttgtagctatcatttattgtgtgccttgcccagcttaaaataagacatactgaatttgttctaaattagagtgtattcataaatagctgaaggaaaaagaagaaaaactacagagcaaacatctgggaagtaggaaatgaaatcagaaacagcttttatcagtacccacattctacctatagatggggtgaaatgaacctggataagaagcagtgtaagcacttgatccggaaaagcaagagctagatcacaggtatgggggtggagcttctggct

SEQ ID NO: 58984 - DNA, 1055 bp, Homo sapiens
ccaaatttatataaaattttacctatatatttcttcttctgcatgctttttttaaacatttatgttttcaattcatttggattatgttgagtgtaatatgctatgagattctcagctgattttcttccagatatttagccagtttactaaaactgtttgttaaataacccatttctaattagttttttatgcttaattaattatattaaaactatgtgtgcttgtatgtatagtgtttcagagttatctgttctcttccattgatctgtttgatccttgcatcagtaccatagtattttaattaccatggtaatcgtttttatttttcttcttcaaaaaatggccttgttcagaaactgtagtaatggtggcacttgtaatagtaaactattattgagtgcgaactacgtgccaggcatgaactcacttaatcctcagaacactatcactctattcctattttacagatgaggaaactgaggcatagaatggaaagttacttgcccagggacacactaattgtgtaagtggtagagctggagtgaactatagaatcaagactttactatccattaaaaaaaatgtcttatatggagtgattgggactatagttattttgacataaagggtgtcttaatttttcagataatcttaattctccacagcccaaaacatgtttctctttctccatctgtttctttaaaatttttattggtgaggttattcatagggctctcctattttctggtgctactggaattaggattgttttttctgttttctaatgatcaaggctgataagataatgctggcctttttcataatggcctttttgatagctaccctcaatgctttattaaaatttgatgcaatgtaagatgtaacattttattgattttcaacatatctcctactcacacaaaatggagacaatagattataatgttttaaagaacaaaggacatctactcaaagccctgttttccaggtgaacagtgtcattttttacaaagatctgtgaaaggaagagtaagctaaaatcagaacacccaggg

SEQ ID NO: 58985 - DNA, 1027 bp, Homo sapiens
gacccccaccaaacttctcactccggccagcagtatttcctcaccaaaaaataagacaacttttaccatagactgtgtgtactgacaaaggggaatttgaagcattatcaatatagaaaattacttttaaattatttaagttgttcagatgaaactgagagagaaggtgcttgacttagagagactggccatggggtggaaaggccaagtttgaagggaagaagccagctctgctctctgcattttgtattaacataaaagaggggtgcttctcagtaagtccgcttctctggagagtcctgttatacgactcttgttctgtagtgctcaggacagcattagccagcaatgcacagtgactttgtcaggcaagtgctaggaagaccatgcatgcagacgcatgcctaatgtgtaccaggattgcatgttcccactgagattggggagtgagctataagccctgtttcctctttgagctacagagctgatgttcatttgattggacagttaaggcagaaatccaattactgagctaattagcacctttgaggggtaagcaccaaatttacaggaggaaagcactggagaaaactcaaattacccagtgtggctgacagtccaccctcttagagaatgtgtggagagccagaggtcctgggggtacacaggcagcttaacttagttattgctcatcagaatttagactgtgttctataggcttctgaaaagatagctttccagtgaacatagttttagaaggtgttttagttccctaaggagtttagtaaatgattttcttttgtcttaatcctcctttaaaagttgtttattctgctgcttgaaaattccatttgtggtaggtcttaaggtgaaattaaaattccatttagggactaactatgcagacgtgggacttcagccttcattaaaaagaattttgttggttgctggattttctgctaccctgagatctttcatttttcaaagctgctatgagagtatttgtaaggaaaactaaagctgtaat

SEQ ID NO: 58986 - DNA, 1480 bp, Homo sapiens
cgccccctggccgccccggccacctcgcccacaacccacacaccccggccccggcgccccgggcccctctaaccctcccaccccaccccccacctttcgccatcccggctcctccagcccgcctcccctcactgtcctcccgaccctccgaccttccccttactggcgtccccggcctctgcctgggtgactcgggagggcaagccctgcggagccggaagccagagaggtgactccagacgtgacttggttgttgccgtccgtaactctggggaagtggtccctaacttcggcctgggtggctgcaggtgcttcctccccttgagttcttttttcgcaacccactaagccaaactgtcgggtttgaatgtgtagcagcacctggccgccgtgcggcaaggcagcgggatgatggaaactcaccaccttcctcccgcacccatcccagaggccgaggctgcagtctggtaataataccttctaaagggtcaccttccggagtgtgccgtccctttggaccatgcacagatattccagctcttttgtaccttggaggcagttttgggggtagccgagtgacatcactctgctcttcccaggtgacctctgggcggacaggccgatccggtttcttttcagagtaggaggaagggtgagggagagtaaaggaaccataggattgcctaagatctgacttaattggggcaccctgattcagcagttccttcaacttgaggtgtgcgaggctccccataaacttcgaagcgccacgtccccgtacgactcacccgcggggcgcccggccatggaggagcctcctcaggtgaaagatgaggccgggcgcatgccccagggctcggtcactgtgccagatcagatgaatgaaggccgaatttccccagccggacctagtaaggcacatacccagagtggagatatcaattggtatttggacagtgggaggaatctgaaagagcgttcagcacagtcccttcttttgatctatgagatccaatctttgaaataatccatctcgtcatgcacaaggtcacacacttcctagttaccagtgtcgtcctggaacctgggccttgtgatttctctgccaggaccactttgtaaccccccaccctcaacctttacaggtgaatcacatccctttgtgtgactcccaactcttccttcctccccacccccctccaccacccaaattattgtgtataattccctttgggctatatcttgttgactatcttggtaattacttggtaatgagtaataatacactattcatgtagatcacatgaaacaattattcagaggtctggggtgaattactaaactgatgtaaatctaccctgaaataaacagaagtggaattctagcttgtattgtgagatctaaaaaactgttaaatgtagcgctagacaagacagacctgttatctcactttccaaagaatgcctgttcccttgccaat

SEQ ID NO: 58987 - DNA, 1017 bp, Homo sapiens
gcgtttgagtagttgctgcaatcgtgtttatactgttaattggctttaaataaattattttttgtcagagcaaaaccccaacttcagttcagttcctacgtcactgagttgtaacttaactaagctttagtttactctcatctttaaaagaaacaggcattctttgcattttgtacaatgctttgcattttgtaattgttcaagataacttcttggtacattggcctcagattaaggatatctggcttctctttaatctcttaatattttcatttttgctctagggctcccaatattacaagtctgttcttgacaaggaagttgggatgacagaactactgtatgaaaactcagaaatgctcagaagtgcagacctttggttctgttttcttcctcatcagataggaattttttttaactacgcacagaatcacacttgcgaagtcttcttttccttcttgttactttatttagaagctgtgaactcaagaagtaggtcccatgttgaatctacatgtgcgcaggtgattcttttagccaagtcatttccacactcatgcccaagtctggagatacacaggtatgtggaaatgtttgaaaagcaaaaccaggttgatgagactttcaatctcttgataacctgtcatctaacctctgagggtccactctggtaaatgtcaacgtcagacatgctacctctccaggtcaccttggtcaagtgcactttcagagcagtgagagcaccatagaaacttgatacatagcttgtttgcagcaaaagagagaggtagatattagcatttccaaaagagctacttaaaacaattatagtaggttgaatatgagccctataataatgtcacccttacttctgttcttacatgttctgacaaggaaaagaccgtgcctcatctctggctctcagaattgtccatcatccacagtctattttatttatacctacgtggtaactgctaactcaaataggcgtgatggtgaccgattatcattgtgttt

SEQ ID NO: 58988 - DNA, 1074 bp, Homo sapiens
tcctgagggttttatctcctgatttggttagaagattgttgaatctggctgtgagagcctttcaagtgcctaaaggagagagcttgaacttccctgagagtacaccaggtgatgtgacactttcttgtccttgtaatatgccacctagaagagaacttttaggagaggagacctacagttctcaccaacctttaatcattagaatttaccagcatctactgataagaatgtgatcttggtgagcagctatcatagtgggtcagtttgcaatgaggggagtaagaatttgagagagcgcatttggatttttctgttggggagtcattgtagtcattctaaactacagagtggccacacagttcctctatatcagattcgttcccaagcactgttgttaagtctttaattactgtcagggaccactttaataacatctgttagtgtgggagaaggtctcttaaaggacttggggaatattaaaacgtgtgcagagaacagaggggagcatatagttcatttgtaactagtatagctaggaagagtgtggccaatatgaaagggtgtgcctattgtggagataattcaattagttttttctttccacagcaatagaagagtttaacttcatggtacttcctatgtgcagcgtctgtactaaatgttttacatggattgtttcatttaaccctcataacacctgcatgagataggaaatagtcttcacatttgacagatgaggaaactaaggcatcaaatttttcagggagacatagctaataagaagcagaaccaggattcaaatttagcaaatgtgattcctcagcccgttcccctaaataaagtctttcgaacaatagaaaaaaaaaaaaaaactgttgacttcatttcaagagtgtcttcctccaaaagatacagagattcccaccagggcaaaatggacgccacgtttccctcccgggggcaccagaagccttagcaggtggctgctctgagttcctgtggatggaggctcagaggttgggtttgattctacagagcatccagggttcccgcatccctttacataatacgaga

SEQ ID NO: 58989 - DNA, 1006 bp, Homo sapiens
ctcaaactcctgacctcgtgatccgcccgcctcgccctcccaaagtcctgggattataggggtgagccaccgtgcccggccttcagttggcttttttatggttaaataaagttccatttttcagattctatttccagatctctgcaatcatcggatcatccctccttggtgcctcgctgaagttgtagctcccattagttcaggtggttctgtaatatcagctgccttcctcagaacgagtctcattcttccttcacatatttttttttctcaaaatgaaacattcaaaggctcctgcttccatatgtagcatgaacattatttggcaccatccttcatgttattctcaaggcactctccaacttgcccatttccctctttcaatatgatgcccaaaattagtcaccgcattccaggagcagttgggtgtgcagggaccagatggattcaggagccaacactcagaacaagagtagttcttaaccatttgaggacgcgtaccccttgagagaatcaaagccctggaatctctccatgggaaagtggatgtacaatctcagaggattcctgggccttgccgtagttcattcataaactgtgtaccttctgggacagtgggtcaagaaccctgcctctgccgtggtgaggccgtacatgggaataatcaaggaagctttttaataaccacacacacttgtataagccttaagtataaggcagagaatttgggggatttgcaactaaggagtttgtttatttttaagctgagtgtattttagagatcagattttgaaactacttttcaattataatcacctgtgtggatttttctcagaatccaatttcatttaaaaaaaatgtatttagctggctttttcctgaattgacttgttcagacatgttagttcttttaagatgaagtgctcatgagattttaaaaatagccaccaggccccatgcccagctgggttctctgttggcgttggttggatgaagagtcccctga

SEQ ID NO: 58990 - DNA, 1003 bp, Homo sapiens
tgatgtgttggaattgctggttggattttacaaagaatggtggactttcaaacttatggtgaccactgttgaattttactgggacatgacaattatactagagcccctaaagtggcagacctgaagtctcgctgttctctttggtttgaggggaataagggcagatgataggcatatattgtttaaaaacgtgtttgccactttgtctcttcctcttcgcctcagtgaccttgttctccttgcaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgtgagtattacagctccctggctgctccttctgtctcctttattttatttatttatttatttatttattttgagcccagctctcactctgttgcccaggctggagtgcagtggtgcgatcttggctcactgcaacctccgccttccgggttcaagggattctctgcatcagccttccaagtagctgggcttacaggcttctgtctctattttgccattgcaagctccacttcacctctcaatgaggggtcattcataaaagcactgattgctttcttctcattgagaagttttccgaatttaccaccttctcaaccatttcattttatggtttccttcaaaactgtttatgcaaaaatctta

SEQ ID NO: 58991 - DNA, 1235 bp, Homo sapiens
gcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagattatgttacattaatctgagaattttaaatttagaagctaaaataaataaaaatcacagctggttgtaatcttatgctttcatatatcagaagtgtgcctctatgtagaatatatatacatatgtgtgtgtatatacatatatatatgtatgtatatatatacatatgtatatatatatatatgtgtgtatatatatatatatatatacgtatatatatatatatagtccttcatagaaaacataaaggtcacatttagatgacgtacacaggatactattatattaaggattttagaaaagaaaatgagaaagcccctgtgtgataatgaatg

SEQ ID NO: 58992 - DNA, 1059 bp, Homo sapiens
ttttattagagagttgaacaagtcatccacctccatatgcttatgggattacaaaattgcagctttgtcttttagaagagaaaattcacagagaaggcaggcctttgtagtcacagctctcatattaaagaagcaagggctcagagttcagctctctcacctcccaatgtgccagagtacctggttctggtatcatctgatagagttaggggacagggagctgcacgtacaacagtggccttgctgttggattctctttttcaggattgcaatcatgaagtatctacttcatagtatttcctgagggctactctatgctatatattttaagtattgttgctatgtgctgataaattgtactaatatcctcatcatccatgaaacattttggccacttgcttgcataaattatggcatcaagtctgtcttgggactgaagccctcaacagcagttcagatatttgcttattaagttgcccatagtattgcaggtgctgctctgcgctcaagatgcagatacaagtcttataagtctaccaagcaggacttctggcaaagtaagcaattgtcaggccagggcgtttggactcggtgagtggatgctttttgtttgacatggaaaattaggagaagcctgatgacctcaaacagaaagtgggaaggagctgtacctctgctttatgcaggttcagagacgacaagggatagcaactcataggtttccttctaggccataccatcaggtgtccggaagctatccctgcatccagtaaagtatttctgcaggttgctgggatgtcccacgtgcttgactctggggaagttgattgaggttgctggaggctagcaggtgtttgccactggaggaggcaaggctctgaagaaggaaaaaaaaaggtagtaaagggagacaggacagagcagagaaactgggttggcagtggcttgttgaaggtatccagcacaccgcgctgtttttggccactatcaatctacattgttcatgccacactgaggttgtatgtggaaccactgcctgattgcatgaacgtgattcaa

SEQ ID NO: 58993 - DNA, 1045 bp, Homo sapiens
agtcagctatgtcagatttctctcagatttctcttactgtcctagttttgcaaaggcatttcagtttcagatcatgtctgggtcagtacaagccaacagtatcagataacaacaaaagaagctaatgtcattctgtctgggttaattaaggtacaccatccaactagtggaaataaaagtcatgctgtgttctacactgatgcaaacacttggaatagtatgtcctgttctgagctccaccctcttagaaaggtgttgataagttattgaatccagaggaaggtatatggggtattcggggaaaggggagagtaaaaaccacttcttatgaagaatggttgagagcagtgggaatattaatcctggatgaagtaagactttgggagagcctaatagctgtcttcagaccttcaaaccaaaaaatagagatctgtagcattttcctgttggacaagatgacctctaaaactccttctccctggaagattcttattcctattgtgttaaatcttcactttaaaagaccttctattcgtacattctacttcttcctccagtatattgcataagccttaaacgaaaacctatcactatcatttgacagcaagctaacagcttcccacctcccattagctaattgaaatcaacaataataagaaagaaatagggtttttattcaatccagacggccacacacataactgagctgctaagtagaaagttccaggatgcttctccagatgcagcctgaggggtcctccagttcctctggggcagggttgctcaaacataaagaagccatcttattagccaggcatggtggtgtgcgtacctgtagtcccagctactcgggaggctgagacaggaaaattgcttgaacccaggaggcagaggttgcagtgagcggagatcgtgccgctgcactccggcctgggtgacaaagcgagactccatctcaaataataataatgataataataataataataatttatctcctgatttacactcacaccattgtttaggcagggacagggtaatttct

SEQ ID NO: 58994 - DNA, 1057 bp, Homo sapiens
atttattatatgtgagtagagctagttttctttcttccttcccagtgtgtatgctttttcttttttgtctcactggactagctagacatccagttcctgtcccaacattaagtgttgatattagctatgggcttttttatagatggcttttattattttacttgtatattttaagttcacccttcttccttataaaccttccacaaaccctcatcatttctcacttgggttgttgtaatagctcttgcctgtattaaaatgctaactcccatttatttcacttctatgtatattataaattttatcatctgcctactacccatcctctaattaaaaacaaaacaaaaacaaaacaaaagtgcatgtgtttataacaggttttactttttttcttaaaatagagatttcttactaaataccattttatttcatttcttcacagatcttctggttcttgatcatcttaattatcaagtgtcgtatatagggaacaagtattgatgttcactatgattcaaactattactgttccatagtcagtggagctttttcaatgtccagaaagaatactttcaatctttatgaacagcctaggattttgcagttgtttctgaaggctcaaattgtcctgcttcaaatttttctttgaattttaagtagtctcttcttttatcaaaatattttatctgttggaaaaaaaaaggatttgaaataagggcaagttatgcagcttagataagcaaaagcacagatttaaatgtaacatattattcaacataaatttaagtgatttatattctagaaccattttgtgtgtgtgtgtgtgtgtgtgtgtcagctgtaactatgaatgatgtttttctttttttttttattatactttaagttttagggtacacgtgcacaacgtgcaggttagttacatatgtatacatgtgccatgttggtgtgctgcacccagtaactcgccatttaacattaggtatacctcctaatgctatctgtccccccctccccccaccccacaacaggccccagtgtgtgatgttccctttcc

SEQ ID NO: 58995 - DNA, 1057 bp, Homo sapiens
ttctgttgcgataaagatatacaggagtaattcaactcctttaggtccatgttcatagttgtcagaatatagactatttctaaccactatttgatctctgtgtgcaaaggtgatatgaaaaacttcatataaacttttttttttttttttttttgagatggagtctcattctctcattcaggctggagtgcactggcgcaatctcggctcactgcagcctctgcctcccaggttcaagcaattctcctgcctcagcctcccaggttcaagcaattctcctgcctcagcctcccaagtagctgggattacaggtgcatgtcaccacacccagctaatttttgtatttttagtagagacagggtttcaccatgttggccaggctggtctcaaattcctgagctcaggtgatccacccgccttggcctcccaaagtgtggggggcgtgagccatagcacctggccataaacttactgtgaatgattatggcctagttcatggctttaaaaataaattaaagcctactacctgagcattctgagcctcacagggatgctggctctgcatcctgccaaatgtgttcccgaggggagtacagagacggaaagcggcacagaggctgatgacccctcttcattcggaacctttgcctcaacctccctggtctccatatgactcaagggtatgagtgttcacagatgatcgctgctttaactctgctttatcatagtccacacttctgacaaaaggcgtttctaggaaataaattctctcttaaaaaatccattgttttatttccacaattgcttaaaatattttattaaaggaagaatacaatttaacaaaaagtgtttattaaaggggaaaatatatagtaatatgtttaaggcacatggcaaacttttggcattaaattgcaagaaaaaagaaatacaaattatcacaataaatttcagaatctgtttctttagtccaaatagttttttttaaaaaagtctgaacagcagcagcagttcactaaggaaggcacatcatggcttggtatctccgtgcgagagc

SEQ ID NO: 58996 - DNA, 1077 bp, Homo sapiens
ttatttcatctctctggcatggccagctgaacatggaattgacccatcagtctttttttttacactcttatttatttcccggtactacagacttaacttcatttgttaatgtttcttttagtaacattcagaatatcaaagagaaaaataagtgaataaacaaaaaataaaaagaatatcaaagagaaaaattgtttgttacaggaaaactaatctttcttccattttcttcctcagaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaatttatttcctagaaacgccttttgtcagaagtgtggactatgataaagcagagttaaagcagcgatcatctgtgaacactcatacccttgagtcatatggagaccagggaggttgaggcaaaggttccgaatgaagaggggtcatcagcctctgtgccgctttccgtctctgtactcccctcgggaacacatttggcaggatgcagagccagcatccctgtgaggctcagaatgctcaggtagtaggctttaatttatttttaaagccatgaactaggccataatcattcacagtaagtttatggccaggtgctatggctcacgccccccacactttgggaggccaaggcgggtggatcacctgagctcaggaatttgagaccagcctggccaacatggtgaaaccc

SEQ ID NO: 58997 - DNA, 1135 bp, Homo sapiens
gatttcattgtactgaagcccattgttaatgaaagaacaaaaagatatacttttttgttaatggcaatttttaggttctgggtaatgagaattgtataggagatgatacatcacctcactgactgtaacaaaatgtgcttatataattttaagaaccataaacatgcttattatgattaacatgtaaattaattcaatatgtaaatcattagacattgcataaattatgataccttctccctttttcaactgtaattataatgtgctgcccttgaatttaaatcactgacctagggcttttcctctgaagaacttataagttattggtaacttaagctgctgtgcataagcaatttttttggtggattactaagattattgataaactgatctgtaaaaaagtatagatctatatattgcaagatatgcatcctagaacactaatgtgtattttctgctgcttcactgcaaatatcatttaggatttttcaaagattttaatatgctctgctctgtgttctttagcgcccagaatgctttgtccggcatctttctgcaggactcctctagtcactctagtgttaagtcaacctttttctattcagtcttccaacaggagtaagtcctttgcctccctcctgccctccctcatccttacctttgaccacctcactctcatatgttttatgatttattctccagtcatgaaatgaattaaaggtgtatgtgtaaataaaataatggggcttaattgttcataggaactgtatctcttcatgtatttgttttttttttgtttttattttattattattatactttaagttttaggttacatgtgcacaatgtgcaggttagttacatatgtataaatgtgccatggtcgtgtgctgcacccaccaactcgtcatctagcattaggtatatctcctaaagctatccctccccccctccccccaccccacaacagtccccagagtgtaatgttccccttcctgtgtccgtgtgttctcattgttcagtttccacctatgagtgagaatatgcggtgtttggtttttcgttcttgcgatagtttactgagaatgatgatttccaatttcatccatgtccctacaaaggacatgaactcatc

SEQ ID NO: 58998 - DNA, 1039 bp, Homo sapiens
tatacctaatgctagatgacgagttggtgggtgcagcacacgaccatggcacatttatacatatgtaactaacctgcacattgtgcacatgtaacctaaaacttaaagtataataataataaaataaaaacaaaaaaaaaacaaatacatgaagagatacagttcctatgaacaattaagccccattattttatttacacatacacctttaattcatttcatgactggagaataaatcataaaacatatgagagtgaggtggtcaaaggtaaggatgagggagggcaggagggaggcaaaggacttactcctgttggaagactgaatagaaaaaggttgacttaacactagagtgactagaggagtcctgcagaaagatgccggacaaagcattctgggcgctaaagaacacagagcagagcatattaaaatctttgaaaaatcctaaatgatatttgcagtgaagcagcagaaaatacacattagtgttctaggatgcatatcttgcaatatatagatctatacttttttacagatcagtttatcaataatcttagtaatccaccaaaaaaattgcttatgcacagcagcttaagttaccaataacttataagttcttcagaggaaaagccctaggtcagtgatttaaattcaagggcagcacattataattacagttgaaaaagggagaaggtatcataatttatgcaatgtctaatgatttacatattgaattaatttacatgttaatcataataagcatgtttatggttcttaaaattatataagcacattttgttacagtcagtgaggtgatgtatcatctcctatacaattctcattacccagaacctaaaaattgccattaacaaaaaagtatatctttttgttctttcattaacaatgggcttcagtacaatgaaatctcacctgcacaaatgttctcactcatttccttttaatgtcagaacagatttctgtttagagttaaatattcccttccattgtttacaagccagacactgcctgagaaatagaa

SEQ ID NO: 58999 - DNA, 1005 bp, Homo sapiens
gtatgagattagtagagggacagagaaatggacaggctttgaggtaaggtaaacaagggcctaaagtactgactggatttatcaagagccattcgatagcataattaggggattgaaaccaaattaaaataggtacaagagggggccagctgcagtggctctcgcctgtaatcccagcactttgcgaggccgaggtgagtggattgcttgagcccaggagttcaagatcagcctgggcaacatggcaaaaccccgttctctataaaaataataataataaaaaaaagttagcggggtatggtggcatgcacctgtagtcccagcacctcgggaggctgaggtgagagaatcacctgagcccaagaagttgaggctgcagtgagcggagattgcaccactgcactccagcctggcaaccgagtgagaccctgtctcaaaaaaaaaacaaacaaacaaagtccaaatgtggataggatgatacattaacatatattacatcagagtggtaggtttactggtgtctataattttctttacctgaatattcggaatatttaaaatatttcatgtctttaacttttcaaaaaatgggtgatgaaggtgagacagagtcaacttatttagaaaattctctcaaaaaatagtatattagaaagttcaacagctagtggtgggggtgctgtcaaaagagggcttctgtttcatttttggtaacattagttgtttttaagtgatactcatagtcaggaagttgaacagtgcagaaaggcatcgaatgaaaacgagacagtctccttccttctcccaccaaaggtgaaactccagtaaacttgcttttcttttaacagctacctaatattccatttgccttaggatatcgcttgagtccattactgatggacactttaataaggttttgttttgttttttaagactagatacaaaagcccttttgaaaaggctgaaggaaaggctagaatagagaagaggggagatgcggaagtt

SEQ ID NO: 59000 - DNA, 1036 bp, Homo sapiens
cctggcatcttggcagatcttgatttgaacctgaattcttccacttactaggtatgtgactttgggagggttattcagcttttctgagtcttttcctttccctgtaaaaatacaggtgatggataaccttccttatagatagaactgatgtccaggtaaattataaagtactgaatgaaggtacttcatcattatattttaatcagtagtttttagagtctttgctcggagagttgtagatccaataaattacttatgataaaaactttaagctattttattttaaatggagactatttttaaattaaaatgaataactgtaactggttaattgtgaactttttttctcagaatttcttgaatggaattattgacaggattttccaggctggtttcaccaacaatcaagcatccataaaatattttatagaatggattattatattgattcttcataaattccctcaatttcttccaaagttctgggattgtttttcttatgtaagtaaagaatattttttatatatttttaaactaagacatgattttgacaatgctgggagatttgtttcacttaaatagttgtttttgactctcagttgccctattgtattgacatcataagttatgttttgcaagatctgaattaattcagaagacagaaatccctggcattcattttgaatatttcatagtttttgagagctgttctattcaacaaaataaagatggaaaaggcatttgtcattaagaagtaagggaaataggtgcattccgtattcttatttaccaagcaatgtctttgtttgatcttagaaatatgaacgatgaggaattaattgcgttccttaaaattgaaaaaaaggttttgggagatttcaaacataacgtagaaagaatagaagtaatatcagttcatttcctttcttgtttcatctgtaccctcacacactcccctaatcgctttccaacttttctcatatattgaaaatcatttttaaggaattgatactaaaattagtgatagagtttatca

SEQ ID NO: 59001 - DNA, 1033 bp, Homo sapiens
agcctggccaacatggtgaaaccccatctctactaaaaatacagaagttagctgggtgtggtggcgggcgcctgtagtcccagctactcgggaggctgaggcaggagaattgctagaacccgggaggcggaggttgcagtgagctgagatcacgccattgcactccagcctgggcaacagagtaagactccatctcaaaaaagaaaacaaacaaacaaaaaacatgtaagttaaaagcaactaagttcagtgtttgaagtgttttatttaaaaatttttttatttttcttaatcactcagcccaaaatgtcaatgtttgaaatattttaaggtgccattctttttctcatcctcctaactgctttttgggggaagaaaaagcccctgtgcctaatttaagccacttacatttcaagttgtcattgattttttcattaatcacaaattcaatagataatttaatgttgactccctcccttctcctttccaggatgaattagtgtccaagtccaaaaaacgctactatgtgaattctctacagcacagagtgaaaaaccgagtgtggcagactctgctggtacttttccctagacttgaccaggtatcatatttttattatatttgtacctttgaagcatatgatttcatgactgaactattttgcagaaactatcatatactattttaaaattgaaaaagataatgtttaaaatttattctgcagttcttaaaattgaagttattcaaaagtttttattaacagagagaataccaaggcaattaggtattgtagaaataagttagaagtgggtttacatggccccatttaatatttttttcccttcggtgttttaatgtgacattttaactgtttaaagtctgatttgccatttgattagaaaatgcaaatacttaactcctaattttctgtagctacgttattttggagtgttacactgttttggattatctgtactgtagaaaccaggcaaattgtatcatttgggatgggaatattgtttcacatggtgga

SEQ ID NO: 59002 - DNA, 1077 bp, Homo sapiens
ttttgatttctactaggcagttactttgttgttaaattaaaatatttattcacattataacaattataatgaaatgtgaacaattataacggaatgtgacgatttcacttaatttatctttccacatttggctactaaaaatgccgggtgttgagagcacacagtgcttcctgagtttgcccctcagttggagaatgtgcaccgatagtgcatggtagagacaggccattgacgtgtttgatgtgtatcatgcccctgagtgaatggaggtatctgtggtcctctttcagggataggctcatgagctgtgatctgttttgtccacaaataaggtattattgaactaggttcagcagcgtgtgcattgattctccagaaatctggatgaatttgtgctcattcatactttctgtatagaccctccttgtaatatattcatttgttatcttctgttatctattctaaattaaaaagtattgtcattaagtatggacctacttaattttagaaaactttgagaggttttgatcgtgtaatgatatttgaaactaatatttgatgttaattttctgttttcaaaatgtattaacataatttatcatttaatttttttagtactaagagagaagaccattatgtgagaatttgtgctgtcaaattcctgtgtttattagatggctccaatatgtcccacaagttgtttattgaggatcttgcaatcaagctattagataaagtaagtgtattttactttaaattatctttgtttttaacagtcagaggtcaacatttgctctttatgttgctagaatatgtacttctaaatatcttttgtcaggagaaaacacaaagtttatgttctgtatttttaattcagtcttgattagggctggtcacactgtggctcacgcctgtaatcctagcactttgggaggctgaggcagcagaattgcttgaggccaggagtttgcgaccagctggggcaacatagtgagaccttgtctctacaaaaagaaaaaaaagaaaaaaaatcttggttagtaattgtccaactcaagtttggttttagagaacaat

SEQ ID NO: 59003 - DNA, 1008 bp, Homo sapiens
ttgagcctgggaggttgagcccacagtgagctatgatcacaccacagcactccagcctgggcgacagagtgagaccccatctcaaaaaaaaaaaaaaaaaagttggttaacagtttttaataaatccttaggttttttttttttttttttggatttttaaaaacatgttctagttccttgactagcttatgtttgttttggttttatatttttgtattatggaagcagggtgtcattaatttaatttacacattaattgggtataggatttccttcctgctggtgcctggcattgaagacagtggttcttccctgtgccttctttagtgagtcgccaccctcacgggaaagcacggaccagaagatgagtcctcatagctgctggttgtctgggtctttcatgagagtaactttgtctaattggatccattagctaaccagttttcacccaattataggtgggaagcaatttgcttatgcttttgaaatggttgattttggcatgtcttttaatgtctagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatggtgaggataagttgtttctcttggtatcttgcttgatatagcattggtatttagagttctagagaggaaacttccgtctttttaaaacaaagagaaaactttttatataatttagaaattatatatatttaagaaattatataattatatattaagaaattatataatttaagaaaaatatttattgagtatctcccagtggtgctggggatacagtggtgaaggagcaaccatctgttctcgtgagttgacattctagtggtttccgtgtgttggttactataatgtaatttcatttgctttttaaaaatattt

SEQ ID NO: 59004 - DNA, 1091 bp, Homo sapiens
ttttttttttttttgagatgaagtcttgctctgtcattaggctggagtgcagtggtgcgatctcagctcactgcaacctccgcctcccgggttcaagtgattctcctgcctcagcctcccgagtagctgggactacaggcatgcgccaccacgcccagctaatttttgtattcttagtagagacagggtttcaccgtgttggccagtatggtctcgatgttttgacctcgtgatctgcccacctcggcctcccaaaatgctgggattacaggcgtgagccaccacacacagcctagagtcattctttagtttggtagatttcaggagtttaattaagcatctgggctgcagccatatggggatgaatttgtcagccgcattgctgccttacatgtcagtagcacacgtgagtgaagtgatgtcggtcagggcttcctagaatttgagagccaggtgtttgtgatccaggaccaggcatatcacagatgcttggtaaatatgttgaatcgatgtgaaatagaaacttggccattgccatcttcctagtgtcatgagtgaagcgttaggcaaaagatgggatttactgaatttagttagtgcaaatggaagaaagaaaaattgaggccaggagttcaaaaagagcaattaaaacattcattcacagttatttagtcatttttcagtcaccagtttccagtgaatatcttctgggtgttctgaatgtcttttgtgctaggtatttcaaaagacacaaagtccgcgtaatatccttttagtagcttctgaggatttcttgaaagtcattctacaactatgtgagaaaacagacattttcactaactacatgagatgagggtccttaagaaatcacagattagcagagaggacagaatgaagcactatccctttgtatctcaaaatagaaatataaataatcgtaattaaatccaaggtagtcaagaaacagcctatgagaaagatgttactgtttgcatatactagaggccactaaccatcaatacttcctatcctgtttttccttcacatctcaaatagaagaatggcttctaatcataaacaattttatcttt

SEQ ID NO: 59005 - DNA, 2082 bp, Homo sapiens
cgaaagtcgttgcggtttttgccttttttttttttttaaaaaaaaaaaaaaaaaggcaaaaaccgcaacgactttcgcaccaacctagtaattattgggggtaaaatggtgagagagatgtggtatttttcacctgacttttgtgttttccatgaaaaaatagttttgattgtaagatatatgaggggaacagacaaggggctgatgaaatggactcaagggtgagtggggtagtcagggaaggcctgtcttatgatgacatctaagctaagagtccaggctgagaaggcaccacctgggacacaagccctgagatgggagcagctgtaggaggcagaacagaaggaccagcagggctgcagcagagttggtgtgtggagtgggggatgaggttggagtggcagtcaaggtcagttcatgccttgtttggactttattctaagaacaatgaggagatgttgaaggattttaagcagaggcgtgacaatttcatatttctgtgtgaaaaatggattgaagtgggataagagaagaattggttgaaactattccaaatctgaagttccaacctgcatgcatggggtaatatttaatttttgtacactgtagcagttacagcattcgtttacagtctttcttattttttcaagacagagtctcactctgttgcccaagctggagtgcagtggcggggcctgggctcactctaacctccgcctcccaagttcaagggttcaagcgattctcgtgtctcagtccctcccccaccagtagctgggattacaggcatacaccaccatgcctggctgatttctgtgttttttagtagagatggagttttgccatgttggccaggctggtctcaaactcctggcctcatgtgatccatctgcctcggcctcccaaagtgcttggattacaggcatgagccaccatgcctggcccatttacagtctttcaaaattaagctgcctgaatacggaatactgaataccaaaatttttttggttgacatactcagatgtgactaaaaacagtctgggtgcggtggctcatacctgtaatcccagtgctttggcaggccgaggatggaggatcacttgaactcaggagtttgagaccaacctaggcaacattctgagaccatgtttctaaaaaatattttaaaaattgtctaggcgtggtttgcatacctgtagtcctgctaggaaactactcaggaagctgaggcaggaggatcgcttgagccctggagtttgaggctgcagtgagctagaattttgcaattgcactgcagtctgggtgacacagtgagaacctgtctctcaaaaaacagtaacaaaaacttcttgtagtgttataatgaagttattgtgtgtgtttgtacattatttatgagtatgtagtcttgatggtgaaatgaagacagaatcagatgtcaacatttgatgtttgtttccacaggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgaggtaatgacaccctgtccccttccttgctcccattgttgaaaggcgagaggtaaaaatacactaggattctgtatcagcaagtaacattttggagatttgcatccaacaaatcatatttctctaaacccagctttcctatttggaaaaagcttatgttgtttctcaacaagcccaacggtagaactgcctgtattattaccattgtgaaaaagtagttgtatattatcgatattcagaacagcgttaagtcaagaatcgtaagcataagtcaagttttcactatatgaaaactggtatagaagctatcaggtgatgctgttgtcaccgttctgagccactgatgactgttatttgtttagtgatgctactgcctcaattctgactcaatgaattgctgttgtctactatatgaaatagggattgccttctaagcaatatttattagaatctgtacttccatttgtcagga

SEQ ID NO: 59006 - DNA, 1046 bp, Homo sapiens
gtttgcctgaacttcaggagataaaagacatggaacaaaaaggcaactgatggtataaaatagaagtgccagggactgcggaaagggcaactggataggggacacagataaaagagctgaacaaagtacggctagaaagcatttgtttatttttcaactagcagcagaaccagccattctgcaatggtagattggaaagagaagatagtgacgacactggaaagactctcaagacctggagctgctctttgaaaagctttggaataaaacagctacgttgggccataggaaatgcgctaaagacaaaagggatttaaaaaaaaaaaaagccttatactttggaaagcttaggaatgaaaaaagccaaagccatgtatgagctttattgatatcctgaaacttaaatttataaatagagataaaaggtagaaagcactgagacacattttactggctactctcatataataagaaatttcctagatgttgcagcttttactctttttattgattaatggcttggcagacttctctatgaaaggaagttgtgaaactcataaagagttggaggctaggatatacatagagttactatatgttttaaattaaacagcaacagtgaatgtgtacttgaatatatttacactagggtggtctggtaactaggaggggcccatcactatatatattttaatagtttttcattattagtccatttaaggttttcaagaaaccatattcttagcaagttacagatgataaacaatttttcatgtaataactaggttaaaagaaataggatgaactatgtttttgtaacaaaaatgctaaattttatttttagtgaaattgaaaatagtgcagcttgtagaagtaattctcaacatttcaaaacctcttcccaaagatatactttaatgactgcatttcgttttcagttaagaaaacaaaccagactcttgatgtggcagatgtctttgtttattccccaaaggggagttgggggagagttaaaaggaaactatggaaatccttttttaattcct

SEQ ID NO: 59007 - DNA, 1099 bp, Homo sapiens
ctgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatg

SEQ ID NO: 59008 - DNA, 2676 bp, Homo sapiens
cagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcaggtaggggcggctgtgaagtgagggggtctaggggagaaaaggggacggagagcagaggaagggtggttctttggattcaccattttaccccagcccagaaacaacaaacaccccacttcctgatctgcctgaggcggaaccagtgcttggtggcaacgtgttcatgtgctgaagcagcataacagagatgagtcagactgggctgatacgctctgacacggggttttcctttcccagcacattcttggatgggagcatgagggcaccagtcaccttttaacctattgggggacattagcagtcacatgttgagtgcaaacgagggtacttttgtgcatgtgtacaaacaggcagttacaagcgtgtcattttcagtggctccattttaaatcagtctgctgcctcagaatcccgtacgcctgaaggttttaagttgcatgtgcacctgaaactcgtatatgagtattttctgtctgtgcttttagagaggaggaattctgtaacgacttttgtttcgggttaggaagagaatgatctctttcagtgcaccgccacttatgttacctttttccttttatttctttgtgtttccagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagataca

SEQ ID NO: 59009 - DNA, 3195 bp, Homo sapiens
ttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttggcttggcgtatgtttggagaagtgaactctgctgaatttattgagtctaaagctgtgggttttttgttgttaacgtctttgaggatgtctagggccgcaggcttccctgccagaagaatgcacatttgcttcagattccaggtgaagaaaatccctgtggtagtgtcagcgcctgagggcttccaggtggtggtgggcccagcgtcaggagatagcagtcacctgggaggcccgttacaacaggttcgtgagaggagcccagtggtggtggtgctgacgtgcgaaacatgaaggcttgttagagaaaccagctgtgttaaggtgacagaatgtgtacgttagcactgtaaaaagcagctaattggtagcagaacgtgctagctgagaatacgttgtattctacatcactgataatgatctgaagtgtacaagtcatcagtatcagatctatgagagtttttgtagttttgctctaacataaatttctctttgccacctccaaagttattatattaata

SEQ ID NO: 59010 - DNA, 1222 bp, Homo sapiens
aaaggccaaggcttttcaggttacatgtaattttatgtaaatcttacaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcaggtaaggaattggaatgttatgacataaaagtgagtgggatttagaatcgaatgattagggacattttaaaatgagcctagtgaacatgatgaaataaacttatctgtataatgaaaacaatatgggagatatcagcgcttgacattttcctctctggtgggaaacatccagatgactgcccagatctagtgattgtgccctggaggtggatcaggaagtgtgtgtcttagtgataagtctcaggtcttagtagtcaactgtccaaattcaggtcactcttggctactttctacaagtagctttctgcctactcttccaggagaccatgccttcagttaggtgatctgacagaggagcctagatagctatagcctacacattcgggcctaaacgtcggttctagacattcaagagcatggattccctctgactcacttgtgtaaaggctcatgcctctgctgctgctgaggtgcactttgagtttggagctatttgacgacatccccaaatccctactcaaaaatgcaaaatagcattaatatactgtaaaagattaacttatgtgtaaattaggagttaatgaaaatgctttctcttcattttgagttcttttcaaggagcccaaatgaatcttgctttttggaatagcgtgtctgttacaagtgttgatttcccaagttggtgtgattaaaacagtgaatgatgataggaagtatttacagaactttatagttagtaactgactggttaatttttcaaactgatttttactcaactgaattagaaaaggactggaaagaaagtaaagatcccaacgacttgagggaacaagttggacaaccaaggactttgtctaaattgtttttatttagactaatgtggttctagttctagaggattcatactggaatcatcggtttaatattacgctatttgaaaggcagcatagtatagtacttttggaaaattggcctgagggtgatgtcttttggaatatttgtgaattcactatgaagcctaattccttaaa

SEQ ID NO: 59011 - DNA, 1577 bp, Homo sapiens
tcaagttttttcttttattcatttgaatgtagatgaactcttaattcctacaagtattcaggagtaaagttcttctatcagatttttttagaatgagtgatttggttttttgttgttttatttttattgatatctgtgtattggttatatcccctggcataattgtggtgtcatttattaaatattttatttccagttacctgaccttaaagatgctgaagctgttcagaagttcttccttgaagaaatacagcttggtgaagagttactagctcaaggtaatagtcattgaaaagctaaggaaatgggtagaatttttctcactgatagaaatttataatgataaggggctttgtttgtgtaatttggctgttagaaaaggtactccaagtatctcaagacaagtttttaggcacttaataattggaagattattttgtgtaagactggctctagaaagaaatattccttgtgggatattgttgtccataatatattttaagtgagttttaggttttcttgctatatcatatgatgtagaagatagtaagtttttacaaatgaggttctcttactctgaagtagtttctaatgtatagccatagtgcgatatgtaaatagtaactgaaggaatgtgagctaggaatatactcctcaactccttcatctaatcttcagatcttttccagtatttataggaaggaatggctaatgtaaggtcccagagaaggttaatttacctaatcaaggtcacacggtgagttcatgaccccttatttcagaaccaacttgttatctgatccagaatttagccttttcattacattgtacttcatttatttcatcaacagtgctaagaagtttctaaaaaatattctatctttaaagttcagctatgaaattgaaattatcaaattgacaaacgtgagaaccgtaatttactcaataatctcaaaagtagatttgaagtagttgctatcgttattaaaactgctatcaaatattttaaaattctgattgctgtatcaatagatttagatagaattgaactacatgatgtggggcatttgtgtgtgaatgagtttgttttgttgtttcttttatggggagagtttaattcatttaaaatggtggtaactaactttatcacgtctcccctttgccaagaaatacttttttgatatcaatagaattgctcaattaatttgacctaaagagtcacagtactcaaattgccaacagactgggaaggggtaaaaatcagtgagtagggacaggcatggtggctcatgcctgtattcccagcactttggggaactgaggcaggaggattgctggaagccaggagttcgagaccagcatcgataacaaagtgagaccctcatctctacagtaaatgagaaaataaaccaggtgcagtagtatgcacctgtagccagctactcagagactgaagtaggaggataccttgaacccaggagtttgaggctctagtgagctgtgatggtgccactgcatttcagtctgggcaacagaatgatatgctgtctcttaaaaactatatacataaaatctgt

SEQ ID NO: 59012 - DNA, 2068 bp, Homo sapiens
agtgagagatttgcctaagatcacccagctaataagtattagctaataataagtattggagccttacattttcttaactatgtcagcagttactctctatgtcattggtagtttttagtgattatcactttaggtgtagtcctgcatcagtatccttgagtgactggttccaggcctcccctggataccaaattctgatgatgctcaagtacctttaagtggtatagtattttcatgtaaccatcatatgcctcctgtacactttagattttttctttcatttaagaatgccagtttgcaacattcagtaaagatataatctggcatatttcagtaataaaactccctaatactagtggcctaattcttgcccctgttacatatcctttgttggttggaaggggggacttgatctgcttattgtaattactttagaagtccagctattggagctatctccatcttgcaaattgctagatcttctgccccaaagggaaggagaacgctccagtgcagtgtcacatttcctacagctcattgaccagaacatgtcatatgctcttgacagatcacagggagggatagattcctagagttagaaatgttttgcaaatggaattaatgactgccacagcagttagaattcttttgattcccatttttataatgacaaaatgtaaatataactttgcatttcttgcaggaagaaagaaacagaagcttgccaaggagagagctgggctttccaaggtaatagtctggtttctgtttaaattatatattttgtagaaatattattttaaaatctgtaattggaaatgtaattaaaatgtaattggaaaaagctagttgatactggacattgcttttttattttaaaatacagcttatttttaggagtaggtgaataatgtagttccaatgacagttatcgagtccttcattatttcttttgctggccataacaacaaacagcttactgtatgaacaataattaaggagcaagatgagggcctcaagacatttgcaccaaaagatgaaaagttcctaatcagctgcttcaaaatgatacaatattacacttaagatttaatttctttactccaacttcctgtaaaagaaccatgggttattatttcaaaaattattcaagattattcaagcccactgatccagaatcccactgccctgacaaatttttgccttgttgcagtacatagttctggatataaaacttgtaatttattttttcttctcatagatcctgagttcttgattatttttaatgactatgtaggtttatctacttggtaaaaaaatgttctgtggcgtgtgtaagtaaattaagtaaatgttaatcattgtgcttgcagcttttcctttttattgagatgagttctattgtttgggttcttaggacttggattactggatcattagtggttctttttaaagcaagttgagacaaggaaaaattaagttaaccagtatattttgttattttgaaacagttgtgtaaacacagctagttgactggacatggtaatagtgaagtgaaaatgggaggaaactacttcgttctagtaggatcagactacctttctgaagtatgtaatatgtttattatgcttttggtaacttatatttctaagggcataggaaaacagattgagacatgcaccagtatgtatttttagattcaagaatagaattaaattattgctacatgctggggtagtgtgtgaaagatgtctccactttcagaaatttaaattgtttcacttgtgttggctaggttaataagagtacgtacagtgtaattcaaggaccaaaaacttgcactaatggaagtttaggttttctcttttttttttttttgagatggagtctcactctgtcaccaggctggagtgcagtggtgtgatcttggctcactgcaacctctgcctcccaggttcaagcgattctcctgcctcagcctcccgagcagctgggactacaggtgcatgtcaccatgcccagctaatttttgtattttagtagagatggcgtttcactgtgttggcca

SEQ ID NO: 59013 - DNA, 2025 bp, Homo sapiens
cttcaattgtgtatatttttcaagaaattactccatttaattttattccagttatcataaaatgaggctatcctgtaacattcttttgaaatggaaccactacgcacaatggattgtggcaacctgaaaagaaagtacagtttaattcaaacaagtcacaggctgcctgtgttagacaagatgaagcattcgcagtctgggaccctgcatctctgtctgccacaaacaaggctgtcagctagtcttctgagtacgtgcacgccagtaacgcgtacgcctcgttacagcatggtcggcggatatgaaaaaaagtccgtggtcacgtgcaaattcccgactccagtgcgtacacccagcggcgcaggggaaacgccggcttcgcccactgcgcaggcgcaggagccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgtgagtgggtcctctctcccctggccaggcttgctgccttcggccgccgcccttcacaggaggggtcattgcctcccaccagcctgtgggccgcgcagggcgaccgcgtggtgcggccctcaataggcgatggcgctggctgcgccgctccgggggctctagtgccccgtaggaattccattttggaggaaggatttttcccgttttgttttccccagacactttagccgtgcaaatgcactcttgatttctgttgcaatctcgggtgtgtgtggcctggggaggaggttgtctctttttttgtcgttcatctttttaaacctctactcttaactaaaaagtcgtgcatttttgtcgcaaattttagtctgaggctaaatccgcatgctcagtgcagtatcattgttgcattcttttttttgagacggaatctcgctctgtcgcccaggctgtagtgcagtggcgcgatctcggctcactgcaacctccgcctcccgagttcaagcgcttctcctgcctcagtctccccagtagctgggattacagtcgggcgtcaccacgcccggtgattttttgtgtttagtagagacggggtttcaccgtgttggtcaggctagtctcgaactcctgacctcagatgatccgcctggctcattgctgcattcttaaaccctcttggtagcttcgttctaagtgcttccaagatatgagtgaatgctatagaaattgcaggggagtccaaagggctgcgcttctcccgtggctcagtcttatttcatacctgcgacatcttttaagagaggtctaccagaggggaatcgtgtcatgaaaaccgttgtgatccaccttgaattttcggagaatcttcattcgcatcattgaagagcaaatttgttgcaataagaaatattttttggcttatcttggttgttcagccaaattagtttttggaattaaaattgatacgtaagttactaaagcccaaggggtacaaagaagggattattgtttacttaagtaacagtggttacggtttaattcagctatactaagtcatttcaagtgttcagtagccctgtgtgagcagtgactgcagcgctgatcttactagcactaagaatcagacatctagttccagctttcttatgttttaggagggaagggatatagacataatttgatttatgactaggcagactaatagaatactgttttacattcagaccttgaatttctagggccaggttagcggcataatttggggtttctgaatcctaatttctgtagttgtaaa

SEQ ID NO: 59014 - DNA, 1061 bp, Homo sapiens
acctgggattggatggggcttatctgtgcaagcttgaaagtcgttctcatctgttaaagtgacactttcactagtttctttgcagatgggtttctggtagcaattaatgtattgtgttttcttttgcagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaaccttactccgtgtgtgctcaagttcttgatttccttggcatgaagcaatgaaccttgggtattaccccaaacgatgtcgcttcagtatctcactttgttgcccaggctgctctcaaactgct

SEQ ID NO: 59015 - DNA, 2113 bp, Homo sapiens
aggacttctgtttcaggcccagcccacgctgagctctagtgttttagtgagatcatggctggaatctttcctgcttgtctggtgcccagcattttgcccctgtgctcggccatcgtagagccagaagagccagtgcttcctctgtctctcattggaggaagcaggcctgtccttagcttctagctgctggctttccccaagacttcagctctgtgatggctgcaacaaaagttatgatgctgtgggttatctggtttcttcttaactggtaagagcaggagtgatgcactttctggctttttacattctaggtggaagcggaactccagcatttgttcctgggggtgcactaggatgtgttggatttggatgttgtcggcagctgtgtgttgtgtgaagagcagggctctagagtcagctagacttggtttcagtcctaggccagccacttgttgccatttcatcgcagtcacgtacctcttccagtctcagcttccttattcataaaatcagaaaaaaaacaccgtgttggagatgtgagattaaatgaaatacataaaatgtctagctgagtgtctggtatatattaggcattcagtaaatcacagctggtttaatcaatacaaaagcattagtatagtgtattattacagaatgccatcagtcatgtcaggcactattttccagttcccttcttgatgatactcatttgtgtagtagcatttttcttacttcaaaacagtaggttgatgtcttcagggaaagatctgtgttcattactaggtcctttttgctaactcctcacatccaaattatatcaccattttgcaaacctagtgacttaatgagtttaggcatttagtagcagcagctgcagtcattgacaaaagggtaaaaaccagtcataacatgactccctggaaagaacacaacacccaccagcagtcgcgacaaaggggtcatgtctgagtctgatccatccttttgatgcagctgccagtttacaagaaatatagaggacaaaggtttgtgttaaactacttgatgagcttgcagtcacaaaatccaggctgtggggaattctgcaggccaaatagtgagagataaagagatacagagaaaactctgtaaattaaacaagattcaaaagacatatcaggtcaaaagtatagacaagaccaaagtatgatgtctaagaatagacacttggttgataaaaccacaaagatgtgcagggaagtagttcctataaaaatgggaatggtggttgcctttggagggaaggaggggctgcaacgggaaagggccacagagaggcttctgagtgggctacaaggcacgttgagctgttgttaattcactcagctatacgtagtttgtgcactcttctatatgggtgtttcacagtaaagaggaaaactcacgtctttcacaactgtttatatgtgtgttagatacggactgcagctaagatgtcagtttttagttcttgtatggttctcagggattcatatacatggttcatctgttttctcatggttatgattcctaagaaagtatgggttgtgtctccactaatatctttataagttgtgtgttattttttgagttattactaaatatttattcaaagagatgaaatgtccacccaggaattcttgtcatgtgtgttaagagttgaaaacagctagatttttttctagtgactttgaggctaagaaatttaccttgtctctcttttctttctttctttttttttttttggtgtagacgtaaaattcatcctgatcagaaaaatattaatgcctatgttgtgtttaaggaggagagtgctgccacgcaagcattgaaaaggtaattttatcccttaggtttgaacagaataattgtcctataagtatgtatgagtactttttttattctttggtttcactttagcatagatgttttagtaatcgagtgctcatttttaacaaccattttccctttgtatttataatacagaaatggggcccagattgcagatggatttcgtattagagttgatctcgcatctgagacctcatctgtaagtagtacttgatttgtttaaagaacgagagctttgtagaga

SEQ ID NO: 59016 - DNA, 1061 bp, Homo sapiens
gtttcaccatgttatccagactggtctcaaactcgtgacctcaggtgattcgcctgcctcagcctcccaaagtgctgggattacaggtgtgagtcactgcacttagcctttttcatgtttctaattgctctttctcatgtgattctctggaatagagtttctcaacctccatacagttgacattttgggctggataattctttgttgttggaggctgccctttgtattataggatgtttagtaacatccatggtctttacccactagatgctggtagcacctcctgcacctcagttttcacaatggaaaatatcttcaggaattgccaaatgttagaggaggcacaactgcccacttctatagaagtagacgttacccaaagctttgacagtgcccataatttctgtcagggtatttatttcccactcttatcacatatcttttgtctgcccttctgagttccatttccctgtattagacctttggctgatgcattagtgtgggtgtcttgccagaccctgatttcaatatatctgcttacttccatccattctcaccccaaccctatgctgcctactgatttttctgtggtatttagtggcacccaggctgcaggttttgtggttgcctttgactcttcattggctcacccatgctagtgtttgccactcctgtccgtttttcaactgtgatttcttcctaatatgagtcattcctttcttttttccttgtcctacctaagttctcattacctcctgtcagaatagtcgcagaggcctattgtagttccttaccttcagtcttcctctaatttgtccaacaaaacactgtgaactcagtcttcctgaagctcttcttcccggaacccttacctctttccctgccttgcattaatgaaacgcccttccccccatccccccagccgccacacacacacccctcacggggcctgctattgccttctcccctttggggagcctaccttgattctccccagtctctaggctaccagtgtgtccctgctatgcatttgacagcacccatccctcattacagtactt

SEQ ID NO: 59017 - DNA, 1042 bp, Homo sapiens
cacaagtttcagtaaaatttttttgttcatccaactgaatagtcacctactttcctgaaatgttcttaaaaactggcagtaggccgggtgcggtggctcatgcctgtaatcccagcacttgaagaggctgatgtggttgcatcacctgaggtcaggagtttgagaccagactggccaacatggcgaaaccccgtctctactaaaaatacgaaaattagctgagcatggtggcgggcgcctgtaatcccagctacttgggaggctgaggtatgagaatcacttgaagccgtgggggcggaggttgcagtgagctgagatcacaccactgcactccagcctgggcgaaagtgcaagactctgtctcaaaaaaaaaaaaaaaagcctggcagtagaggattatcagacaatttttcttaattcctttttgtagcacttatttgatgttctgaaggtcagctaatgtgtatttttttttttaattttagaagctgaagtcgttttttaaagagtatggacaaatagaatctgtacgatttcgttctctggtatgtttcattcccccgtaaaattacataatattaaaatttattgcatttaaatcagatgaacttattgctgttagtgagatggtgaagcactttaaccttttgaatcaataggttcaaatttaacccaagaaaagagttgctcttactatctactgctgactcttgaactttttaaataatgtattgagtttacttaataaaatgatactcttgctatgaaagcctgcaatgtactttggagggtggatgggtgacttatttactgtgtcagcagaatagactgaaaagttaatactgattatcattgctggaatcctaggcattctcttcctatgtcccatcatacacattagtatgggaggtgggtatgattgctgcaaacagtctttgttctctgagcacagacagataaagaatttatgtcaatttaatattaaaactttatagaagtgagttggattttaccagctcagcactctgaaccagttatagcc

SEQ ID NO: 59018 - DNA, 1045 bp, Homo sapiens
gtgctggcgaagcggtggtgcgtggcgtggctgagtttctgtcgtccatttctagagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaagtaagtcactgggctttcttcccgaatagctcgttagaaccacttacatacaaagcaatcttcttacctaccgcgtgaagcgtgatttctaaagggggcagacaggattcattttaagtaacctttcatgactcttacataccagtgagagagaagagattctcatttagaaagactgaattatggcttagggtcagaattctagaagtatggggtctcaaatataacttcaaacttttaaaaagcaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacaggttggtaaaattctcttatttgatgttaaagaaattagatggtaaattaacattcctatacttggaatattcgtcagttttatttcatatttctactttctttcaaaacttttattatggaaaatccagtacatatagaaaagttgaaaaggctaagaaaccccgtgtactcagcatcagcaattactaatatttggctaacctttttgtatttttaccccactcatataccccctcattatttgtttttgtttgttttgagatggagtcttgatgccacgcccaggctgcagtagagtgcagtgatctcagctcactgcaacctccgcttcccaggttcaagcgattctcctgcctcggccctgagtaggtgggactacaggcctgcgtcaccatgcccagctaatttttgtatttttagtggagacagggt

SEQ ID NO: 59019 - DNA, 1604 bp, Homo sapiens
ctgcactccagcctgggcgacagacagagcgagactttgtctcaaaaaacaaacaaacaaaaaaaaacgaaaaaaggaaacagtgagagacttcctctgatgaaaataactaatgtgttatttgctttgtaaacctagtggcggagaatgcaacagttgagctatgcactgttttgatccaacttgaagaagcaattaagcctcccactcttgtcaccatttacatgtacaagaaaactcctaagtacagaaagatggagggattaggaggggacaaatgatttttggatggattgcagatttttcctgttttgatacttgtttcactgttacaaaaagtgtattctgtattttatttctgtgtcttgtagactaggcacagttctttccctctttgacccacgcaggagccttccctggtctgtccttttcattacttctgtagttgggcactgtctagcttcttgagctacactagcttttcctttcttcacatcgtagaactgtgagaattgaccactgttgttgtaagctaaatgattttggacaatatagcggaattttagttcagaggactagtattttctgtctattgttagacataaatttttattaagctcttggtttggtctcccttttccttaggtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttt

SEQ ID NO: 59020 - DNA, 1077 bp, Homo sapiens
gtgtacaatttagcattttggtgtctttccaggttttttgttttgttttgtttttgtgtttttgttatttttagacagagtctcactctgttgcccaggctagcgtgcagtggcacaatctcggctcactccaacctccaccttccagattcaagcgattatcctgccccagcctcccgagtagctgggattgcaggcacccgccaccatgcccagctaatttttgtagttttagtagagacagggtttcaccatcttggccaggctggtatcgaactcctgacctcgtgatccgcccacctcggcctcccaaagtgctaggattacaggtgtgagccaccgtgcccagccccagttttatttttaagtgtgattttttactgtggtaatactgtatatggatgtggatatatgtagatcttaaggtgtttaatgctgtacatattcattcaacaaatactgtgcatttattatgtgccaggcattgttctaggctagataaaaaatttggaaaacaaatatttcagaagccttagttttttagttcatctgcctcaaccttattcagcagccatgctcgatgttctctcctttttgtatgttaaaattttctttaaaaatgtctgttaatgaaagctttaaatttatagcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtaagtatttttactttatttttatttatttatttattttgagacagagtttcactcttgtcgccaggctggagtgcaatggcgcaatctcggctcactgcaacctccacctcctgggttcaaacagttctcctacctcagcttcctaagtagctggaattacaggcatgcaccaccaagcccggctaattttgtattttttaggtagagacagggtttcgccatgtcaatcaggctggtctctaactcctgacctcaggtgatctacctgtcttggcct

SEQ ID NO: 59021 - DNA, 1694 bp, Homo sapiens
gccattcagatgattactgtatatttgacagtctaccaagcataatgatagattagtgtgagtgattttaaaagtatacatattattggcagttcaggtaagaagaattttttgtttttgcttttcctaagatgctgctgcatttgtatatgattttccaggtttctaggcaggttgttttctgtaggactaaattcaaatggctaattttaaattacctactaaaatctgtgacaaatttattgttacatttttgtttattaaatcttttctttctctttcagcaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtgtaagtgacatgttaaattgacaagcatacaaacttcatcctagtaactctttttgttttattttgtttttgtttttagagacagagtctcgctctgtcaccaggctggagtgcggtggtgcgatcttggctcactgtaatcttcagcctcctgggttcaagccatcctcctgcctcagcctcccaagtagctgggattacaggcacgcgccaccacacccagctaatttttttgtgtgtttagtagagacagggtttcaccatgttggccaggatggtctccatctcctgacctcatgatccgcccgcctcggcctcccaaagtgctgggattacaggcatgagccactgcgcctggcctttttttttgagacagagtctctctgtcgcccaggctagagtgcagtgcagtggcatagtctctgctcactgcaacctccatctccctggttcaaatgattctcctgcctcaacctcccgagtagttgggattacagacgcccaccaccacacctggctaatttttttgttgttgttgtatttttagtagacatggggtttcaccatgttggccaggctggccttgaactcctgacctcaggtgatccatccgcctctgcctcgcaaagtgctgggattttgggcatgagccaccatgcccagccccaatcctagtaactcttcatgccaatactctgaaaaagaggctttaccaaacttaatagatgtactaatgtacaatgtatagaccttatttggatcccggtttgaataaataaattggttaaagaaaaattttaaggcagttgaggcaaatgccaacactgactagatatttctgatatggctgggcgcagtggctcatgcctgtaatcccagcactttgggaggctgaggtgggtggatcacgaggtcaggagttcgagaccagcctgaccagcatggtgaaaccctgtctctactaataaaacaaaaaattagctgcgcgtggtggcacgcgcttgtagtcccagctactcaggaggctgaggcaggagaattgcttgcacctggcaggtggaggttgcagtgagccgaggttgcgccactgcactccagcctgggcgacagagtgagaccccatcccagaaaaaaaaaaaaagatacttctgatatgatgtcggtaatttgatttaaaagtatctggtgttaggg

SEQ ID NO: 59022 - DNA, 1778 bp, Homo sapiens
atgctcagggaggaggaagttcatcaaaaaagcagaaaagaagccataaagcaacagtggtaaacaacaaaaagaagggaaaaggcagtaagtgtgaaatctctaatttttaaaatataaaaataatagctgataattttacccccagtaagaaaatggtattcagggtatgggatagtacactattttgattttgtctgtacactcaaaaaaagtcacacaaattctgtaaggctacttgctttaaaaaacaaaatagacaaaaaaaaaacatgcactaggacaaatacctaatgtaaatgatgagttgatgggtgcagcaaaccaacatggcacatgtatacctatgtaacaaacctgcacattgtgcacacgtaccctagaacttaaagtataataataaaaagaaaaaagaatttctgcaaaaacaaacaaaacaaaacaaaaaaaacacaggttttctaatcttaggtaaattctagttttaagcaagttggtgttattcagcggtggtattgattgctgatgaaaaatcaagtaatctgtttttgaaataatagccaatatattataaacatcaacatatttgttacctttgtattccacagttcttttcacttgctataaaatgtatcacacattgtgaaatatttcaactacatgttatttttattacagtgaaattgattgcttagtaattcttcaaggcaaaatcagcatagaagtataacaatcaagataactttagaactataattccaacaactccagtctacaacatttgtctttggtactctatattatgtgacctgagagtaactacaaacaatactttttgctaagtatgctccaactttagcaacgactccgtgcatcaatccacagaaaatatatatactgtatttcttctgagggctgcacattttatctctcttttgtagacaaagtaagaagcagaaaatatgtaaagaattttttttcaggtgccccacactgacctcctgctgctcttccaggagactcctgccacctccactgcctgacctttgctagcagccggcttggctgcacttcagtgcagaaaagggttattcggccagctccccgaggttctgctgagcccatatgacttccaggcggtgaatatggcgtccctggggccccgggcggctgtgctcagcaaggccatgaaagccaggctgagacagtccactgcatagagtggggccaagccttgggtggcttagctaggagttgccaggggttccagagcagcagtgggggagctgggagggaatttgtgtatatgtgtcaaccagtggtggagtttctttattcccaaaatttcacagtgggaggagttgctgctatctacctttactatttggaataatttctggctttgagagtttaactcctttttttttttttttttttttttttttttttggtgatgttgttaagtgaaaaatcagtaaatatatgccaaatcagtcagtcatcaattgtttggtgtaactggtaggatatttaaagtgttttttctttcactgtgatgtttttgtcttcaagagtttactatttaaatgacatttcctaagagagcgcatcttcaatgagttatttagtatattcatataatacagagatatagtgttctcccattttacttattgggattctgccatggtaaatcagaatgagttaaccattcaagagaataatttagtaacatgaattaattctgatggaatctaaactaatactttgtatccaga

SEQ ID NO: 59023 - DNA, 1780 bp, Homo sapiens
agcttggatgacaaagtgagactcaaaaaaaaaaaaagaagaatattaacttggaggtagcacaatctgggattatatcctgactccactattttctcagatatattatgataaaaatattatacttatataaacttggagaagcttttttcttttttatttcagctttattaaggtacagtttacataaaagtgatgacttttatgtttaaaatgtgatgggttttgacaaaagtatacagtgttacaaccatcaccgtgatcgtaatagaacatttccatcattggaagagcctcttagcctctttgaaacccagtttctttgcatgttacatagagataaaagccagcaacctcgggtggctgtatacacaggacctaatatatacagtccctggcacatagaagacattgctagtgttcttatcatactcatcatttttttttctgttattttctagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaaggtgagaaggaaaatgtgtatgttgacttattttagggtttcccctcttaaagtttcaatgatttcacagtatctcttgttataacctgaggcgattaagtgtcatatttg

SEQ ID NO: 59024 - DNA, 1495 bp, Homo sapiens
ctcatttatatataactctgtgtttcacattctaaggaactgtcaaacttttccacagagacgacaccgttttacattctcaccagcaatgtgttagggttccaggttctctgcagccttgtcaacacttgttattctctgtttatctcattgtgcttttttgatttgcattttcctaatgcaacattttttcatgtacttgaaatgtagagttgaacattttttcatgtacttattagccatttgtatatcttctttagaggaacgtcccttcaagtttttgccatttttgaattggtcagttgttttgttgttgttgaattatagttcttcatatattctagatgttattcccttatcagatacatgattgcaaatgtttcttttgttgcctctgcttttgatgttatttccaaagaaacattgccaaatccagtgttctgaaaattttcctttatgttttcttctaagaactttatagttttagctgtaatgtttacattgttgttctaatctgagttcatatttgtatatgatatatgtgacctctttgggttacataaagagctcatctcttagcaaacaaaatggagtcgagactgagagactggaatgaatttgattggaaatattaattttctgttactttttagctattcttagtctccttttgtccttaaaaaatttttaagtcacttttcagcttaatttctttgttctttcctgctctaaaatgttttgtgtccttcattttttttctttcttatttccatgtaatctgatccctgctgtacttgagttgtgtatgccattggatttaggaatattgaaatagagtacaaagttgttctactcattttctttgaaataattgtcctggtaatgatagaaagcaaggtaccctgggaagttgtctgcgttgtttctatagtacagaagtcagaggcctataaaatgaccatttgacagtggtttccattatctgtaagtttgtattaaaagagagtggcttttgagttaaccatagattttgagtacaaatgaacataaacatttccttcatgaaaaaaagatgataattcagttatgtgttgtactcaaatgggctttaatttttctttgtgtattcatcttagaatgtttactaaacttggacctgtttcattcagtagtttcgtagattggcaggtacattgatatttttgtctaagtacgcacaaataactaattccatacatttatcaaatattaacaaagtacacttttggggaatttaaaaaacttagcatctgcattacaatatgcaattaatggcacagttaaccatttgcagttgtctttgtacgctttggtaaaatgctgtattagtgttcttattattacatattacctctgcctaaagacctatacttccgtttcattttatagcgttacattgcttaggaaaacctattgatataattactataccattccgttgagctgtttatgtcaa

SEQ ID NO: 59025 - DNA, 1045 bp, Homo sapiens
atttttgtatttttagtagagatggggtttctccatgtttgttaggctggtctcaaactcctgacctcaggtgatccacctgcctcagcctcccaaagtgctgggactacaggcatgagccaccgtgcccggccaaggcttattttctattaattggctctttaaacaaaaaaggcttagtagatataagaactgagtcattcatgaaactgttttacaattaagatatagctttgttttgttaagaaaagattgactaaaagaaagagaattccaggagtattttgattttagatggtagaaagaatctctagtaatttagtttttaaatagcaggaagggaaaggaaagaatttaaattgaggcattcaagtttttaataatatagggaggaaaatgcgacctagttcaacaagacatgcttgtgttactgtgaacgttgccatctatttctgagaactcaagtgcttgtatgctatgaactttcaaaagaagaaaacttaacatcttgatgaagacctgtaggatggatctctatacactccaacatcatggagaaaacaaatgtacttcagtagattaagcagttaatcttcttagagttaacataactattttatttctttctgcaataatcagtctgtcttattgataaataagcaataatttttatttttgcggctcctccagttctgaagctaatttaataaggactgcaacaaatcctcatcagctgtatgacaatttttcttttatttttagggtcttcagcttgatctctaaatttatacttaacagatgtgaaattggaaatgaagatttatgcgtggaggttcatgaaaatagttttatcttcagtggtagtcattcatgacaagcagtttgggagatttgtgtggacctatttccatggtttttttaatctgaaacaagtatttcagattaaaaaaaaagagagagacagacaggaccttgttctgtcacccaggctggagtgcagtggtgcaatcatggctctccagcctcgacttcttgggctcgagtg

SEQ ID NO: 59026 - DNA, 1828 bp, Homo sapiens
taaaacatgaaaaaattgttagagttgaccatacttgcttcttgctgttcggcacaaattctgttcttctgacttttggaaattttcttttactgcacttatttttgaatcttcattttctctaaatgtgtctttctgtaaccttggttgtcttacagttttagtttttaatagtaaaatgaaactctgagaatttcatacacgtggaacctgcttttcctggaacaatcacagccacaacttttatcaatatatgtggtttggaactgaaaaacttatgaagtgtcttttattaactctgcaattttttaaacctttcaagagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgaggtaacttgagttttagctagtgattattacctaaaaacaattataaaatacttttctatttaaaaacttaagtaatggattacagatttattagtattctaattgaggtcatagtaccttataaaaaatagtttttagcatgtaaatacctcacttagtgacttacaattaatgttttcactacttagaagatatccctaatgtctagaaaaccgaggtctacacacttgatttttatgtactacatgtagatcagcagacaaaacattgttgaaatgatcagaacttctggacatctacaaaccaattatcaggctgcttgctgtcttgcattttaaactacattgccacagtaacctcttttttgtattctgaagtcatttctttccttctgtagtcagggatttaaaatcctaggaaacattagctattttaagaaagccttatctccttattaacagctattgcattacagccttattcagaagtctcagaaatttattagtatctttgaaaaaatctggttgaacatgtaagcagacctgcttcactaaaatagaatgcactttttgactgctcctaacctagggaactgaaaggcaagagtgaaatttggttttaagtcatgttcaatgacttaagcatttttcttagataaattttctttggctttccaaagaaattttgtattttgattttatccaaaattggcaagccagttttgggatctattcattcagttatcttttaagaatcatttattttagaatatttgatagtatatttgaaatgtagcctataagacagatacctggaaagattaaccatagaagtttaagttgtggtttcatggtgtacctagtgtcttcaaggaggaatacagttctcatgctttatacttaaattatattctgtggtttgggaagttaataggaaggcatcatctcaaattctgtgtttgagtgttgcaaatgaaattttgattctctttaatcacttcccacaatgccctttctctaaagaaaatcacttctgagagttttgaggctgtccttactaacttttcattctactttcacatacatataaatgtactcatagaaaatatatagtattcttacatgcatgtgttttaaataaattatactatacaaaattctgtttcttaaattttttgttgtcctgttgtgtaataggaagctcatgatctaatctgattacctttcttattttgagaaaagtaccagt

SEQ ID NO: 59027 - DNA, 3864 bp, Homo sapiens
aacaaaaaaaggatgctgctgtgtgccccagggttactgtagtgactaaatgagatttactaaggagtccagcctcacacataagaaatgtgcaaaaaatagatgctattactaatacttttaatagctgttattgttatgactctgagcacagtgttttaaatgaattttttgacaaaattttttttttgcattgaaaagattagaaagaactagaataaattagaatgttaatatggctcaatatctgagagtttagacaaaagaaatgaatacacattaaaaataactctatagttatattttgaaatgttttcaccaaatgtaatttctcttcatgtttccagatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctggtaaatcagatattgttaattgtcttttgctttctttggtatattttccatatcctctataaagttccaaaatcaatatattgtataatattattctttattatttgtttattttcttcattaagtgctacttttgtataatttttatcataacttcaaaatagctgttagctatttttgtctagagctttaaagtagcaggagtttcttaaaagtaatttataacttttaatattagaattggttgatacctcctgttgctaagagataaaccatggatataggttgaaaatttttacttttgttggtttctttcctctgatctttttctagggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctgggtaagaaaattgtttttggttacgatgcatttcagcttgatggattcttatcatttgctctttgtatgtgtttatgtatgaatctaaattaattgacaaaatattaaataatagagtgattggcatttattaattaaatagcattcacttctttcagagaccctactgatagaaatttgtagagaaagatcatactttgatccacccttcttgctctcatcatggaaattgataaaatttttagctagagcaaagtactttttaggtctgctgaattacttgataatataaacttggggctatgtccatgttttatatattgtatgttggctatagattctgagagttgtatttatttcttaagcaaaagcaagagtggaaaaatactaaagttttaaaaggccaaaaattgtatgttctattttatgtgatagtagcatttgtttgttttagtcacttggaatgatgaattatttgacaatgtaatttatgcactgctagtggacccctggattttatagataatctttggcattgaatcttttttctgaggcttaaaaaacataaacatatctgttagtgtctcatttaaataagtacaatgaattaaaaaaaaaatcatttagcaggccaggtgcggtggttcacgcctgtaatcccagcacttttgggagaccggggcgggcagatcacttgatgtcgggatttcaagaccagcctggccaacataccgaaaccctgtctcttctaaaaatacaaagaagtcaggcgtggtgacatgtgcccataatcccagctactcaggagggtgaggcaggagaatctcttgaaccctggaggcagaggttgcagtgagctgagatcgtaccactgtaggccagcttgggggatcgagtgagactctgtctcaaaaaaaaaaaaaaaaaaatcatttagcgtactgacatttggccacagtatgcagacgaacagggaaggggaaaataaaaaatggggcttatatgaatatagtaaaaaatgtttattatactttgttgtatttttgtgtataaaaatatatatttgaagtatgccttactgctgttggagactatttcaagtattaagaaacagtaaagatttcagctttttgcctaaaatcttttgattgatcagagttctgaaattttggtggcaccatacaaacatggaagaaaaacatcctgggtttagaagaatgtagtaaaagtgtttgttgattatactttgttatatttctatgtgtagaagtgtatgtttaaagtactgctaaaggagatcattttgataagaatcttaataaagattcagctttttaccaaaaaatctgatttttaaatctgcagatgtttctggaacatctgctgtttgcaaggcactgtgataaatctgtatttttttctttgctaattttttaagttggtgcttctgcttattttatagaataaactgtattttgtaggtttttaacaacccctttaactgtataattatatggatttttatgtactacagatatttattagtatatgcgtacctcaaactaaaattttcctgatgtgactgccctagtttggtagatattttttagaagcattgcagttgggactgtttatatagtactccctgcttttccacagtttcagttacctgtggtcaactgtggtctgaaaacaggtgagtacagtgcaataaaatattttgagagagtgagacaagaccatattcacataactgttattatagcatattataattgctttgttattagtcattgcttatctcatgctgtgccttattaataaattaaactttatcagaggtatgtatgtataggaaaaaacacagtatatataaggtttggtactatccacggtttcaggcatccactggggatcttggactgtatcccttgcagataagaggggcttactgtaattgatttttgagttttattagataattgcagtggaaaattttacagtgataattaatatataggtatttttctggcatataaactttctctaagtaataggctactaccaagaatgttcagtgtccttcttccattgtccagatgtgggagattgaagaagttgatatatgtaaaatgtctagttcagtgccttggccatagcacgtacttaatacactatcttttttaaaatttttgtttcattgtaaagagtgtaatatcaagtagggaagatttgatatttctttgtgaattcagatgaaaatccttgctgatacatttcgtttcccaagatattcttctctaaaatatgactagcttaaatgcatatgtgtgtgtatgtatgtatgtatgtatgtgagtgtatgtatgtatatgagtgcatgtatgtagtgtatgcatcaacttaattttttttaacctgtatgtatgttggttgcattttatactttcagaggctctctttcttggcattctgtgttccatctggtttagcacattagtcttgaatttgccactgaagtcttagagagtagaatagttttctttggttgattgccagtaattatgttgtttttttctttatacttcagtgtattattaaagtgaatttcatttggtttgtgtctgagggtgatattaaatgtatatttttaatttttgattgcttgatttcattaataaaagagtgttgggtttttgttgtagattgaatgaaaatttgcctgggctactacttaaagtatgattgtgcttgctgttggcatt

SEQ ID NO: 59028 - DNA, 1025 bp, Homo sapiens
caggggattgctggagcccaggactttgagacccgcctgggcaacatggtgagactccatctccacaaaaaaaattttttaattagccaggtgtggtggtgtgcatctatagtcccagctacttgggttgttgagtcaggaagatcccttgagcccggaagttcagggctgcagtgagctgtgtttgtgccactgttgctgcactttagcctaggcaatagaataagatcctgtctccaaaaaaaaaaaaaaaaaaaaaaaaaaaaaaaaaatagtcaaatgacttaatatttcaacatttataattttctgatatttgttagagtactaaaacctttatttttaaaccaaatttagaatttatcaagtttttaaaaattcttttgagtctaggaccaataaatataaaaatatactcatatatactgtgtctatcaaaatgttattatattaacaccttttaatttgagagtttttgtttcactttgtccattagattgaaagtggagctgtttggaaacaagtctaccaagatcttggaatccctgtcttaaattcagctgcaggatacaatgttaaatgtgcttataaaaagtaagttagtataattgatatgattatcttcagtatttttacctagaaagcaggatgaaatttaccttataactgaggttaattatttctttaaagaaatcagaacattttactagagtagtcattctatgatagtattttctaaagtgtattctatgatactagatctatgagaaattctgtgaagaaagtttttgtggctaagtacatttgtcaagtacttcatagaggttaaaaagctaatattctgaagtcaagtaaatccacatttgaatcctagttctgccaattattaactgtttatgccctagggccagttatttattctcctaagcctcagtttcttcatttgtaaaatggaatgcttggccaggcacggtggctcatgcctgtaacttcagcactttgggaggccgaggcgggcagatcac

SEQ ID NO: 59029 - DNA, 1050 bp, Homo sapiens
aatatggctcaaagagctcaaattttggattttattttacctggagctttagatctggcagtgacaaggtactctttaatggtttgctgaacagcctcgtaaaagttaatgagtggtgcagatagtgaaggctgctatatttgaccatgaaatgaaatgtatttaatgtgtttagtaaattaattggtcagtatgtaatactttaggtaagttatgaaattctgccttttaactgtagtaaagtattaatgaaatgagattgttttggaggttatattttagggtgtagtgatctgtaatgacaatgtataatgtagaaatttccctgcttcagtcttctccctgactgctttctatttaaattgctaaaatcagcaatcattcccttgctgctaaaaacctcctgagtagctttttgtcactgtaaaagttaagctttcatatagaatctcctttatagtccaattcctgcctcaattttttctcatcatttccctttctgtgtcctcccccttgaactttatgctatagcaatgtcaaattacatatgttgctgctactcacctttgcatatgctagtacctctgtaggcaccaccttttcctcccctccttccttagtcagcatggtacattcctgttcaattttcagaaccctacttaggtgccatctctctaaagagaaacctgtgaaccatcacctccctcacctcaggaaagcaccagttcatttgctagtctaaactactactgctcctggcaggcacggtgggtcatgcctgtaatcccagcactttgggaagctgacgctagcggatcacctgaggtcaggagtttgagaccagtctggccaacatggtgaaaccccgtctgtactaaaaatacaaaaattagctgggtgtggctgggcgcggtggctcacgcctgtaatcccagcactttgggaggccaaggcaggcagatcacctgaggtcaggagatcgagaccatcctggctaacatggtgaaaccctgtctctactaaaaacaccaaaaaattagccgggcatgg

SEQ ID NO: 59030 - DNA, 1087 bp, Homo sapiens
taattgtgtctagctaattttagttgaaggtaattgttaccatagttttaattgaagttcaactgaaaatgtaaaaatcatgtgtggtcagttttcaggtattgtatatttattttaatggctctgtgcctggtattaatactgtttgataattgtttgttgcataagatattacatgatttcctgtattaaaggtttttactagtgaagcttaatctttgtttaaaagaataaaactgctgttcttttatttatttaaacttaagtaatcttccaatggtggcagttttgccatctataaaatgactacctaatgcataggatggataggattaaatatattgctacatttaaaagcacttaacacagtttctggtacatagcaaacaataaatgtcagtggtattagcacagtagtttttatttctttatcgtgtttaatactttttgagaaaacaattgtcttaatttcttcagttcatgtaccttgtggtctgtttccagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagtaagtgaaaacagttgataccttttaaaattataaataacagttgggtttcccttgtgggttaggatttggcattaagtcattactcatataagtatttttagtatgagaaatatttcataatcttgtatttgagatcctcataatcagatagtttacttggttactttagatatatgatcttgtgaaatagaaaatattaagcctgattttcctaataacctcaaaaacatgtcttagtcttcctatgctttttttaatgagatgattaagaaagtatccaccaggctgggcgcagtggctcaggcctgtaatcccagcactttgggaggccaaggcaggcggatcacgaggtcaggagatcgagaccatcctggctaacacagcgaaaccccgtctttactaaaaatacaaaaaattagccgggg

SEQ ID NO: 59031 - DNA, 1597 bp, Homo sapiens
tgacggttactttgtcatacttttggaaaggcatcaaagacaacttcagagtatactagatagtatactaaataggtaaatcatgtttaaagttttttagtagtttaatctgtcagttttccttttttgggcagtgaaactgatcattgcaaactatctgaaaaacacttttatctttgtaggtattcaataatagccattctaaaaaggacatatgttgttgtccatcaaacatttcctagtctttactcattctgggcattttctttggtgctgattctttattagaatcagattcaaattggaatagctttttgttttgttttcctttttactacactttcctcaaacatcaagttgatggtttcagatacttcctttttcttctgacagttatctttctaatttactagtccaatatttaatgttactgaaaggattttctgtttttcttttaattttgaaagtttttagcatcatacaaaagaggcttattggacattttatgaatacctaattggtgtgtatttgttgttatggatagcagtggtgatctcttttcagattgcctcctcttcccaacctaacctcagttaataaaggtctgctctcctaccttttaaaattaactttgtactggagatatagaattactgtctccagaattcctttaatttgagattgggattgtgtatattttagtgtaatactgggatgtttaatatggggccttcacctttttgaggatttgggaaccagttatttgtcctgatcttcctcctcaattttttacagtagcactaaataaaccagaaatatttttgggaaaatgatgtgctttcctctcatgataaactcttgctgttattttttagaaatttagaaaatgatttaagatttaaattagccattttacaggtcttaggaaatgtaataagagtttgggaatacctatattcatcattggcatgcttattctttgtgaggataaatggaaatattttatttttttctctccctagaccagaggaagagtcttcatcatcctccagtgatgaagatgaggatgataggaaacagattgatgagctactaggcaaagttgtatgtgtagattacattagtttggataaaaagaaagcactgtggtttcctgcattggtgagtagcttcagtatacaagagtttaatttcaaactttataagtttatgaagaaaacaattttcttactaatgtttttcataggtacaaaatgaggaaatgtttttagcattatttagttcacactaagcttactttcaacgttgtctttgaatacaaagaactcttgatgtcattcaggaaaggcaaaatcttgataatcttagaggtttagctatgtggaagttgaattctctctctctcggtagaaaattcatgatgcaaacttttaaagctcctaagtccatgtaggtctagattgcaaaagaacaacagaatctttcttggttgacagggataactagaccttttcctcatacttagtgaatcagggtgtttccatccttgatcttaatcttgccttttaggtactccctatataatcatgactgcaat

SEQ ID NO: 59032 - DNA, 1828 bp, Homo sapiens
catttaaatgttttcctcttgaaataccaacttcttatttttatttggtatatcctgttttatacaagatgttttcatttcatatatgttgtttctttttcactagaaattggaaaagttactttaataactctatatttgaagttactcactagaaaacataaaatgtgaattgaattccaaatgtagtcttaaatagtagatctgtttgcactcagaaaattgtaatacatgtcatctctttgatctttgaaaaaatccttcagtagcttccatttttaccccctctcatagtttttgatgacggagatgagaagacactgagacgatcttcactgtgcctgaaaggagagaggcattttgctgaaagtgaagtaagtcatcatttaacaaatgaacatgtcttaatattttttattgggaggaataaatttttgctttctcaactcagtaaacctacttcctaatcaggaaagttcattaatacacaatacccttatgatgtaatctgtgaagcctgtttaaggccctgtgtttgagcaccaggttctgtcttcttttttgtctatgtaaagtgtttcagtatttgtccacagagaaaatacaatgggctttaattattatctttaggcagtttttaaacagacttaaaatttgtaaataactagaaaacagatttctgatttgtaatctacttgatccttgtcgtagttaaaggatgtgtagatacaacagtctttaactactgctactgctattagctgatattattatgccctttcctcttgcctgactgcccttcctaaaattgtcccttccattccttatcatcctttcagattgatttaggtcttattccctaacatcaaaatatgagtacataattatttattgtctgccttcctcactagaatgtgtcacacggtcagagactttgtatatcttcttcatggctttgttcctagttgctgtaacagtgcctgatgcagagtatgaacttcataagtgttagttggatgaatagatgaggtgcttataattgccagggattttgctaagtgctttacatacattattgtatttgcaacattatgaggtagttactattattatccccaactttcagattaggaaatggatagctagagctggttttctaaccagcactttctagcaccaaagccatatccttaaattgaaagatgttactaagagcagagggttcacaaagttttgtaactaactcgcttgcaattcagaatttaaaaggtagatgttgctctaaatggtgttacgttctctaatccagtctacagatattcattgatacacagtgtggccgagctatttcttttctctactcactatttggaatagtgtttctttggggatattttaatattactaattaatattacttatttgttattatttattactttaatattactttaatattacttatttagtagtgttattacttaaacactatttggaatagtgtttctttggggatattttaatattacttattaacctattagactttatgtttttgttttgaaaaatttttgcttctcttaatgattgaattcccacttaaatttagaatttggacaggttctctgtattataattccagcctatccctttagtctcatattcaaccacttccctgtacttctgccttattagactgcttggtattttcagactatggtccatactttcctttattgactcctttcctcttgttggaatctcacttatgttgaaggccattataaatgcttcctcctctatgtctttcgtgagctctctacccaaa

SEQ ID NO: 59033 - DNA, 1055 bp, Homo sapiens
ttcgatgtcatttgctctatatctaatttatctttttctctgtgtgtgtgtatacacagagagagatatatacacagatttgtatgtgtgtgtatatatatgtgtgtatatatacacatatatattgtatacatatatgtgtacatatgtatgtactcattatcattacgttcaaactttttaagagcaagcttaaaacacaatgttctgtcacccattgtactccagtgtgtaattcctgataaatagaacagaataacttcaacttcggtctgtctactttttctcatttccagttactcttggcagatataccacagaaagttgctcttttgatattacagtgcaaaacgttgcacaattacaccactaaaaataattcagtagtattcaaagatgatgtgaatattctgttcatcaaaccacctgtcagcttagcatcttttgatagctctctgaatcagccacctttatgatggttgccaaacgctgattctctgtcagttctgttacagttattaacattttagtataaggaaaagctttatcttttctacattttaaaacattcattcattcattcttgtcaatatggactcacggatttcatttttactgaatgcattgtaatttgttaccaactttttaaagtgagatataattaatttactgtggaatacacagatcttaagttgatcagtttgacatacatatatatccctaaggagataatagcacaaataatatttattttaatgctcaaactttcccccatttgaccagtaagaggaaaaccccttcaagatgcttcctgtgtctgtttgaaatgtccctatcattaatcgcaccatttctttactttctgacacaagatgtttcagattcttcttgtgcttttctctgtccaaccttgaaatcaaccatttttctaaggatcctaattccttataatggagagagttatttagaaatcaagacgtgggccgaggcgggtggatcacgaagtcgggagtttgagaccagcctgaccaacatggtgaaatcccgtctctact

SEQ ID NO: 59034 - DNA, 1004 bp, Homo sapiens
tgtaaaattcccatgtacaggaataccaaatacagtgtgccaaaagtggtaggacaattgaagacttcattgtcaaccctgctgtgttgtgcagctgccacttttccctcagaatgtgtgtgttcacaaggtgtgttgcttttgtagatcaacataagaaatacttactagtaaagtttatttcttatctgtttttaagataagtaaattaacagttcactattttttgtgtgtgctcagttaatcttcctcatatcacctggaatttatcatctcccttgggtaatcacagtctagtagattctctcttcaccattttcttagggaaaatggattggcaagggaaatgctagactattttaagggatttattggcttttctgtcccactgggaatgcttataggaggggatgccatgaaatgtttttcatgatctcagtggggatcagaaaattccagcagaacggaggctaggtgggcatggttaacacatttaggtaggagggcatgtttgataatgaaattctgaaaatgtttgcatgtgcattgagatccctaggtagataagtaacctagtaacttatttgattggtatagttttttaaaactccaggtctgatgataatctaatataaactattctattgaatgctttgaaattgagtctgtttagttctgagaggccattgaaagaaggcaagaccgagtatcctggaaggcctgttacatacccctgtatgtagcatggccctttctacttgcctttgctaatgatactttgtgtgtgtacatttacttaaatagctgtgcagtgggataggggaataatactcaggttttaaaatctgattttggctctgacttaaccattaattactggtgactcaaaagaataccactgtgacctaccagtaagagtaggtgcatatggagagtcaggaaatagcattttgatagagttttgacttaaatatgtttccttacactcatcttgaaattgtttc

SEQ ID NO: 59035 - DNA, 1285 bp, Homo sapiens
aggtggctcactcctgtaacctaagcactctgggaggctgaggtgggcggatcacttgagcccaggagttcgagactagcctgggcaacatggcaaaaccctgtctctacaaaaagctcaaaaaaattagccaggcatggtggtgtgtgcctatagtcccaactacttgggaagatcacccgagcctggaggtcaaggctgcagtgagttgagattgtgccactgcaccctagcctgggtgatagagtgagaccctgtctcaaaaaaaaagagaagaataaattttcaattcatactgatatttccagttttcatgaaaaattacagaggttttgtttaacttattttatgatttatttatttattttatggtgaaaaatatgtctatttagtgttagccagctgggctcactttagatgatcccaattttgttggcaacgtcatcatagtcaggaaccggtagaacatgggccttctttccatcaggcctgatcagggtgttgatattggccatgtcagtgccacagagctttttcttagcctgtttgatctggtatttgttggccttgacatccacagtgaacacaagaatgttgttgactttctgttcttttcatggctgactcagtggtcaggggaaacttgatagcatagtggtcaagctggtttctcctggactggaccagtcttccaaggatatttgggctgcctccagaacagcagcagtgttttgggctgtccttaggtgggtgacgtgaagatcttctcttttttgtgtggctgtggatacggatacctttcagcactgctgttttggcctttagagcctttggtttggctttgacgttgggagagcaggggcttccctctttgcctgtgatgccttcttgatgagtacagccatgtaacttcttttatagttgtgtctttttttttttttgggacgtagtctcgctctgttgtccaggctggagtgcagtggcgtgatcttggctcaccgcaacctccacctcccaggttcaagcgattcccctgcctcagcctcccgagtagctgggattataggcaccctccaccatgcctggctaatttttgtatttttagtagagtcagggtttcactatattggccaggctgatctcgaactcctgacctccggatccgcctgccttggcctcccaaagtgctgggattacaggcgtgagcctccgtgcctggccttttttttttttaaattgagatggagtcttgctttgtccccccgcaggctagagtgcagtggca

SEQ ID NO: 59036 - DNA, 1062 bp, Homo sapiens
ggaggagttttgaacaaatccggaagtcagaggtctgacgtgggtctcactgggcatttcttcttcaggctctaggggagaattggtttccttgcctcttttccagcttctagaggctgtatttcctcctttgcctctggtctctcctattttcaaagccagcagcctggtgtcttcaaatctgtctctgacactatctctcctgcctccctctttcacttataagtatccttgtgtttatattaaatagggctcacccagataatacaagctaatctccccctttcaaggtcaactaattagcaactctgattccatgtcagctttaaatttccccttgatagataacattttcacatgttttggagattcggatgtggtcattttgtggggagggggagtgcattctgcctaccagagtttccttagtgtggcaaaatgatttagcttcttaggcctcgctataaaatgagattagtatttactatttaccacaaaggaattttatgaagatggaaattacgtactaatacagacaggccatgcatagaatacacttaattagcagatgctttctgcttgatcttatctgctaggtatatgcttgtggtgatgggtagtctccaaggtaaccactgggtttgataaactccaatttgagtgcctgactcttctaaaggcagatgtttgttttagaattcagcctttccagacctttgcatgatgaggatggtgatgatttatagcacaatggtggaaaaacagatgagtgccccttaactcttaatttgttttatgatttgaatctgtcttaatctctaagatacagttcactttttaagtaggcagcttttctgtttaacatgattttctaaaggattgctatagaagataatgaaaagggaccttgagtaattgcacttttaaatcacacaagattgttttgtatgtgctcagatggtattttttgaagttaatgttgtcatttcttttctttttttttattttcgggacagggtcttcctctgttgcccaggctggagtgctgtggtgtgatcttgg

SEQ ID NO: 59037 - DNA, 1097 bp, Homo sapiens
agccaggagtggtggcctgtgactgtatttccagctactcaggaagttgaggctgggaggattgcttgaacccaggatgtcaagtctgcagtggagctgtgattgcagccactgtactccagcctaggtgacagagcaagaccccgttttaaaaacaaaatcaaaaacacgttaattttggaatggatctctataggaagtgtccccagcatatgctcaaagtcagaatatatagtttataaggaattctttaaccgtacagttatatggcacattacgtttttaaagttccataatcattagttatatctaataacatccctttgaggcaggtcagcaacatttttccctttttatggtcgaagaagcaggtgtaaagatgttgagtgatttgcccacaggcacacattaaactgatcacagagcctgttcttttgttagtaaactgaaccatgctgcctctctactagttattataaataaataataaagttgttgccatttagtgactttttgatggctttattgaatagtaagtgtagtttacaaaccttttgcctacttactttgttgaaaaagttttaaatttagaatttacttgtatcatggtatgaaacatttttatgtaaatttccctgtttctttttttttatttttttttattgatcattcttgggtgtttctcacagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaaggagcatgctgccttcaagcatctgtttaacaaagcacatcttgcacctcccttaatccatttaaccctgagtggacacagcacatgtttcagagagcacagggttgggggtaagtaaggtcacagatcaacaggatcccaaggccgaagaatttttcttagtacagaacaaaaggaaaagtctcccatgtctacttctttctacacagacacggcaaccatctgatttctcaatcttttccccacctt

SEQ ID NO: 59038 - DNA, 1013 bp, Homo sapiens
taaaacctttgagcaagtggtatttaaagaaaggatttactttatattgatagccaaaataatgtatataccgaaatatatataaatacgtatttataaacatattttactgatagtaaaatgttatatatattgttatatatcatttaagataatttatatgtaaattaaatataaaccagatttctttattccaggaaccttgctgttgtttctaacctttcttttcctgctacttagtgatgcagaagcttttcttggtaaatctacttgtcccctctcttaatttactgcttgaatatgactgtgaaaactgtctttgtttaaagtgcccagtaaacattgtagcttcatgattaagagcatatggcttggaaagtcagtggtcttatttccagtcctttttatgtcctttacttggctgctgaggtttgggtaaagttactgtttttgaaatgaaagtaaacatcagtttcaatttttgtaaaatgagaataataacagctaccttgtaaagttgtgtaaatatgaaatgaaataccatatttaaaatgctttacactgtgcttggcatagttctgagcagttagtacgtggcagttgtattattagaggaagcctgtcttgtttttttttaaataagctgatagagtgaggattcttttaatcaagactgtttgggattgaattgccactcctgcttaccagagtgtaggcagtttttcttaaactttccaagaagactggtgtcctcatctaaaatacgaaatgcttacagtaattgcctcatggggttgtttggggtgactaaatgtagtaggatttactacatagtaagttctcaatacattgtagctattattattagttcggtagaaagaatgtgcagattcttatgagtttaagtaggctttcggggagatagattgactctggtcttttaaaagttaattttgaagttgcagttttgtgattaagccttaaatctgttattctttccttctgaaatcctt

SEQ ID NO: 59039 - DNA, 1005 bp, Homo sapiens
tttaatgccctgtgtgtgtgtacatgttctctctctctctccccctacctctacctttgtttgtctccctatccactctgtcagttcgttcccccctctctgttcttttccttccccctcttccttctgtctcacccctttcataagtcattcatttaacaacaacccgtttcatatatcaggtaatatagaatgaaggtgggtgaggcatctgacctgctttcagggagcccacagtgtagcagaagatgcagataaataaagcaaaactcctagcatatctatttatgagtattccaacataaaataattgtaggaaatgctatgagaggacagaagaggacagctaaatcagagagctatggaaagttttctggtggagttgacatctaagctgagtgcgaaggcttttgctaggcaaagaagggaagaaaagtttttcagatagaggataacgtactggaaaatgaacgaaacaaggtgaagtatctggaaactgtaagtaatttggtgtgactgaattaacttaaagcatgatatgtttgggtaggaataaaagggcagtggtgggagatgaagctgagtgagggagtcgaaaattttcttggccaggcatggtgtctcacacctgtaatcccagcactttgggaggttgaggcaggtggatcacctgagttctataccagcctggccaacatggtgaaaccctgtttctactaaaaatacaaaattagcagggcatggtggtgtgagcctgtaatgccagctattagggaggctgaggcagaagaatagcttgaacacgggaggtggaggttacagtgagccgagatcatgccattgcactccagcctgggtgacaagagcaatactctgtctcaaaaaaaaaaaaattttttcttgaaaactacatggaaccattgaaagttgttgagaattgcttgaacccaggagctggaggttgcggtgagctgagatcaggccactgcaaaaacaaggggagag

SEQ ID NO: 59040 - DNA, 1145 bp, Homo sapiens
tttgtttctttttctgtgtgttcccaatttctttcgttcttttttatttttctttttgatatagagtctcactatttcaccctggctggcacgatctgtaactgctgcctcctgggctcaaataatcctcccacctcagcctcctgagtagctgggactacaggcacacctggctaatttttgtagtttttgtagagatgaggttttgccgtgttgcccaggctggtgtcgaacttctgggctcaggtgactctcccgccttagcctcccaaagtgctgggattacaggcgagagtcaccgtgcctggtgtaatttctgtattacgatgatcattgagctacagaaggttttatgccatttattggatcttaccaaacatatttgtacttgggagcaagcttttaagtttgaattgtctgttgtattaacgacaacaaatctttaaattttattaagtgacagtttattgaggtgattgaaagttagattatgtagtaatactttttaggtgttgttttaaagttgaagtgttgtatgttttagcagttttcccatgtactacctttaagaatttatgtaaacaaatacattcccattactgtctaatatatgctatgttacttttttcacagtatgtttttgaggaatatgattcgtaatacataaggaatttgtgctgtaacatagatcgtgatgttggtgttatgttgaatttatttttcatgctcttgatagacttttaaaaatcagtggtgccggctgggcatggtggctcacgcctgtaatcacagcactttgggaggccgaggtaggaggatcacctgaggtcaagggagtttgagaccagcctggccagcgtagtaaaaccctgtctcttctaaaaatacaaaattagctgggcatggtggcacacacctgtaatcccagctattcggaaggctgaggcaggagaactgcttgaacccaggaggcggaggttgcagtgagctgaggttgcgccactgaactccagcctcggcgaaaaaagtgaaactctctctctcaaaaaaaaaaaaactaaataaaataaaataaaaatcagcagtaccacattataaggaggtggtagattattaaagtttgtaaataattccaagacttattt

SEQ ID NO: 59041 - DNA, 2092 bp, Homo sapiens
aggggctctgtggcgggccggtcctgcccgcggcccacaggccctcctggcccctcggtggcccccggccggcctctcgctcggacgcggcgcgtgggggcgcggattcgctcggccgggcgccgaggccctaggggagagcggccggccctgcgccggacgccgggcttgttgtgagtttcttctctgacagaaatggcgtcattgtcgtagacgggaaactccgtcgggtctcgacaatggggacgggaagctgccgagctgtgtaggtggttgggtttgcggggatggcggggccggagggagccccgagtcggcgtgtgatggttcgggggctggcgcctggttgcggctctttcttcggggttcggacgtcgctcgcttctttccctccgcctccgccagtgcagaggggctcctgtggtgttgactgggtgtcttttgtttcccctccaggtgcagctgaacctggtgttttagaggataccttggtcccagagtcatcatgaaggtaagattgcctgcggaaaacgaatctctggggttatcgaattcaggaagtaggaggtttcgacgaggtcgtcgtgtggggcttccgagttttgcagaggaaggtgtgtttggtgacttggtgaccgagcccttccccagagagaccggggtcagctggcgggctttgctgtggagttggaggcagttataggatgtctcaactgaagatgattctcccatattgaacatctctttttgtagggaatgagaggaataacggcatgaattaaagtgttttaaaaggtaaaataaaaagcaagtcaggtaatctgaccctagaaactgaactgtattgtggttctatcagttacactgatgaaagagaatcttatttattgtgtgaacagtactgtaaaattttagcagaaaactctttgactcgtcacaaaaataatttaattgaaagatttaaaaagagaatttttgtgattttttacacaattcagagataccagttgtttcttgtatttccagtgacttggggttatatggtttatttttctttattgatctggttggtctgtaaataagtcagaggctctgttgcattatgatgtgtggaaaactgatggccaggttcctcttagatgtcaatatgttaactgagtggagaatagggtcaaaaaatttgcttaattgttggaagaaatgataacgataaaaatacaggtatttttgttacttgagagaatatgtatatgaatgctgtcttttttttttttaaacacatgctagaataaaaccttagatttttgaaaagtctggattcaactggtggaacttagacactagcttgtattttttcatccattacaaattcagaagtgcttgaaaagggtagagtgttcacaagtgtagaaatgcaacagatagcatgttagaatatcaacgttgtctacttttgacagttcctttgaactatttaaaaaaatatttcacttgtcctcagaatcaagactgctttgacaattttgcatccaaattaaaatttgtaatacttgtggttgtagaaggtaaaagctgtggctacttaaatcttggtctactatacagagtaattaagtttagtctaatttttttaaggttttctctttgagtttgggatgctgtaaactacctgaaacagtttattcctatctcatttcatgaagcatagacatgtttcaggaatgaatcccttttgttagtcacaaatcctagctataactctcatcacctgtgtaaaacagtggtgaaagtgcatttattaggtaactcgtatatgtaccttgatgttgggtgagaatttcttaagaaaagttttggtttgagtaagaaataataagttcagaagccgaataaataaaaggtttagtttggagtaaatgtaatgtgtcacatttcccagtgttgtagtgcttgtcacttcttaggtgctctataaatgtttggttaaaagaaatgtagttaagttgaaagtctgagattaaaatgttttttttcttcctttcgtttcctttttttttttaagtagtctgtttaaaaaaatgaaagtatgttg

SEQ ID NO: 59042 - DNA, 1086 bp, Homo sapiens
ctaggttccccccctttctcccctcccctagattttttttccccccctcccctacctctttcccggatggcctcttagacgaccttggattggttaaagttctttagaacccgcctatacactgttcctattggtccctggatacaaacaacgacgccattttcccaccagttctatggaaacagaaagttacgcctcaaggctttctgggaaataaagtccatactctggggccaacgcgcaaatcctcgtccgcgagaactgcaaggcccgcaatgccctgcgcctgcgtggaccggtgcgggggcgggggggaggtgaaaggggcggggcaacaaagcagtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcttttgcatgggatgttcacttcttagacgcaaggttgtgtgccctggtttcatcgt

SEQ ID NO: 59043 - DNA, 1035 bp, Homo sapiens
accgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccac

SEQ ID NO: 59044 - DNA, 1768 bp, Homo sapiens
tagttcttgattgaatttagtcctcatgcaagatattattttatattgaggttgctaaatatttattagttgtgaaaattaacacacctgagactttcataatctgttaattaaactgagtaagttttgaatagttcaaataagtgaaattttcaatttttttattagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttcc

SEQ ID NO: 59045 - DNA, 1035 bp, Homo sapiens
tggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatctt

SEQ ID NO: 59046 - DNA, 2080 bp, Homo sapiens
tttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagt

SEQ ID NO: 59047 - DNA, 1460 bp, Homo sapiens
aggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctc

SEQ ID NO: 59048 - DNA, 1040 bp, Homo sapiens
agtgattctcctgcctcagcctctggaatagctgggattacaggtgcatgccacaatgcctggctaatttttttgtatttttagtagagacggggtttcgccgtgttagccaggatggtctcgatctcctgacctcatgatctgccaacctcggcctcccaaagtgctgggattacaggtgtcagccaccgtgcctggcctacacttttaattcatgcgagtacttgcgcataggccagtttcaggactacaccaggtaccctgggtcgcctcccccaggtctgcctggaggcgcctgctctggtggagctgactgactcccagtgaatgcacaaaagtgctggcaaggacaaggcatggacttcccacttttatggggaagagtggctgagaaggggaggagaaagcagctctgtggtctgtgttctttctgcctacattccctgaaaacatggagacggtgcctggtgtgcctcaaatgatactgcactgatctaagtggaggactctctcctgaggagctggaaaagaaccactattatgaaactgcacaaggctaatctttaccattccaaggaaagctacatctcaccccctttacaatattcaaaaataatttttttacttttttttttttttttaaattaagacagggtctcactccattgcccaggctggagtgcagtggcatgttcatggctcactgcagccttggcctcccgggctcaggtgattctcccacttcagcctcctgagtagctgggactacaagcacttacaggcgcgtgccaccatgcagctaatttttgtattttttgtagagatggggtttcacaagattgcccaggctggtctcaaactcctggactgcagcgatcagcctgccccagcctcccaaagtgctgggattacaggtgtgagccacggcgcctggcctaaaatcatttattttctagtctaaaaaatatctagtcatgacgccagtgctcacctcacatttgttcagcgtcttcagctggccaatgctggcgataatgagt

SEQ ID NO: 59049 - DNA, 2489 bp, Homo sapiens
ggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctgatgcattgtggctaattagtaattcaccattacctatagtttttggttaaaacttggcctagttcagaaatctgtagtagtaactgagagtttgaatttcaacctggattgcaggatagctctgtagagctaattaggataattatcagacaaaaaggaactcacaggaatgctgtgtgatcatgtgatcacatatttgagcagtggtcacttataccaaagtttggggtttctggaaataatgtcagattttgtggatctctgaagtgggcaacttgaactaacttgaagaggaaccaatatgattctcagttctgaaccttggttttaaagaagttcatttatatggtagactaatacccaaattttctttctgccatctaacataaatcctgaaggtcacagtttagtactcatagtttttaaatgctaaagttgtgtgagtatgaataaaagcaaatacctctcagggttttagtgccatcgggaaggatatttctaaattttgttgacattttgaaagaattagttttgctttcctcctatcattgcctaatgtttacctaatatgagtacatttcaatcaaagctggttatcacagaagaagatatactcagcttaggtataattgtagggaaaagcatgtgattaatttaagtactcttagaaatagtgcaactgagaagacagataatagcatattgttatacatagtagaggatgtctccccaagtttaagggacatttcccaaaatgaccaaccaaatcatttctagtaaccctttaaaatagtagtttcaatagagaattccattaaaactagtcttatgacagatattaactgtgttcagattttattaggctagctagtttctttctatttaatatttaaatcttatcatgaaatgcagtgatgagctgtaaaaataaatatgaaataagatcagaaaatcattagtaggttcaaagcctttattattgctattatgtataagcctagaaatggtcacttcccaacaaaaaatacatcccttgttatacttaggacaagttgtaaaccccctttgttttgacagtagaattgttccagtgaatcatttatttccggtgaaccccagacacgataagcagtgtggtctttaaattttattagttggttgtcaccatcgcactaatagacaatctccattttccacagaataaaactgtaatgactttaggtcattttccagctcgatttctctgcccggcttctaaaattagaacgaaggtggggaaggatgtgattaagacagatccgataaagcatgctacacatactcttcccccaccccgtccccaggcagtagcttacccttaaaatcaaacaaacagacccatggtctccatttagaatcaaactgttgctatctagagacagtttaatgtcataatacgaggactaagcttgactttgactttgtattttgctgggcaacttactttgggactttcataggacaacagaaggtctgacacaggaactttgagaagacgtgacagcaatcccttcaccttttgaattgtcatggagcctatcaaaagacaagaaaagtccattcgttctctcaaatgacagttacctgtaaaactagctcatgtgatgagaccacagtatcattgcaatgatagctgtatctgtcttttttttttttttttttttgagactgacttacttacttacttaagtaagtcttgctctgtcgcccaggctggagtgcaatggtgtaatctcggctcactgcaacctccgcttcccgggttcaaacaattctcctgcctcagcctcctgagtagctggtgcccatcaccacacccagctaacttttgtatttttagtagagacggggtttcaccatgttggccaggctggtcttgaactcctgacctcgtgatccgcccgccctggccccccaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccatttcagtagtgta

SEQ ID NO: 59050 - DNA, 1042 bp, Homo sapiens
aaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtact

SEQ ID NO: 59051 - DNA, 1064 bp, Homo sapiens
ttttatctaaaacaacactggataaatgataattcctttccttagattaagaaaatttttttctggaagggcagtggctcacgcctgtaatcccagcactttgggaggctgaggagggtggatcacccaaagtcaggagttcaagaccagcctggacaacatggcaaaaccctgtctctactaaaaatataaaaaattagctggtcatgatggtgtgcgcctgtaatcccagctactcgggaggctgaggcaggagaattgcttgaacccaggaggcagaggttgcagtgagccgagatggcaccactacactccagcctgagcaacaagagcaaaactccatctcaaaaaaaaagaaattttcttattttctttcctcacttctacaagcttattcctttgtagtgatgataaaggagtcaagttttaatagtggcaggatatgtgtcagactaacacaagaggccacattatttttcatctcagtttcagactgaattgggcagttgaccgaaccggaaagtggcaggagttggagtacccgagccccgcttaccctgcctttgcatgtgggtcaggatatgtgatctccaaggacatcgtcaagtggctggcaagcaactcggggaggttaaagacctatcaggtaattaagaatttcttagcttggcgtggtggctcttgccagtaatcacaacactttgggaggctaaggcgggtagatcacttgagcccaggaattcaagaccagcctgggtaacatagcaagaccccatctctataataaaaaataaaataaaaacaaaaaattaaggatttcccacctacgtatacactcatcacaccaagtttcatctcactcggcatcccatcatggaaagcagaacccacttaccttggggaaaagcacgttattctctgtataggaatcacctctcaaaggttaaggatgcacccctacatccctcaaatcttgcctttaaattctattcctaaatcttttttgagcctacttattatgttttcagctagtatttacaggtgtcatccctggaggctgggca

SEQ ID NO: 59052 - DNA, 1049 bp, Homo sapiens
ttaattgctagaagttgtttccaagggaaaatatgtttcaatgtaataagtcaggtttttttaagccataaaatattttgagtgtaatataaatagcatcggatgcatcttgtacaatagcgttctgtgtgagaggcccagatgtaacacctaattcattatgctgggcctttgttattaagaacacacggggcaaggttcaggcgtttaatagatttggcagcaggagttgaatgatgcctaagaagcatttgtttgaacatatgttccatttaagccagatattttccttcaatatgctctttctttgccttttaaaatcaggttagtacttctctgtgttatgccatttagtaaagaccaagtgatggccttagttgatagcagcaaaattttgttagagcaaatgttctcaacatttgaggaataagaaatttagataatgacaggtacagttttgaatgaaagtgttagtgacgccactgcattggtgtttgtttgtttggtcgcactgactttcttatcccttttgtgtcaacaggactgtggaaacaacgagcttcaatttgttgctgaagacagatgatgactgttacatagacctcgaagctgtatttaataggattgtccaaaagaatctggatgggcctaatttttggtggggaaagtaagttaaccattcttagcccattggcattcgtgtacctgatcaaatgtaattaataaagcataaaatatcttttttttttgaaaatgtggttgagatatacaatttcgtactagactcctgggtttatatatatttcattactctaggtcagtcatgctggctcacatctgtcatcccagagttttgggaaggctgaggtgggaggatcctttgaggccaagagttcaaaactagcctgggcaacgttgcaagaccctgtccctacaaaaaattaaaaaggtgatgtgagcctgtagcccttagctacttgagaggctgaggcagggagactgcttgagcccaggagttggaggctgcagtgagctatgattttgcaact

SEQ ID NO: 59053 - DNA, 1054 bp, Homo sapiens
gagtgaaggttgcagtgagccatgatcgcaccattgcactccagcctgggtggcagagcgaggctctgtgtcaaaaactgaaaaataaatccaactaaataaggaatcattttgtaaaaatctagtatattaggttaaacttttgtttactagtatcccataccagggagaatacagtgcagttgtcattctcatacattgctgataaccctataaattagtaaaagttgctttcaaaaagcagttggcggtgtataccaaaatccataaaaatatctctttcttgtcccagtaatttcactctgggaatgtaagtacaaaacaaattgttaggagtaaataaacatgtacaccaaaacatgcctacattattttagtagatacttagtagatattttagtagacatttagtagcaaccaaatgtctaatagtaggggaaaatgagtaaatcagggtgtatctgctcattgggatgttatacacacatgaggaagaatggctgtgacagctgcaacaacataaggaaatgcttttgatacaatgggaaatggcaaacagcagtatgcaaaattgtgtatatactctttgtaattggttttttatatgtgcatggaaaaaacggtcaaggatacacaccaaacgctaacagtggtatgtcagagttatggggtgaaaattttaaatgatacgttttgggaaaaattttctctaaaaatcttgcctgaaagcatacttaaaacctaaatgacagcaataaggaaattgactcactattcatctttctacaaaagagctttgaaggtacaatcgtgtgggagagccaagacctccacggccttgtgtcaagaaatctccacaaagtgacagtgaatgatggagggggagttctcagagtcattacagtaagtcgtttttttttaaggtttaattgcatattttagcttctttttaatatataaaattgttctaaaatttaccttagagcccaggcagcatggagcaatgattcttgtgtgttttacaacatatatagtagcaaatgttgttgtcttc

SEQ ID NO: 59054 - DNA, 1331 bp, Homo sapiens
attcttcacaagtgaagactactgtgtgtttctcttaaaatatttatgttttggctgggcgtggtggctcacatctgtaatcccagcactttgggaggccgaggcgggtggatcatgaggtcaggaaatccagaccatcctggctaacatggtgaaaccccatctctactaaaaatacaaaaaattagccaggtgtggtggcgcatgcctgtagtcccagctaccagaaggctgaggcaggagaatcacttgaacctgggaggcagaggttgtagtgagccaagatcataccactgcactccagcctgagtgacagagacagagcgagactccgtctcaaaaaaaaaaaaaaaaaaaaatatatatatatatatatatatatatatatatatatatatatgtctctaattttatgttgtccttaatggtacagttggaacctgtaactaatttcagtaaaaagcagactatttttgttcacctaagtcactagcgacgttattgttagcattatggacgcttacatccttagacagaatttcactcctgttgcccaggctggagtgcaatggctcaatcttggctcactgcaacctccacctcccaggttcaaatgattctcctgcctcagcctcctgaatagctgggattacgagtgcctgccaccacacctggctaattttttttatttttaatagagacagggtttcaccatgttggccaggctggttttgaactcctgacctcaggtgatccacccacctcggcctcccaaagtgctgggattacaggtgtgagccaccgtgcccagcctatatccttattttttgtgaaggttgaaattctttatatatagtcatttctccaatccacaagaagttgttaatgtttataggcacagaagtactgtatatatttaagctactctgttgtttggatgagaaattagaagctttatggaaaagagttgatgcgtgaaaggagttacagacagcttgcttatgttatgggagagatagatatgatatctcatttttccaacctgtatcatgctattttttcccaacttttattttggtttttatgatcttagtaagggaattgccataaacaagttgttttggatcttaagagatacctggcttcataattgccttacatcagaataaaaagtaggtgtatgagagcagaggtgaggaatagaaattaaactgtgttgtggagcagaaacaggtttaggagacaggtggaagataaagcttcttccttgcttagtaacaaaacagctgatgggttatttaagttccatgagtaagtcaagatgatttggg

SEQ ID NO: 59055 - DNA, 1052 bp, Homo sapiens
cccagctaatttttgtatttttagtagaaatttggagtttcacatgttggccaggctggtctggaactcctgacctcaagtgatctgcctgcctcagcctcccaaagtggtgggattacaagcgtgagccactgcacctggctccagtcctcttttatattcccttttttgttttgtttatattttcttctgaagattctttttgaacggagtttcctgagtgcttttgttcccagtaaaaatctgtgtctttcagtttagttttaaccctttgggggagtgttgacactataatgtgttggcttaatttaacaacactgctcacttccctgaatattttttctttcaaggtgggttttttttttaaggttatgtggattatgtttagcatttgagaatttcgtgacaactttgattaccttaaatatcgttatttaataaccatgactgcactagaaaacccagtgatgccaaaaccacagtagaaccatgttagtgaccgtggttagggccattgtggatttagctgaccaagaagtaaggtgtttgaaaactttttgcatatgcaatgtataacatgaagtattttttcttgtctttttctcccaatttgtaggaggccctcttcattgctcgcttcagtcctccaagctgtggtgtgcaggtgaacaagctgtggtacaagcccgtggaacaattcatcttaccagaggtacaggatggcaggaaaagactgtagtaccaatgcagtccttcataggagtgggcgtgtgctttcaggggcaggcacttgatattttcttgtaccagggcagcactccagagtgatagatgaaggtaccaactgtggatgggctaaaacatagcactctgtattcaaacctcctgaggacttcatgaggcctcagaggttccaaaaccactttttgaaaaacattgcatgtttccgtagtttatttagtggagtagagaactacacaactgttttaatgacaaaggatgatgttgggtgtggattgatggaaagaccagacagagataccatttgggta

SEQ ID NO: 59056 - DNA, 1033 bp, Homo sapiens
agaccaaatttactgattatttatgactacagtcagtactgtttttcttatttctatttatccaacccttccaaatagatgccttccagttgacttaaatttaatatctcctgtggcgtttatacatatatatgcacacatttatgcaaaaagctattaaagcagttctgataattaacttacttagatgtggctgaaaactgtattcttaaatttcaaaaatgtttatatagaagcagccatttttctcaagcattttttaaaaattcctgccatttgtgaattatatagcaaatgattacctaggttttggcattaagcccacttcactacttcttactagtaaaacaaaggattacatttgttcagttatataaacctgttctcattacttagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggtatgccctgctctgtacaggttttttctcttttttctttttcaaaaacatcaacttttccttgtgacatacagtaagtagattggaagactatataattctctctggttgagagactttcacctttcttcccctattgactaaatacactgtagtgtgatataagactggtttggggatagattatctgtgaataaatgtgctatatctagaagagaaggagttgactagattagaaatctccaacctaaaattccctaaaacctagggaatttcaaaagttggtaatggatataaaaaaagtttaggattcttaggataagtgagtattattgcctcttacttccaactgtagaagtctgtaatacaaggctaataactgcttcaaatcttttttgtaataaggatatagagggaataaaagttattcttttacagaaaac

SEQ ID NO: 59057 - DNA, 1865 bp, Homo sapiens
gtggtagaatacagagataaatagagtgttaggaggggcttgacatttagtagaaggaaataggtgtaatcgtataataaaatgttgtatgtgctgtgatataaatagatataaaatagcccggggtgtttgagaaactcctaacacttctatataacttgagcacagggcttgtggtggtgggggaagggttgtggcacagtgtgagagaaacagccaggagaggtaggagagtagagaggtgtatataaagaaaagaggggggaagcatatgactgtgagaggcagacagtgagcagatcacatgtaacaggcatgtggagggttgagtggaaggacgagacctgttgtggcaaggactgctgaggggctgatctacagagatcagaggggtgaccttgtgagagaataaggtcattgaatgtagaaaatggaggaggaggctaggaagattgctagtgttctgacttggagaatagtggaatcatcaatcaaaacaaaaatactaaaagagaagagcaggtttcatgggaaagaaactcagttgtgtatatgttgaccttgaggttcctacaggcagtagtgtactgataaaggtttactaactggctctctgggaaaaatgatgcttatatgtacatacatgtttattataaattttattgacataaagtatatacagcctgtaattgacagataataacctatacaatactgtttatcgtaaattccatgaaaccagttgattctcatagaacgcttttgttgtttgtcagactctcctatctatgaccaacttatggttgcagttaacaaaagagtgtagttgtgacaaaagtctttcttttaagttaaacagtgaggtgaggactaaagtgacaactaagatatgtcagctttacacttaataaagtcagtgacttctatgctgtatcaggtaatagttttggaacactggaatcgtatcttccttgactttttttttttttttttaactattcactctgtagtggctatagatagacacatcacattaagcttaatttgcattatcaacattttctctatactttcttaagtctagacagtcaacaaaacaataaaccaaacccttatttgtattatttgccagtttctagggtgtgaatatttccactatggccaattcaagtgactaatgtgacatcactgaacacagagtgggggaaagataagcagtagcatgccatatatactatttccaccatgtagatgtaataaatataaatgatctcaagaacataatagtaaaatgtagtaaaacattaagtgattaatttgagtatttcctttgattttaatatatattataagattatataatttaattttaaataaaggctatgtttaataaccgtctcacaaaatttctgaaaagttgacagttggctcccagaagccagtagtagcaggctttagcacacagctgtctgtgggttatctgggtgaagatgtccagtgaatttacaggtcctttacatgggtctaaactagagttactaattcaggtccggacacagtggctcacacctgtaatcccagcactttgggaggccaaggcaggcagatcacttgacgccaagagttcgagaccagcctggccaacatggtgaaatcccgtctctactaaaaatacaaaaattagccaggcgtggtggcacacgcctgtaatcccagccacttaggaggctgaggcaggagaatcacttgaacctgaaaggtggagactgcaaagagccaagattacactgttgcattccagcctgggtgacagagcgagactctgtctcaaaaaaaaagaaaacaactggagttactaattcagg

SEQ ID NO: 59058 - DNA, 1086 bp, Homo sapiens
tgcctcagcctcccaagtagctgggattacaggcacttgccaccatgcccggctaatttttgtatttttagtaaggacagggtttcaccatgttggccaggctggtctcgaactcctgacctcaggtgatctgcttgcctcggcctcccaaagtgctgggattacaagcgtgagccaccaagcccggcctagttgtgaattttcttgtcactagtagtgcttactcatagtagctttcattccttttcaagacaggtttctttagttcatggttgcaatgataatagagcctattacacagcaaatgaaagacctcagaatcatcactactattagaaccacctccaaaagctgtacttcctgtagtatttccctgttagaaaataatgactcctccaccagttgctcagaccaaaacccttggtgttaccctgatttttcctttcacctgccacatccaatccatcagcataccttccagatgctgcttagaccatacccagaatctgacttctcaccacctttaccactgccatctgatctaggctgccattatgtctcacctggattattgcagaagtccccttctctgaacttactgcttctacctttgaccccctacattttattttccatacagcagccagagtgatccttttaaaattagtcaaattatgtcaattctctattcatacccctccattgacctcctttcttgctcagagtgaaactccaagtctttgttgtggtatttgaccttatctacatctacttcccctacactggctgccttactgtactttcatacactaaaagtgcccctacctcagggcctttgcatttcctacgtcctctctcactaatgtcctcaggactcacttccttcaggtctctgattagatgtcactctagcagacagccccatagtaaatagcagcccacccctatcttgtttgtgtcttcccttagttggctttaatttttttttggtaacacttatcaccagctggcatctgtattgtatttagttgtaaaattgtttgtctttctccacttgaatgtaggtttcatgagcattggggcttc

SEQ ID NO: 59059 - DNA, 1048 bp, Homo sapiens
ctctctggccttgcattctcacctgaggctagctgtagaaactaaaatccctcttccccaaagccagccataaaacctaaacatattactctaactagcccccaccaccacctttctatataaaaattacctaacttaccttcttttattacaggtcataagaacctcataccagagagggtcctatcccatacccagtaggaaagaatgtatactcagagaggacaagaagaatctagacaggccttgctgggttttccaactccatctgttaacattagatcctaccctttctgtccaatcttaattccacatagctatctatactttgttaaacctaagcacagaaatgggcactttctcctgtatctttactgatcaaataaatttatatgccttttctcctgtccatctcttgtcagtgattttcaccgaaccttcagagggaaaactttcccttggcccttacgttgccctcagggagcttgcttgggattgtgatttagtcctgacattatgaagattttgtttactgctgtatctgtgccatctagaacaatgagcataggagatgctctgtcatttgagtgaataaatcaagagaataaaactggcgcagtttgatgtattttcacaaattgaacacacccaactaatcaccacccagatttaaaaaaagaaaactatcagtgcttcagaagttcccttcatgctctgttttgtcactaccagggatagtaaccagtggcagaaatttggctacttttgtactttatataaacagaaccgtctagtatctacatagttcctatcgcctgtttatcttaatatgatgtattaatagaataatgtttaatgatatgattaacatgtaattttaatggctgcatagtattctgtcatatagctacaccataatttatttaatgagtcctttatgtgtttatgtagcttgcagtttttcgctattaataggtgacactatgattaataaagatcttctgagtgtatcactgattatttctttagaatgagttcttagaattgc

SEQ ID NO: 59060 - DNA, 1109 bp, Homo sapiens
ggtatttaagcacacagacttaaagaaatgtgcaattgaagtcatcatgaaaagccaaccacttaacacacagcgggttgtccgtgacccagcagcaagagagaccacactccttgtcttcatggagcttaaaatccgagtcagtgactcagagtctagtggaaaggcatgcttgtagtgtgtctctggaatcatagagactgtattttttcctttcatatttgacaagaccataatggtgattgatagctgcaggggtgcttgacaaaatagataaataatcagttactctttgcttagttaacaaatttgactttaaataattagaaataaagtgattcaaattttactttattaaattaaatgtattttcagtgtactaaatttaaagtttaaggaacctaaattaattactaatgttacatttttttccttttctcttttagggaaataatatatagccataaaatacttatttatctttataaggagaaaatatagtactgttatatttttaaaagttttgtacacccaaatatttgttgtttatgtaataaagcataaacaaggaggcaaaagaagatatgcaaagaatagaatgtactgagctttgtgatcctgattttattctatatcaccgcatttatgagcatctcaacttgtcagcagagtgactatgttagaattacagtcaaaaccaatgagttgtaggcagtcatttagtttatgtctctctgcgccactgaagataacttctttacactaacctcagtatgatgaccaatatgctaatacacttttaagaaatataatgtacaaatgggaatttttttttttttacagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagt

SEQ ID NO: 59061 - DNA, 1015 bp, Homo sapiens
tccctactagtgccagtggtaccaccaccacccacaccccatccccccagttgtgagaatcaaaaatgttgctagacattgccaaataacccctggagggcaaaagtgctactggttgagaaccacaggtttaatatatgcatattctagataatgggaatttgtagtagtactgtttaataaaatgtaggaaaatacagagaatcttaaaatctgaacagaacctacccaatgtgctactcttgttccgtatttccttagtcttagctccagatactttgacctcaccatagccttacaaaattaccttaatttttcttttagtttttttgtttgtttttgagaattaccttaatttttctgaattccattttgattgataactttttctactaagttagtaggtatttctttaagtggccctccttactttctgagaaaaagtaaatgtttctaaaccttatttcttcccagattttttttagtggccagccaatgccaattgactcaacagaatagatgagaaagtaatacaagtgacagaagatgttgctcagcagagcaactaaggctgggagaagaaacctgatgctgcgatgtgtttgtggcagtctccaaatgaaaagatgtgttcaaatttcaacaagttcagaggagttttagatgatgcaatatggttcctaagaaacatgtaaactgctactgttttcagaggctagcttttggatatcatttaatattctaggcctttccctatggctagaaagtctgatcattgttggcagaaaagagagtccaaacttaattctttattattaatagtctaccctggaaaaaaaatgaacgaaagagtgactatgcttatttttattttcattcacaggaaattttactcaattctttagctcagagttagaacaccaaaaaacaatgcaccgtaacctacgcacccccccgaaaaaaaagaaagaaagaaaagaaaggagaaaaagtagtcttaacaattcaaagtgaa

SEQ ID NO: 59062 - DNA, 1048 bp, Homo sapiens
acatgtcattatacatttgtcaaaacccatggaatgtacaacacaaagagtgaatataaactctggactttaggtaagaaaaattgtagcaatattggttcatcaattgtaattagtgtcccacaccaaatgcaagatttaataatagagaaactgtgagtgcagggccaagggaggggaggatacgtgagaattctgtattatctgctcaattttctgtaaacctaaaactagtctaaaaaataaagcctattttttttatttctaaattttatcattcattttgaggtgttttgcattgggagagttttcaggtaatcttatctgccatctgccacaaaaagattttctgttttattttgatgctttttaaaatctaaaattaaagtaattatttatatttccggtaaaacaaatatttttgcctatttctttgtcttagagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggtaaattcacccttattaattgatatatattgtttaagtgctcatgggccactgtaactatactcatactgattacatgaaggtttactgaaatcgaataaaattgccatgtttcttagtcctgattaaagtgaagcctttgttatatgaggattgtctttgacctccacagtgaggtaaattctgattccccaaaatgactgaaaggagtaatttaaacttgctcagtgctgtagcagggtccatctttgacaaactctcttgacctctaatcccttcggccaccatttctctgctctcctttatggaaaaactgttggggaaagttgcatatgcttgctgcctccagttttcttttgaaatgcttcagacagacttctcaccactctcgtcagggtcatcggtaacctctatgttgctaaacccgtaatgtcataatctttctttgtcccc

SEQ ID NO: 59063 - DNA, 1044 bp, Homo sapiens
tagtccattaaatatttaatttggaattgtatgacatgcattttcaaatttctgttattttacgtaaattcactttctactacattgtatctattacatctaatacacctgatacacatttaaattgtgataactgaattagtaattaaatacaatattttttaccagtattattactatttataatggcaagatagcagtgatatgactaattttgtattctttttttcaattcaaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattgtaagtaaattaattacatgggaaatgttcattcacacaaaggaaatagaggttttatgttgactgtattatacgttttcaaaatcatatttctttgtgctctttcagagagctttttaaaactcggacaacttgaatttttaattatagaataatatatattgctaattcacctttccaaaatgactcaactcatgaagcattgctttttaagcctgtaaccctagaagacattttctagtgttgtttagtaagatcagcatcagaaaagagtagatcatcatcattgatgactactatgggagtttacatgaactatttctttttaaaggactgtatttatggctacttactctcatttttctaattattatgaattttagatcttggcctaagtttaacacctttaaaattatgtagagaatactgataagtgtcagggttcatttatcatcatctcacttgggtttctgcgggtcacttacagttgacacaacggaacaaatcggtcagtttactctatagatagcaaaagccaatctaattctagcagaactcgtaaatcatgacatgtcaatctctaaatctaaactagattttggtgttttagctctgaacagcaaaac

SEQ ID NO: 59064 - DNA, 1120 bp, Homo sapiens
gtgaactgggtttttctgacatgcctagactcctaataaagctgtttcttccttggtgaaaaaaaaaaaaaaaacatttccaatagcatctcaagtagcaatgtccagtgaaactttctgcaatgatggacatgttttattcatgctgtctaatacagtcagcactagccacatatgcctactgagcacttgaaatgtggctgatgcaactgaggaactgaatttttagtttaaataaatagcataagtgacagtgactactgtattagacatcagagatgtacaattgaatagtgttagtagactatatgcccaaaaaaatcaatgataaaaagtgatggtaaatttgttaatcacagttaaattaggaaacatttcttaagcattatgaacatttgtttcacctgttaaaaaatgctactacttgtcacagttcctaaggtaatcatcaagtacttttcttgtcatgttagtaagacttttttggtctctgttttagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaagtaagggcaaatactagatatgttattttaattcagaaaaataaatatatatgtaatttaaaattttgagtatatacattaaagtagacctaaatctctcttttatattttagaataatgaactaatatagtttgttacttaatactcatatatttttaaactttttttattttgatagctttagggatacaggggtttttggttacatggtcatatttttgcatcatccagctttaagtccccctccatatgttggttcatatcaatatgtcttttaaatctaccaataaatccccatatctgaacacttagtaaatctcttttgtaaaaattacaaggaatacgtggttcattggaaatctcttcttcagtgtactatcaaattttagacatttacttcagctctcagcttagatgacaccttttcaaaaagaccttccct

SEQ ID NO: 59065 - DNA, 1077 bp, Homo sapiens
tatgtatatagtagttgtcagaaagtgttggttgaagtaaattgacatacaaggcaggacatgtggtttttatagatacatcttatctctttgacaggacagtagaccccattgggaacaagtatcatgtattttacttctttttatctcccttaccacataatgcagagcctgtctattgactaacttatcaaaaacttatgacacttcagatcactagttataaaatgctactggccactaaggttgtgtgtcattgtatactatagtatatataagagactatagaacatggagtttatgccttactctcagttttgtttattcacaagccttacataggtagagtatgagcattaaaaaaatactttgtagaaactaatggattgatgttacagaatggaagattatacatgttaaatttttactctcagcaaattgggagaaaactatatccacccatttttttttttaggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaaggtatgtcttcataaaatttattcttatagtttcatatgcagtgatactcatctcgtcatcaaagtcttccaataatagttttgtatttcagttattcctgaagaaaatggaggaaacttattagtgtatagttaatcaaactaagatactcttctagttcttttcatcatttaaataattacatttttcttttctttaaagcattttttaaaagtaagaaagaaagaaactcattgaattttagacctgggtgggccatagatatctcccatgctgtcccttcattctgtagattgatgagatctttgctttagctcccacccttatggcagagaacccagttctctaggcacctagaggcataccattccattaggcactgctgctacagagttagtttttcaagtcacagatattcgtgctcattt

SEQ ID NO: 59066 - DNA, 1049 bp, Homo sapiens
gcaaaaatttcaaataaattgacctgacccagagttcccaatatttttaagtgcttagaatagtgcctggtatgtaataagtgtggtttaagacttagttgatattagtagtaatagtataacttaatatatattctaaaccgaacaaagctggaatccttctcaaccttgatgtgatctatacaattgatcactgctaaataaatcactgaccatttgctttgtgggaaacagccttgcttctaatgtttatctgtttagtgtagtagctgttgttttttaaacaaagaaaaggatcagttgagtgtgttttcactttgaaatacttacttgctagttcatagcttgcattttaaacttgttgtcattactgaatgaaaatatttgtatttcaggaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggtaagaatcactgcttatagttttgtctaaagagaaatgacttacttattattgataaattaaaggatttcttttggaccacacgaaaaagctacactcgactatattaaacttttaacataaaaaaattacatattaaaatgttattaagctttctgccatagatgattaaggtttcttctaatttatgaatattttagaagttttctattaaccaaaaatgtaattagtacaattaaatgttaaatgtacaagattttaaattgagaggaggatatttttaaaaataaaatttatgaagtttttattccttaaatgtttccaatgcataggaaaaaactaagggtcaaaaaatactttaaaaaaaaaaaaactttaatttgtttgggtttggagttttttcaaaaa

SEQ ID NO: 59067 - DNA, 1066 bp, Homo sapiens
gaactttgggaggccgaggcaggtggatcacctgaggtcaggagttcgagaccagcctggccaacatggtgaaaccccgtctcttctaaaaatacaaaaattacctgggcatggtgacacgtgcctgtagtcccagctcctcgggaggctgaggcaggagaattgcttgaacctgggaggtggaggttgcagtgagccgagatcatgccattgcactccagcctgggtgacagagcgagcctctgtctaaaataataataataataaaaataataaaaagaaaagtggtttttgttgtttttgttggttggttgatttacatttagttatattgctatttcttcagcaaattttgtgattcctatactagattttttataatccattcaaaaagtgacaatagtattttacctcttttggtgaaattgctcatttattcctctaattgtgtactagctttaattttttccctctttctttaatttagcatgccagagagtattggtggatcttttggtatctttgatgagttcaagaacatgttcagaagagctaacccttcttttgagaatatttctggagaaatctccttgtacagtaaatatgctataatttttacatttttcactgataaattctttcacttacaatttttaatagaatgtatttttaattatttagaaatgttactaagctctttcttttgatgtgacagttggtataggcaatttcatgttattatgtgtgaaatactcaattatttgcatatattttaaccatttcacttcaatttggattaaccagacatatcgctgagattatattttctttacccaccccatccccagtttttgtgcttcagaaaagctgaataattttaattactaaagagaacttaattatgaatagttacaaccatcttagggattatccttttcaaaaggttattatccactatactcttcaattattgtctatgcttcccctttccattggtgtggcttagtgtcttttaaactattatctgctaggaaacccatttttataatgaaaccttgactagaag

SEQ ID NO: 59068 - DNA, 1100 bp, Homo sapiens
tccttatgaaaaaatcttttttattaacaaatgtgcacaaataatatatattagtattaaattgtatgaagtaaaattttaccacattgtggttttttgtcatttccaattgtataactagaatgaaatttcttacatagatttatttattaaactgaaatgacctataacttactttgttagaaaccccctttttgaggtattaagttgtctgaaaggatctgggaaattttgctgagtgaatttcataatttataatgattcatattgtttactaagtttttttcttcaagaaaatattgaaactgtccttaacatgacttttgagtaataagtattctattactaaaaacaagcaaatgttacaacctttgaattacactgatttatagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggtaaaatatcattgaagtgcttgtaattagatctgcaagccagatcattaaatagcaaaatggttcataataataccactttagaattttgtattgccttacagtttaacaagtgtgttgcataatctttttattgatcttcccaacagtctggcattcatatatgcaacaatgtgatatagtttgttatcacaaacatcatctgagtggttaagaacatggagtgaaggacagagtccccaatttcatgtatattctagtgtgaaagacaataaataccagaaatagataataaaatagaaatcgataaactgggtgatgtcgtattagtaactgggtggtgagggaagtcctttctgaagaggcaatgtttacattgaggactaaatgaaaacaagctaggcagacaaacactggcaggaagagcattcaggcagtttgttataaagaatacataatacaggaatgcagacacctgtctgtgacagccaagcatagatttcttcttagtttaccacagctcaatttgtctttaggatggaactatattg

SEQ ID NO: 59069 - DNA, 1063 bp, Homo sapiens
cttattggccatttgtatatcttcttttatgaacatctctttaaaagttttgtaccatttttaaggtcaggttatttatttatcatcagttgtagcagttctttatgtattctggaaccaagtctattggattccaaatacggtattttctttgtatatatggtaaatagaatactttctcttttaagtcataagatatattttaagatattaaatgactaaaattatttaggtcataagttaaatatttttttcctgtggtggtattttttaatcccttctttccacctagtcactttttggaatatctgtagcaataatagtaggaacagtagatgtgcctttggagtgaaaataaatagccatttaaaacataggcctttatcaacatttagttctttcaattaggaaatggagaatgaatgtttgagtttttaaggggaattaattgaatgatattttatcatttaagatgaaatcataacactagacacatagttgtatgttttaggaggaaatttagtttttctatctgtgcttctcatgaataggagcacttcttgagtactctggggtgatttaagccctttcccaccaactgtagtccgtttgctttattaatatttatttatttatttttgagacagagtctcactttttcacccaggctggactgcagcggcacaatcatggctcactgtaacctcagcctccagggttctagaggttgtcatgtctcagccacctgagtagctgggattacagacgtgcgccaccacgcccgggctaatttttaaaaatatttttagtagaaacagggttttgccatgttggccaggctggtctcaaacttctggccccaagtgatctgcccgccatggcctcccaaagtgctaggattacaggtgtgagccactgcgcccagcttattaatagacatttaatataaagaagtaaataaactttttattgaggtataatttatatacagtaagtgcacagataatgtgtatgcagttagatgaatagtgacaaatacacctcacatcagtagtcccaatcc

SEQ ID NO: 59070 - DNA, 1045 bp, Homo sapiens
cactatacgagtcacatcttgtgatgagcatggattgtagctgaactggggcccagagcttgactgtgcctcttggcaagaggcatagtcatatgtgcactgccctctcagcagggactgtggggagggcttccccctgaagcgggtgaagggaggtgaggcaatacatgtcttatttaacttaacatctctatgttaaatatcttttaaaggttactggatacctcaaaattacttttagcccagagatgaaactattttgaaactccttggggatttcgttgttcatggtttttcccttctggaaatttgtacattttcctctgtatttatgttcccctattctgtttgctgtagcttatttcccttaatcttaaaatgtcacattaccctttatttgatttaaatatgtcataagaagtgaagtggcgtaactttagctattagaatttttcagtttttattcacctgattggaaatcctttttattaactgaactttggtgtttggggaggatgggtcagtgattgtgggctctatcaagtgaaaaatgggttatatttttaaaataccaatttattataaaatatataaagcaagaacattttataagtaatgggtttatttttattgtatttaagaaagaaagtcttctctcttaaaaagagaaaatgttttccatccaggtgctgttacttacctattctcagctatgctcaggtatttcaagcctgggactcatttcgccatggaaggaattatttaagaagcacctgactaggtcagaactatgcctgaaaatattatagggttaagtaccaatttccagtaattttaagccaatcttcagttagaaacaaacaacaaaaacacatagttttaaaagtaaatttgtatttgttttcctaatcttttttttttgtaatacttattttatagctcggtcatgagcaccgacagtaactcactggcacgtgaatttctgaccgatgtcaaccggctttgcaatgcagtggtccagagggtggaggccagggaggaagaa

SEQ ID NO: 59071 - DNA, 3014 bp, Homo sapiens
aggcagcctggccctggagtctatgctatgctgcctcttgaaggcctctcccctcacccactttccttctcagcttccctcatcttcttctgtcagtgtgaagctaggagtgcaagctacataaaaagaactttgcactttaaaattccaattctatgttataatcagagctggagaacttccccctgagatctgtttaatagccttagtagaaaatctgcataacccccaagttgggaatcagtgtttgtgtctggtttaatgctgataaaacaaacaatggatcagctcagctgactgcctagcacagtgtccccattctcctgaagccttcctagcatggcttcaaggaaactaaaagggggatcacacacaagaaggagcccactatcttaaatggctatggagtcagatcagagagagggctattgaactgatttctgccttttccaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaatcttcctctatcttttctgaatgaagagatttaatgttgggaggctgattcatgatagacagacagacagccacttaataatctgcaaaacctgtggagcccagaaactcttatcccagtattatgagagctagtatgtttctcaaccacaaaaaaccttaggggttgtaatttacctaaaaatgagtgcagtgtctcacacctgtaatcccaacactttaggaggccaaggtgggtggatcacttgaggccaggagtttgagaccagtttgggcaatacagggagactccatctctgcaaaacatcaaaaaaaaaaattagctgggcatggtggcacacacctgtagtcccaactactcaggaggctgaggtgggaggattgtttgaatccgggaggccaa

SEQ ID NO: 59072 - DNA, 1050 bp, Homo sapiens
ttgaaggcaggtactttgaccacagcccctgccaacatctgcttcttgtcctagtctggtcccctgggtctgctgtgctctcctccatgtgggcctcatgcagggaattccatatatttatgccagttatagccctttactttgttttcttttgctaacagcttcattgagatattatatgtcagttatgttaaagggaaccaaatttgttagtaacagaatcaccaaactcaaatgaggaaccaaattcaagtatctttgcaaaagaaaatgtgttttatcacctctcgatcctttcagtcattctgttttcatgtctgccaatcacttcattgtaattcttttcaagtgtttttcataaactttttctcatgcatccttattatttcttttcctctttcccccctttttcctcctccaggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggtgatggaaagctggacactgtccagggcgggtctcaatctcctaagtcaggggtgggcaaactagggccctggggtcaaatctaaccagccacctgtttttatataacccagaagctatgaatggtttttacggttttatctggtacattaaatatatactggtacaaaattgtatagatacctgcatactgtccttggttttgcctcctggcctgcaaaacctgaaataatttactatctggtgctttaagaaaaagttggccaccctcgtgttgtaagtggcactgcacagagcctggagtcaccctgataccgataagcaattcacaacttacattagtctgccctggctcgtgcctccccagcagaagcaacacgggaggaagagacaacttgccagtttttaagagcaagcctcatgtgttctctgggacttgtcattgtaatgcttaatttctcccactcttgc

SEQ ID NO: 59073 - DNA, 1470 bp, Homo sapiens
aaatcagttgctataacccagtaaagactggggtgttatttgtaatcactgacaccccttctttgtaccccttatacttgtatgaaagtaatagcagctatggtttcttgaaagtattatttcaatgacctttatccccgatagctaatgaacaagatagaactatttttccattccctatcttaagatcttccactgcctcccctctgcctaagttctaagttcattaacatggcctcctaccttcatctctgaccactcccccaccctcatagtctccagccacatacaatgacatcctgttcactttaagccaccatccagccttcctttatacctatgtgccagtctcgctacctaaaaagccctcatccaggatccttgtttgacaaactgctattggtccttcaggtgccagcttcaagcaatgtcacctcccccaggaacccctccctgttctccccaggctggggttcctcctccaggctcccataggacctggaactcagtctcaactgtggttggctgtgggctcatggaaaactgggcctcggcttagtcattgttactgtcctggttcccaacgtgcagcatgatggatacccacagagtgagtaaatggcatttttgaatttgtcactttgagtgttgtttatcttataaacaacaagcatttcacattcccatttggtttcttaaagtgcagggattggacaccatgtgaaataacattgagtattcagaaaaacctcatctcagctgcttagaaaacaaaaaaaattagaggagctctgtgtttacttctagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggtatctttgtgtaaatatgtgtgtgcatctctttgatttgcatctgcccttttagagattctcagatgtgaggctttaactccagcattggtctcctgaaattaatgagtacgggacgaaagagtctacagttttggtgacttgtagatatccacggtacaatgccagaacatgtattacagtgtggacttgataccatgtcccactttcaaatcttttgccaggagactttacaagttggcatgctcagaaattggatattttccatatggcttcaatgtggatcaacactcaggttatatcaactccagaagagtagcagggcggcataaatggactgctgaggctgctttcaggggcagacccagactgaacaccctggagatcccttcctgtgtgtttcttcggcacatccatgctttctcttccttcttactgcaagctctacctcttacacaacaggctcttagttcctcgacactgattccttc

SEQ ID NO: 59074 - DNA, 1079 bp, Homo sapiens
atgcctgtaatcccagttactcaggaggctgaggcacaagaatctcttgaaccaggcaggcagaggttgcagtgagccaagatcgcaccattgcactctggcctgggtgacagagcaagactccgtctcaaaaaaaagagggaggccaagccattttttttcacgtgacttttaatgctgtgtattaccttcttcatcagtgctctttgattgactgagggctttctaattctggtgctttcagctataaaatgggcattgtgtggctgtggcagtttgtggtgccatgaaggtgatgtgacctgatgtgtgggtgtgtgtatgtgtgtgcatgcgtgcatgtgtgtgggggtgtgtgtgtgtgcatctgtgtgttcctggtgcacacgggcctccctcactgaccccctctgccatgcaggtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggtgagtgctggctgattatacctggtgacagctcctgcttcagtgacctggaaaaacaagcaggacgatatcagaccagaaccccaggctcaacccctggaaccatgggtgctcattccatgtagtcctgggtgaccatctctagatggggccactgtattgctgagctgctcgtgatctttccattcccctgccaaattcatagtgattcatctttcagcagctgctcaatttaagagcctcatatctgctctgacgtagcaacaagcattggagtttttagaggctttcaaagcttcagagatgcattttgtgatttagggacttcttttcccattagatagaggttgggcaattcagaaaagccattcggttttatctgatcctgacccctgccaagaaaccaaacctgagacctgcaggcttccactacaaggctgagtcagaattgctggagcagtgggaggggctgtgagggtcctatg

SEQ ID NO: 59075 - DNA, 1029 bp, Homo sapiens
ttgatagttaatgtttagtgagttttggattactgttcccagatcagaagcaggttcccatagatttgagtaagtggcttaaattattgggtaaactacgaattccagaagaaatctcattgtccctgggcctggtggctgttttacagatgtagatgaatgccagccaagccgatgtcaccctgacgccttctgctacaacactccaggctctttcacgtgccagtgcaaacctggttatcagggagacggcttccgttgcgtgcccggaggtaaggtggtgggacatctggagtcggtagcccattgccctgtccatgaatgcagagcacatggcccattgccctgtccatgaatccagagcacatggcccgttgccctgtccatgaatccagagcacatggcccgttgccctgtccatgaatccagagcacatggcccattgcctgccctgtccatgaatccagagcacatggccctgggagagaaggtgaggcgggaaagtaggaggctccatggagagttctaagggttgttgaggtgggagatcagagcatggactgcaatgtagagcattctttgaaatggtagaacatcaggtgggaacattgcctataatcccaatactttaggaggccgaggtgggtggatcacttgaggtcaggagttcgagatcagcctggccaacatggcaaaaccccctctctactaaaaatacaaaaattagtcaggcgtagtggcttgtgcctgtaatcccagctactacggaggctgaggcatgagaatcacttgaacctgggaggcagaggttgcagtgagctgcaattgagccactgtagtccatcctgggtgacagagtgggactgcctcaaaaaaaaaaaaaaaagaaaaaaaaagaatatatttgacaccttagactggagttaaccagttgtgttatttatttttaattactgctgctgttgttggtcagatatattcatgccactataaatgttttcaattagagataagtaaacattttcatcc

SEQ ID NO: 59076 - DNA, 1079 bp, Homo sapiens
cacagacaaaaattgtatttaacactacttttgatacatagaaaatttattttaggctaggggcggtggctcacgcctgtaatcccagcactttgggaggccaaggcgggtggatcacgaggtcaggagtttgagaccagcctggccaacatgctgaaacctcatctctactaaaaatacaaaaattggccaggcgtggtggcacacacgtgtaatcccagctactggggaggctgaggcaggagaatcacttgaaccctggaggcagaggttgcagtgaaccgagattgcaccattgcactccagctctgggcgacagagcaagactccatctcggaaaaaaaaaaagaaaattttgttttaaaattgatctattcttaggtgacaatgctattttattatagtcagtaatgtttgaagagctttaaaaaaaagcctgcagtaaaaaaaaatttttgctgcagatattgatgaatgttcagaacaaccctcagtgtgtgggagccacacaatctgcaataatcacccaggaaccttccgctgcgagtgtgtggagggctaccagttttcagatgagggaacgtgtgtgggtaagttctccaggtaacttttcgaaacagtattcacatggtgtgcattagctcttatgcaaaagttctggtcccaggtaaaatgagtctggtcaagttggaaggtgctgggaagagcaatttataaagatgaatcagacttagcctctgccctccaactatctggagagtcacaagtgtaatgagtaagcaacattattgcctacactagtaataccatcgcctcacctgttgccagcttttgcattacatttgcctcttataaacttcttttaatcattttcattatgcttttaataactataagctattagacatgtttcttccagtaattagtagccttggggttcacattgagggagcaccttataggtacttttggatcattacctatcttagattgaattctactttagttacacctaaaattccaactggggtcattctatttatggattttaattttaccaaccacgagcagcagcataa

SEQ ID NO: 59077 - DNA, 1046 bp, Homo sapiens
cgtagctatttcaatattcatcaccgtaactggcattatggagcacttgacaatttgcagaacatagattgtatcctttttttaatcatcagggaaatggaggctcacaggagttaagtagcttactcaagttcacccagacagagcctagcacagctgggagtccaacccctgtcctccgctatttccagcacaacccttgagccaacccaacagatgctgggctgtggctaggaagcctcttctctcctctgcgtgtggctcagttgggccacagggatgtctgagctctgtcttcagtgtcaccagttctatgttctacagccaaaccaaagcacctgcagaagcgttcgcaccaaccccactccacactgtgagcctggggcgggcagaagggcgcgctccccagtcagcaaagtgacagtctcatcttgtttttcagggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcaggtgagccccagctgtgtcccagggccagccccagaccggccactagcctcgtgctcttgacccaccacggcagccgtgaactggggctgtctctgggatctggagagggaaatacaccgggccttacagtcaccttcccctcaattatagacataggacgcactactccttgtagagaattttgtgcaaaaaagacaatacgcatgagttagagttgtaaaacctggacataattattatgacatttaagtgtatttcttttcagctttttctccagcatctatctatttacatgtatatgaaatatcccaacatataatttcatgataaactaattttattatacatctatttgtacttttttttttttttgagacagggtttcactcctgttgcccaggct

SEQ ID NO: 59078 - DNA, 1024 bp, Homo sapiens
agtcctaaagccactgtcagtcctatgagccaccttagctcataaggtagagcatgtaaccagcaattaggatgagcaagttgaattttaagtcctgatagtgtccctggagcacacttctggaatggctgggactgagcttgtgctagtattgtgcccatttggacacagtctcaccagacagccctagactgcctcagccacatgacgcccagacatgacggccagtgcccttccactctccagtcctagctgcaggtgatggcttgcagaccaacacagatcctcagggctccctctgcttgggtagtggtggctgttggtgggttgctggcctgtttctaagaagcctgtccttcctcctaggagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttggtaagaccatttaagttgcagttggtaacgatcttggatgtgtgggcttccagacaggcgtactgctggggagatgtcagttgtgagcattacatggtggtttgtaaagataagagcttgggaaagtagaggctgaactctcacagccgtggagccttggtgttatatgcccagtggcttcagagatgctcagtgatcttttgggattaggaccatggttttggagactgttgagtgtgtcttctttcaagtttcctagtattccgttctgtctg

SEQ ID NO: 59079 - DNA, 1048 bp, Homo sapiens
ctcccaaaatactgggattataggagcaagccacctcgcctagccatctcttagaatttttaaaatctataggtcctcccctaaccccagctcttttttttctttaaaatttatttgttcaagaaactagatatttctccattttagtgctttatattctggattttgctgattgcatcccattgtgtccattagcatgttcttctgtctcctgtatttcctgtaaactggcagttagatctggagacatgactgaattcaagttatgcactttttatttattttattttagtaattggcattttactccagtggcaagaacggcagtaatgcacagttctctgacccttcatatcacttacaactgagctcaccctcaggccttatttctaaaataacctgggtgcacaggtcttatcctgctttgaacctgcctgtcccctatattggaggaagtcaggaagtggggagactcatatgtatcagaccatgtgtaagctctggaactactgtggtgaccaagacaaatggagtccctgaccgtgaagaaatgaccacatagtggggagagaagccagaacctacaaataggcaggaagaagacatatcaggggctgggggtgtgagggaagggaaaaaagagtgagtggaaggagcttccactggaggggatgccaggaagctctctgagaaggcactgtttcagctgaggaataaggataagaagggacagtcatgtgactaacgaggtggtggggttgggcgggggcgtgctgttggtagctgagatggagaaagtgccatatacagtagcttctcacttaacattgtggataggttcttggatactgtggcttcaagctaaacatgcataactaaaccgatttgactgtcgggtaattgacagaaacaacatttaagttcctatggcttatttctggtcagaaacacatcaccaaacttcccatgaagcccaaaacacttctagtattaaacattgaaataaataaatgtgagctctacatacatttaagatgaataaaaacaa

SEQ ID NO: 59080 - DNA, 1052 bp, Homo sapiens
ggcaagttatataaactaaaactcattttttctcaaatgaagaatgaaaatggtattaatctttactaggtttaatgagataactaaagtaaaaatgctttgtaaactgtaaagcaccttgcaaacggattaggctccaggtccacttgtgggctctaggctgaaattaatcagtctccaccttgattgtgtcccggacttgcctattttctggacttcctttttgtgttttacttttttttggactcattttgttttccagctttttgtagctacccagtcactaactttgaagccatcccaaaaaacattgcaacttgcatgacttttgcccccagtgtctctaaactaggcagccaagtgtaacagaaagagcacgggttacggactccagcaaatgtgtgttccgttcttggttctatcacttactggctgtgtgacattaaagctaaattaaaatctctcatcatttccttgtctgtttcaagtatgcgaaaagagggatggttgtactaaatgcctgtcacatgaaattttaaaagataaaaagagccttagtaaaggacctcaacattaggtgacagcccatgtttgctgcatttccactctttatgttaaattattttaagttcctgctgcctctcacccatggagtttgcttttgcaagtctcactgtcttctcagtacagcgatttgtatttgtaaaaggaccctgtttgtttcttatttgtttctacctcaagtattctctaaacacacatgttttggagaaggctccccctagactattgcagaaagcagcctgttactaggctcatctaagcccccggccaagtggctgttgtttcactttttcagggagtatttggacataagaaatctaacataaattttaaatttattgagcatctgcatatagactttctccggtgattcatgctatctgaaagttcacgttaaagatgaaatgagacaggaagtgctttctaagatgggaaacaccctcccattataagttaggtgctctgtccatccccttcttgtcagttgg

SEQ ID NO: 59081 - DNA, 1001 bp, Homo sapiens
gcggggtctgggtggctccgcgcgccccgggccgtgaccccggcacccatggaccccgcggagcttcctccccggcggctgtgggctgcatcgccgcagggaggtcagtccgcgtccctcggctgtccagtcccttcggggctaggacctggccggtcccgggtggagccaggttctcgcgcggagcctccgcagggcaagagccggagctggatcgcagtctgcgcgcgggccccgggactcttgtggctgcgggagagtttcgccggcagcctcctgtatttgtgtgtggactccggatgtgtcttggcagtgatgctgctttccagttgggctcgtttcagagtccagagtccagagcgggaaacacagggctcccagtgatcccatttcctgtggccaggcattgtcaccacggaggccccaaacgaggagcgggaccagatgacctacagctccctggatcctccccgtgactggccgggcctggggtcgctgtcaacttgttgaagtcctttcgtgccgctgccttcctcggccgcccaccatgtggatttcatataaggcttgtgtgcattccagaagtgtggggggttggccgggggaagggggttggaactgcaaacgcagcggctgcagcctgtcctgcccgtgaaatggctgtgctcccggtctggcctgggaacactgcgccttagacaacactcacgtggaacttgtaggctttgcctaaaacgaatgagcccttcaagtctggatccacaaagagccctcccccatgttggttgactgccctggcccctttgcacactggtgaagcctgtggatcccttttcagtataacgcttttattttagtttttagagagacgaggtcttgctctgttgcccaggctgggtgcagcggtgcgatcttgggtcactgcagcctccaactccttggctcaagctgtcctctggcctcagcctcctgagtagctgggaccacaggcgagtgtcacc

SEQ ID NO: 59082 - DNA, 1130 bp, Homo sapiens
aatttactatgtggctgacattgttaatatatgcaattatttgtagatataattcagtatttccatcatccctgcaagatgagtaacaggatgttcactttgcggatgaggaaaatgaaccttaagcaacctaggcgtctggtgaaagggtttccagccagcaaccggaggaggcaggaatcatgccaggtgtgtctggtgccggagcccagaggcttcccagatccgcacacttcatgctcactcatctgccagccacacagaggtcctggatgtctggtgggcgatgagcaagcgacagagagtccgtgtgatgaggttgctcaggctgatgtgacaacagtgagaagaggcgtctcatctcatccctaaccagacggggttagggatggcgtcttggagcagccaaccggagagattgacatcgctgataaagaggtagattcacacgacctcatctttgtcagtgcacaaaatggctccctacagcccactggtgacccggctgcagaaagctctgggtgtgcggcaataccatgtggcctcagtcctgtgccaacgggccaagatggcgatgagccactttgagcccaatgagtacatccactatgacctgctagagaagaacattaacattgtttgcaaacgactgaactggcctctgaccctcttggagaagatcgtgtatggacacctggatgacccggccagccaggaaatcgagcagggcaagacacctgtggctgtggccggaccacgtggccatgctgcagttcatcagcagtgggctgcccaaggtggccatgccgtccaccatccactgtgaccatctgaaagaggcccagctcggaggcgagaaagacctgcgccaggccaaggacatcaaccaggaagtttataatttcctggcaactgcaggtgccaaatatggcgtggactgctggaggcttggatctggaatcattcattagattattctggaaaactatgcataccttagggttcttctgattggcactgactcccacacccccagtggtggcggcctggggggaatctgcattggagttgggggtgccgatgctgtggacatcatggctgagatcccctaggagatgaagtgccccaag

SEQ ID NO: 59083 - DNA, 1655 bp, Homo sapiens
gctggcatggcgacaatctgcaacatgggcgcagaaattggggccaccacttccgtgttcccttacaaccacaggatgaggaggtacctaagcaagacggccggacagacattgccaatctagctgatgaattccaggatcacttggtgcctgaccctggctgccattatgaccaactaattgaaattaacctcagtgagctgaagccgcacatcaatgggcccttcacccccgaccaggctcaccctgtggcagaagtgggcaaggtggcagagaaggaaggatggcctctggacatccgagtaggtctgactggtacctgcaacagttaaagctatgaagatcccgggcgctcagcagctgtggccaagcaggcactggcccatgacttcaagtgcaagtcccacttcaccatcactccaggctccgagcagatccacgccaccattgagcgggacagctacgcacagattttgaggaatgtgggtggcatcgtcctggccaatgcttgtggcccctgcattggccgctgggacacgaaggacatcaagaaggggaagaagtacacaatcgtcacctcctacaacaggaacttcacgggctgcaatgatgcgaaccctgagacccatgtcttcgtcacgtccccagagattgtcacagccctggccattgtgggaatcctcaagttcaacccagagaccaactacctgatgggcaaagataggaagaagttcaagctagaggctctggatgcagacgaccttccccaagaggagtttgacccagggcaggacccctaccagcaccccccacaggacagcagtggccagcacgtggatgtgagccccactagccagcgcctgcagctcctggaggcttttgacaagtgggatagcaaggacctggaggacccgcagatactcatcaaggtcaaagggaagtgtactactgaccacatctcggctgctggcccctggctcaagttttgtgggcacttggacaacatctccaacaacctgctcactggtgccatcaacattgaaaacagccaggccaactccgtgtgcagtgccaacattgaaaacacccaggagtttggccccgtccctgacactgcccgctactacaagaaacatggcatcaggtgggtggtgatcggggacgagaactcgagccgggagcacgcagtgctggagcctccccacctctggggccaggccatcatcaccaagagctttgccaggatccacaagaccaacccgaagaagcagggcctgctgcccctgacttttgctgacccaggcgactacaacaaggttcaccctgtggacaagctgactattcagggcctgaaggacttcgcccctgacaagcccctgaagtgcatcatcaagcaccccaatgggacccaggagaccatcctcctgaaccacaccttcaatgagatgcggatcaagtggttctgtgccggcagtgccctcaacagaatgaaggagctgcagcagtgagggcagtgcctcccaacacacccccaacctcgccccccagagctggcgtcatgttcaagttcagctccacatgcgccatcagcagatccgatccatccagccatgggttctgattccaagatggtgtgaccagacatgcttcctgct

SEQ ID NO: 59084 - DNA, 1291 bp, Homo sapiens
ggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcacagattctgcatagttttttttcagcctaatgaaatctaatatgcattacctcagggccacatcaagaatacacccctttccgaactcactgaatgttcattacattcaaggagaaaataagagggtccataaagggcattaataacaaataccccaagccgttgagctaagactatgtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctggagccataaaactgcctattgggaggctaaatgctctgcttttctataaaacagaga

SEQ ID NO: 59085 - DNA, 1071 bp, Homo sapiens
acacatcaatcatatttataccaattctctcttgaatgtatcaggcaaattaaaagctttgctggttaaatttagctacttagataaggcacactcactaatgcctcctcaaatttcctctttcaccaaaatccaagtcagctgctctttgttgaccttagtgctgggccaacacctagttgaacacttaaaccttattaagaagaaaggaatacatattagtaaaccctagaacttgagaagcactgtgagaaaaaggttctcatatttacatagtggatattacttgcttttatcttttaacagtaaaggtaaacttatattagaactaaatgggtctaaatatttgaaacttttatcgagatttccaactagacaacctttatctaaaaaataccattctttcactttagattgttgcatgaggaagagactagcatagatctgatcagagacacatctaatatgcattcccagttttcatcttatatgagaattgtattaaaggacatttctaactgtatactatcatgctacttaagacatgggtccagatggaggagctgctgaaaaggatcaggctaaaattggggaatttgtctcatcaaaaagattcaattaataaacggattaaagtgaggaaacatttaacaaggaacagtgaggataagagagtgggattcaatgtctattcagtacctattatatgagagacgctggactaggcactcgtcacgtttctgtggatcctagtctatactcaggaacacccacttattaacgttactctaggcccttagcaaggatacataagaactcttgcaccaagggtcaaaatacattgaagtcttctgaggatgtccctgtgcccataacctagatctgtgtcagagtccctgtacctgttgcccggttcctatgggccagggcactgatactacatgccttccgtgtggagttctgagattggctgcccaggtcattaattatgggttcagggttgtaagatctaaatccagtgactcagcaactcctaatgacatctacctggttcctccaagtctggattct

SEQ ID NO: 59086 - DNA, 1007 bp, Homo sapiens
atgcactagattaaaactaaagcctgggtaattaaaacaatgtggtactagtgcatgactaaatagagcaatgaaatagaaacagatacagagaaacagaagcagatacacagctaaatacatatgacggattctaagataagatcaatgtagcctctcaaactcgtcaggaaaaaacaaacagttcaataaataatattggaacaactgggttaatcacctgcggaaaaaattaggttagatccataacttatatcttatgccagaatatgcttcagaggttcaaaatttagatgtagaatttaggtgaattactctattgctctggattgagaaaaacattctaattatgactcaaaatccagaaaccactaaaaaaactggtaattcagactacataaaaattttttaaaactcatgacaaagccatcataagcaaaagacagatgacaaattggaaagaaaatatttgcaactcattactgtcaaagggttcatatccctaacaaataaacaacatatcaacgatatagtagaaaaatggataggaacaaaacaatatgggaaacaaaaggaaatacaaatggctcctaaacatattaaaaggtggtcaaccttaggcatagtaaaaatttacatactgagcagtcaggtgtgtggcgtgcacctataagccaggctattcgggaggttaaggctggaggatcacttgagcccacgagtttgaggctacggtgaactatgatcataccactgcactccagcctgggtgataacgtgggaccctgtctcttttttaaggaaaataaaagaatgtacacattgatataaattttcatctaccagaatggccagaatccaacattttaataacatctacattggtaatgttgcaggttagcaagtactatcataaattttagatggtatgtgaattgatgactacccctatgaaggacaatatgccaatatctttcaaaattataaatgcacacagtctttgcccc

SEQ ID NO: 59087 - DNA, 1051 bp, Homo sapiens
tctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcactcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtc

SEQ ID NO: 59088 - DNA, 1361 bp, Homo sapiens
aattagtgtgtttggggaacattgagtaaagagcaatcatttgaagaggaatgtgcaaaataaatttattagaccaattgtaaatgatttgagattctttattaagaattattcatatcactgttcccattattaatctaatgtctgtagatagtatgaagtaacaggcttcctttgccccttctaaaccagtcttaatgagaacactaatttaaacatggaagcttcagtgtttgaggttttttattttaggttttgctttcaaattatagcttatgtaacaatatcaataatttgaaacagtatgcaacatgttagccttactaataagctttttctttcttccataggctttctacaagtataagagacttacagaattttaaagtcttattacaacacagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcact

SEQ ID NO: 59089 - DNA, 1086 bp, Homo sapiens
tatggtcaaatttacttcccaagagggttgttttttcagttgatatcaccaacacatcagtgctaattgttaacttttacttttgaatttttatttatttttttgagacagagtcttgctctgtcatgcaggctggagtgcagtggcgtgatctcagctcacttcaacctctacctcccaggttcaagcaattctcctgcctcagcctctcccgagtagctgggattacaggcgtgtgccaccacacttggataatttttgtatttttagtagagacggggtttcaccatgttgaccaggctggtcttgaactcctgacctcaagtgatccgcccgccttggcctcccaaagtgctgattacagacgtgagccactgcacccagcctaattgttaaattttaatatgttgttgatggaaataatatttagttggtggaaatttctgcctcattttcatttgtatttcttacatatgatagggatttttataatggaatgtatgtatatttagtgtatatcattgttgacagattgattattctgccaatagaaactgaaataaagaataaggtaataatttttactaaacttacgaacttctttgcagtacttgaaaatggcaaacaataccaaagaattagaagattgtgagcaagctaataaactgggagcaattaacagcacattaaggcaagttttattttggtaatattaagaaaatattctcattgatatcaagaatcaattttttatgattttggtaaaacattttcgaacccattaaagttttaactaatatatttttaaaaggaagaaaaagtttttctttatcctaaatttcataatagctttgcctcttcttggctgatttatccttaaatttctagaatgtatcatccatagtaaatcttttaaaaagtagaaatttacaagattgttcagctaacagggtttatggatcaatttttcctgattactatggaagaaggggcttgaactcctaaatctttttaaatagtgattgagtctggatgttacattttgaatgataaaagttattagcctgttaaatttcgtagattttt

SEQ ID NO: 59090 - DNA, 1013 bp, Homo sapiens
ctctggattttctttgtagcactgactacaactcgtactaaacttacaaatatttaatttgtttccttcaatagatttttaagttccagagggataggggagttctttttctgtccattttccccccatagcctacccagtgcctgacacatagtggatgctcagttcttatttgttgaataaatgggtgcatgagagaattctcattaataagataacattaggaggctggaagacattcaagtagttctaaatgctttctctgtcacccagtctggagtgcaatggcatgatctagctcattgctgtcattttaaattctgaaccttataggtgccacgaggataggaagtattccttcttattcaccaccatgtcactggtgcccaacacaatgacactttgagagcaccccataactataatatgagtttactaactttgttctttctttcaaggttaatctgaagcgaccttgtcctttctgggcagaagatggccactgttcaataaaagactgtcatgtggagccctgtccagaggtataataaataaaataacagggcaaagccaattttctcttggacttttagaaaagcataacctctattttatttcaggctaatgtcaatggatttggatgtgtcagcaaattcatatgctctcagctctctcctttagaaccagattattgaagattctatacttgacaccaaaatgggtttgaagacacttgtatccagtgatactggtgatcaaatatggaaatatagtcttattctaaaatggaaggaaaatcagaggcctgttctaggattggatctgcagttgtcttttatttcatgctttattgaatcagcatcttgtttcataggaaaaaaaaaacaaaataaaaacaagctactggaccctatatttcaaatttatagtgatttaattggggaaatttcaggcttagaattagattttcacttggccttgttacatttacatttaaaaaaaaacctatactt

SEQ ID NO: 59091 - DNA, 1818 bp, Homo sapiens
gaaacaaccacaggtcaagaaggaatgtgaatctgttgttttataagagtttaggacaaggacgtggaacagtggacactggttttccccaaagctggcagttttgtggaggggtagcttgtttcggtggtggatctctgtttatttttgcacatctgttataatttaatattcaaatctggaattaagaaaacatattttctagtatcctctaagggccaaagtcctacaatcggaatggattcatgccacgttgaagataaaattatcctctctctgaaatacggtaaagatttaaataggtcctgagactgttgatagccccagacatacccacagcattatatgtaacatctctcctgatcagtgccattcccacggtttcaaagaaaacagctacaaggaatgcttacctgagtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgcccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtgg

SEQ ID NO: 59092 - DNA, 1050 bp, Homo sapiens
cagaggctgtgcaggaggccgagctgggtggcgatcagcggcgggtccctgtccaaaacccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttgggtgagtcgcgcgacccccggcctcgggtggcggggcagtcgctagaggcgtggctgctctgagggtctcgccagtggaggatggcattcggatgtcacggctcctaaatcaccatttgatgggtgggacagtgtccagtccaccccgacccgccggtcctcaccgcggcagagccggggctgggtggcggggacgctgcctctgcaggcgaggcgctccggggcataagggattatcaggagtcgcggcctttcttggacatccctggctggggtcaggctgtttgccctggggtgtctcctcgctgcaaacccaccccacctgggctgctttctcacctgttccctcctagcctgaggccgagcgccacctccaagtggaggaatctggggaagtttccttcccggaatttgtagtgacagtggagtgacctccattgcgttccctgcctctaacacgctctttaggatgccgagtcatttgactgcagtgttaaacattgcaaagcgcaagtcatgtgacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtgtatggcaactcggcatccattctttttgctcttgttcttacttcctgaattgagtcacggagccagagttttgaggttttgactaacgaattaag

SEQ ID NO: 59093 - DNA, 1053 bp, Homo sapiens
cttgaacccgggaggtggaggttgtaatgagccaagattgcacaactgcactgcatcctgggcgacagagtgatacttcatctcaaaaaaaaaaaaagaaaaaaaaagttaggcttccttttctgtttttttttttttttctttcttctctttttttttttttttttaagagatggaggcttgctctattgcccatgctggagtgcagtggtgcaatctcggctcactgccacctttgcctcctgggttctagcaattctcctgcctcagcctcccgagtagctgggactacaggcgcacaccgccacgccccgctaattgttcttttgtattttagtagagacggggtttcaccatgttggccagcctggtctcgaactcctgagctcaggcaatccgcccgcctcggcctcccaaagtgctaggattataggcgtgaaccaccgtggctggccacttacttttctttctattgaatttgaatgaataatttggaagacagtatctttacttcataccaggaatgctgccagtgaaatttcttgtttggcagttcattatctacctatatatttaattttgctattgtttatagagttcttaagatatgattaaatgctagctggttaagaaatcatttagaaatgaaacagaattggttgttactccaagttaataagttgcttgtcaacataaatcctacctggtacccagttttcttaggaaccttgcttccatgtttatccttttctgcttagtattctaagtactccttttttaccttacaatttagtcttaaaacacaacacagtcaagtctttcttttgtaacctgtgagataccttctagcctttgtgctgtttttcttctctttttgctgcctgccttcctgactgagagtggatttcctcactaaggctctgccctctgatttttcactctcttttcttttttggttttactagtgaaattttgtctttaatgtctctttcttttatgtctttaccgatcactcatagatttttttttccatatgtatccagttccaacctt

SEQ ID NO: 59094 - DNA, 1043 bp, Homo sapiens
atgttttttgtttacttggagattgtaatttgcccctttttataacgtgggcaatcagtataaatggcaaagccagtagagtgtcaaattatgcacattggaattgacatttgtcatcatattaaaattcctgtgtagccccatattgataggaatttaaccaggaagcttgtctcaggactggagtcacacatttaatcatataagcagacttgaggacgtggagaccctaaaactgcttgcttgcactggccatcatctcccatcagggtagacggtttcaggtggcagtcctttctcctaaggagttagtcttgtttgtatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgcggatgccgggtgtttggccagcctcaatcaccagctcaggtgccactgcctcacacagtcacttagggtcattggtttaggttatcattctacagcattttaaactgacacattgtctggaccatgtgggttcttgaggactcatcaaaactcgttactaaaagcatgaatatcaggcggaatagatagcaatgtgacattcatatttatccctaagttccagtctaatgcagtgccctggtatgtggagtgtagacagatgtgggctaatcatggaaggttccctgaagttgtggatattggtttggaattcagaaagctgggaaggatgtggaaggctgaaggttggcttttctagatttagggcatgatttgaacaagtccttagaggtgggaagggcagcacagggttgttagcttggcaagagtcaaggcgcaaagggtgacttggggttcactggagggaaacagaggtgagtgctctagaaggaagttgagccttgtggtgggtgacaggaaaccaatgatgtaacttgtttttgacctatctgggccccaagtttggatctgctatatta

SEQ ID NO: 59095 - DNA, 1032 bp, Homo sapiens
agatgggagtttatcccaagcgactgtcctggcccctcatacaattatagtggtgaccagtcaggggctgtgggtgaggagacctgccagaggtggctggaggcactttattgccagcctggcgggctggcgagcgccaatgaagtaaaatctggtgacacacttgagtttgcatgcggcattttattttattggttttttttaaaggaagagattataaaaagacatttcacattaaagatttgcagtcctgggacacagtttggaaaacactatttataaggttgcacatattacaaacagctcccaaatggtgaaactggtattctaagatgaaagcttaatgaacataatgaagtgaataaacgcatgtgaactaatgtttaaaaagttagagcttgtctcaagtcagtacagctcttaagataataaatacagtaacactactttttatttctttgctcttttatccctttcaggttcgatttgctgctttgattactgtgttagcactggctgaaaaactaaaggagaattatattgtcttgctaccagaatccattcctttcttagcagagttgatggaaggtaattcccaaactattcccaaccattaaacaattaaggaataattcagtaaaattctgtgaaaatgtgcccaatgataatgcagatttggatataacgtgactagcagttgatccagtcctcatacaggcagctccagtctcaaatacaggcaggctcgagctcctgttttgagttgggtggagggagcaagttgcgaagtgaccacctcctgatcatttgagagtccgtttacagtgtaatcttcacgatcttttcttttgtggtggtttgtgatcatacaagcagattacagtagtgtttttaattaacctcatacatttatatgattgaagttttggtccccagattgtatggaaatgcctagtggcattaaggatgcagtaggatgtccacttttagtagcaaccgatgttcattcactactccatgttaggtgcttta

SEQ ID NO: 59096 - DNA, 1029 bp, Homo sapiens
cagtaagacacaacctagtgcttggaagcaagattttagaggttcttaagtcctaagctaaggagggtgaattttttacttcattgttgtcagacagtgaagtgttgttttagcatcatgagcgaatgttataagtcacctcacttgggagaaagaataaagtaaatggccgttactgtcagttactggaagtaactttaaaacgcaaaaattaagattagtttattctctaatgctaatacgtgacccacttgacagttgagggaatttaacttgccagagtgagtgttagaatcttaactctaaaagaaggaatcattcttcgagagaccatccattgtgttctgccttcgtcctgattatgatttctagatcattttagactcttctgatttagttattttaatagtgatttcaatgtaaacattggagattaaatggttaagttcagtgttttttcatttttactcttcccacgtctacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcaggtaaccaaacagaatcatctttcgttgctgaggaagccatcactgttcgagcttggcaggttttagatctgctcaaatgacagcttgctaggatttttctttgtaaggttgttttttctggtctttttaatgaaatgttttatttgaaaattgttttttcaaagatataacttcattgtggaatttgagttttgttttgttgttttgagacagggtcttgctctgtcacccaggctggagtgcagtggtgcaatctcggctcgctgcaacctccacctcccggtttcaagcaattcttgtgcctcagcctcccgaatagctgggatcacaggcgcccgcctccacacctggctaatttttgtatttttagtagggatgaggttttgcca

SEQ ID NO: 59097 - DNA, 1042 bp, Homo sapiens
aacatctgaaggcgaattaacttttctgagaaacagttctggtgccacgcaagtggttctcttttaagcccagcagagtatggctgaagagtaatgaaacagtgtctcttcaaagcggttttgaaggcagtttgtggggaaatagaggagcgtccgtgtccctgaagtcagtaagacacaaacacaggtgattgtttggataaagccctgtttggataagtcgaggaccatttttaaatgacttcttagacatgggatctgggagtagatctcgacccactctaaataaagtagtatactctgttctgctagaaatcctaacgcacattatcctgaaattatgccttcacaattcctaagtacagatttgttacctttttctttttctacacaggatgctattttagaagcagacactgaattttggttttcagtctgttgtgagtttagtgtccagcatcagatacaaagcttgatgaatatcctccagtacttactaaagctgccagaggaaaaagaaggtaagcgtagatcgggtgtcacttactgttcaatctgaaagctaaagagaaacagaagagaatgcaggttatccttagtacatcttcagaaggatttttaaagtaagttaatcattttaatttgattgtgtagtttcttgaatccttatggaaaatagtcggaattccatttgccattcctcacacattgtcttttatacctctgtgctctgcgctgacgtcttggctgtggaatgttgctggtatccaggatgagttaggttcaaatgacagtaaatgatcaggacctcattagctgtctctcagcttctcattaaaatatctgaagacatttacatgaaaagaaaaaaagtaggtaccacaggagtggcagcaaaatattaaaattgtaccatgcagcagagccttgaagaaaatcccacgaaccgcagcaccactgaggctggcttaggaaagggttgatgaagccaggtgtgatggtgttagcctgtggtcccagctacccaggagaatgagacagg

SEQ ID NO: 59098 - DNA, 1091 bp, Homo sapiens
attgaataaatccttcctaggggttaacatttattgctctaattttatcccaatggattatatcatcaactcttcttccttcaatatttcagatttccgttaatgctgaacaagtccgaatagaactggagccaccagataaagctaaacccttgggcacagttcagcaaaaaagaaggcaaaaaatgcagcagaagtaagagctacaaatgcattgagcacatgctgttgttccctgactctgaatgttatgaaaccattggaactttttgatactcatcaatttgctataatcaggcacaatggtttttacttagcacatgatagagtttgcttttccaacgttttgtcttctccattttccagaaaatcacaagatctagaatctgttcaggaagttggaggttcttactggcaaagagtaactctcatcctggaattactgcagcacaaaaagaagctcagaagtcctcagatattggtgccaactctttttaacttgctatcaaggtaatgacacttggctttgatctgtgagagaataggactctaattcttgcccatcttatctaacattctcttttcaacatactcttctcttgtttagatagtctgtaaaataaagcaagtactataggtgaaattaaaagattggttttaggtatccattgctggtgccccaaactgaccttagtgtcctgtgtcatgtagtaaatggccactcactgtacagcctactttcctctgaacttttcagtagcgtgcctgggacgtcattacttgcatttcaagatatagtgttgaatttatatagatatagatatgtgtgtatatagtgtttgctatctaaatatattttcatatatatagatgtatatattctatatacgtagatttgtgtatgtgtgtgtgtaaattgagtatgaattgtagcgtgtgctttcatgtgaaaggcaaagtaattctgaaggttgtcctgtaagattccagataggctaatggaaagtgcaatagagaggacgtggaatttgacatagcgcctgtctatatgagagaaaattagagttagaaatcttatatcttatttctag

SEQ ID NO: 59099 - DNA, 1434 bp, Homo sapiens
taaaagctgtgcacacaacaaaggaactttacgcgggaatgccaaccattcagatcacagcccttgaaaaggtcagtgatttctttcagaaactaaggcatagcatgttcaagcatttaaaggtagaaggcaacaggaacagcgttaaaaaaaaaaagattaatattttatttggagaagatagttacaggtggactagacgttttaaaggaaaatgatgtatttgacccatttttgaaaactgaacgttgtacatgggtcattaaaaagaattgcattttaactgacaaaattaagtgggaaacaattttgtattttgagagaggttgatataaaaattatttctggaatttaaacttgttcactgaactcagttgccttttttctaccccctctagattacaaaaccattttttgcagccatatcagatgaaaaagttcagcagaagcttttaagaatgttgtttgatttattggtgaactgtaaaaactcacattgtgctcagactgtcagcagtgtttttaaaggggtaagctgcaaacttcttgtaattttttttattaatgtttatagtctcttccaagggacaccatgtttaagagtcctgtattttatagtgcttgtaagaggtcagatgttaccattaacaaaaatcatggaaaagtaagtcagagagaggcataaaataaaaattttaaatctttaccattattttattttatgaagtatttgttgataattttaaccagataggatgtgtaggaatatgtgtgtgtgtgatctttctcatattagacggaatctacctattcctttatgcaaggaataggaatgagtcaatggctcagtattgaactgggtaacattattctacttaatttaaatagttgtttaatgacatataatggaattgaaattctgcttgttggttttatacgtatattgaaaccttgttattatcagaatagccacctggttattctcttttttgaatatagaataatacaaagttctagtatctagattcagcagttctcagaattttaacatattaatcttttttccttctttttctttgctgaaatattttaaagtaaatctcataatgtcatgcactttcatccctctgtacttcagtgtgcatcttttgaaaagtggatatgactacaatgccattagaagtaaaaaaaaaaataattccttggtattatctaatacctagttcataatcatatttccatggttatcacaaaagtattttttatagttgttttctttgaatcagaatccaaagatttagttgtgatgttagaaccttataaaaagagatatctggatcccaccccatatctaaagaatctctggggcagtaaatctgtttttgtgcatgtgtgtatatgtcttattccttcctagctgattagaatatacat

SEQ ID NO: 59100 - DNA, 2349 bp, Homo sapiens
ataaacaaaacttttgcatattatgcagaggaattcatataacccatgttcagaacccttagtttgtactagtttttgtttcctttaacatttcaggaaatcccctcagaatggcacattgaactgatgttagacagagggatcccagtggagctgtgggcacattatgtagaagagctcaacagcactcagagggtggccgtggaggactcggtttttcttgtattttccttgaaaaaatttatttatgcactgaaagctcctaaatcttttcctaaaggtaagatacaagctgtgaatcttttaaatgtgatactctgcaaaactgaatgattgactccacaatgactgtcttgaataaaaagctcccagcatgttcatgtaggatctagcatcatttctctttccatgtccttgtaggtgatatatggtggaatcctgaacaactgaaagaagacagcagggactatctgcacttgctcattgggctgtttgagatgatgctcaatggtgccgatgctgttcatttcagagttctgatgaaacttttcataaaggtacaagcctcctccttttcaggcgtactctacccttaaagaagatatggctggcctgcaatcccagcactttgggaggccgaggcaggcggatcacttgaggtcaggagttcaataccagcctggccaacatagtgaaactccatttctactaaaaatacaaaaattagccaggcatggtgatggggcctgtaatcccagccacttgggaggcagaggcaggagaattcgcttgaacccgggaggcagaggttgcagtgagccgagatcacaccaccgtactccagcctgggtgacaagagtgagactctgtctcaaaaaaaaaagatgggctgggcgcagtagctcacgcctataatccgagcactttgggaggccaaggtgggtggatcacgaggtcaggagatcgagaccatcctggctaacatggtgaaacgccgtctctacgaaaaatacaaaaaaaattagccgggtgtggtggcgggctcctgaagtcccagctactcgggaggctgaggcaggagaatggcatgaacctgggaggtggagcttgcagtgagcggagatcgctccactgcactccagcctgggcgacagagcgagactccatctcaaaaaaaataataaataaataaaaagatactgtgggttatttgggttatgacagtttataatgtaaacaaaagtagacttgtaaacagtgaagagtatataatagcacgggccctgtaaaagagtacaatcacaatactaatcggtaggttgaatagaaactaacattgctacactcctactaatatgttaggcccattactatatttaaaaataacaacagcccagtctttttgattggttaataccatttaaaaatgtgaatactggtgttcagagaggttatttagcacacgtgaagttactcaggaaatttcatccccagcaccagtgacctccatgttgccaggcccagtggtcagttcctgttcttgcctgacttgttctctctacagcatttgacatggagttggcattgctcagcacattgttgaagtattttcttaattaggcgtcccagatactgctcttgtcttggttctgtgttttcaagtgcaaggttatagtgaggcttctgaatatcactcttcattgacatcttcccagttcattaaaacatggaatatggaataatttgaaatgattagacaaagcaaaactttgccttaaattatttgtttctttataattgtacactagtgagaagaggatttggaaccagcttatttgagtaagaattaaaagtttgcttttttttttttttaattaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccaggtattaaaagtagcattgttatgttttgtcatgaccaactgttcatgctttctctatatggtttatgtagtttggaaaattataacttaaaaaaaaatagcagagggcaggcgcggtatctcacgcctgtaatcccagcactttgggaggccgaagcaggcagatcatgaggtcaggagatcaagaccatcctgggcaacatggtgaaaccccgtctctactaaaaatacaaaaattagctgggcgtggtggcatgtgcctgtaatcccagctacttg

SEQ ID NO: 59101 - DNA, 1016 bp, Homo sapiens
ttttaacattttatatattttttcaatgtggatccatatcacacccataagaataatatatcctttttaccaccattttttctcattcccatttaaaatattagtctttttgttgttgttgttgttaaaatagcaaaatataatcccaaagaggagaaaattatctttgccttattaaataaacctttgtaaaggattagatgtgtgatttaaatacattaaccagttggcaagtgcaattatgttcattacagtttctgaaattattcttataattacttagaaatcagtgcttagtactttataaaggctttctgtttgtcatctcactttaaatgtaaaacacataatacctagatagacctgagttgaaaaaattgttttatgaaaatcaagagcaactggtaatagagtgtgtttatttttcaaggtggaggatttaataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggtaaggaaagcagaatctccagaaagtgggatgttgaataaaacaacagcctggcctattagtcacagcaaaactgaaaatcagaggcgagatgttgagtctgtggatagtagctggatgaaatgtgaagcagtcttgggtagcagtgagatagtcaactaggcactcccttgcttttgcggaaagtttagttgaattataaaattttagggttgcaatattttgtatctgatgcctgactctcctctcttttattgtctttattggataattacccaagctacacctaactacctctagcgatgaagaattcacttggtgtgttagtgcttgaacaaaatactatttcattcaattgtttactaaaaatagatcttttaggctttaaataatt

SEQ ID NO: 59102 - DNA, 1051 bp, Homo sapiens
aggactttctaatttgctgctttatgtaatttttactttataattaaaaacaaataccaatgtgttaaacaaattaaaaaataagttcagagacacatgataccatctgtggtaagtttttaatgagctctgtttatttcatttttggcaccaaagctttttgcaagaaaaagtaagcaagctccatagaggatgagagtgtgtcttacgtgtttttgtatctatcgtatgggtagatatctatcatgtaggatgtgcttggttcattttttttgagtgcctgagtgaacctgatttccggtagagttgagacatctagtgtgatatgtcttatgttatagttaacctctagtgatttctctaagaaaaattattattttttttttaagattagacaggatgagcagattaaaagtattgttggccaggcacagtggctcatgcctgtaatcccagcacttgtacaaaaaataaataaataaaaatattgtcacagataactctgttattggcatggattttaagtggtgtcttagtgtatctgaataatagttttggtcaggagaccaggatattgtcagttaagctggagtaatgtaatgatgaatttttgcccaattgaagccttccaatgtgtctttcaaccaagtgtgcttgcatgtcttttaggtacgaggtacttaagatagccgctgacatattaattaaagaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaaggtaaaaaattcagttgtttttttagaaaaagtgaacagataacacaaaagaaaacaaggaaaatttaaaatttattgttggtcatgcttatatgccagtaaggtcttttaaaatttttgccaagataaaaagtatacagtgaaaaggaagccaattcatagacaaattca

SEQ ID NO: 59103 - DNA, 1048 bp, Homo sapiens
caacccttgcaggtaggtattatttattagcaaacctgttttataggtgagaatagtgagatccagaaaggttaagtgacttgactaaagttacacaactagtaagtggtagagctaggatttaaattagacattcttattctttagtctatatcccgtcaatatctgggctctcactttaataagatgaactccttaactacaaaaactatatttggagtataccatatttactatattttcactgaaaacttgaaaaggatttgtaccaaacaattattaatctcaaaaggccctttagcgattatctagttctagtgtgtttcagtcctcatccagagcagagcctgtgttagactgtcattctggagtgtttttcacaaaaccatacttcctttctagtgcaaagccttaagagatttttggcaacagctaaattaatgtttttcttttattgctcaggagggtgttgatgaatctttcataaaagaagctgttttagcccgattaggtgatgataatatagatgttgttttgtcggctataagtgcttttgaggtgagtgaatttgtcatttgttgaggtatacaattttgtaaatttccttgcccttctcacttgattctctgcttgagactagaatatttttggaaattatttttccatgggaaatttgttctctggagagcacagacttaagtctggttaggagaaactcacagaaattcacaatttgatatattaaatatatatggaagttgttcaaacaggaaaaatgttttgtgaatttttatattgcttttaacatatttttatcaatagcaaataccttgggacctgtggaaattgtcttatgaatgccacttttgagaaatagatcttaaaacttttaatttgtactaggattcctgggagaaattccttataattcattctttttaaaattcgcatttaaaaagcgccatacatgtttgaagcaagtacaaatctactctggatatttttttccctttagattttcaaagaacacttcagttcagaagtgacg

SEQ ID NO: 59104 - DNA, 1520 bp, Homo sapiens
tcccaaagtactgggattacaggcgtgagccagcaccatttaaaatagcaatgtagtcttactatgttgttcagacaggtctcgaactcctgaccttaagcagttctcctgccccggcctccgaaagtgctgggattataatgccagtggtgtgaaccactacaccaggcctctagtttctttatctgtaaaataagtattaaactataccttgtataagtatgacaattagagataatatttctaaagcacttagaatatagtaggtactcaataaatagtaactcttatgtatgctgatatttctgtttttttttttacagccttctatttgaagagtatatttcatatagttcacaggaagaaatggattctaataaagtgtctttgcttaatgaacaatttcttccactcattaggcttttagaaagcaagtaagttacgtgtgtatgtttatgctcttctaaagtacttcctgttctataaagatatgattcacaagtcacatcttaatatactgaattgtacagagactgtcctttttaaatttgttcttcaagaaggggcgagtatcggaatcaaaaatatttgaaatataagaggaaatagtggttgtgtgggggctatggagagtataattttttatagagagactattttgttattggagtagtcatagtaacacacttgaccaatgtcatttggttttacctacaacatttgttaaaatttaagtcacagtctcagtaatttttaagattttatgtctttcctttatatgtgtatggtgtatgagattaataaatttattaagaataatgaattcactttttaattgcttcccagataccccagaacattagatgttgtattagaggaacacttaaaggaaattgcagatctgaaaaaacaagagcttttccatcagtttgtttctctttctacaagtggaggaaagtatcaggtatgttgttctccaaaggaattatgacaatttggggtacatttgtatgggtatgtgaagagctccagaaggaaatttgccacttttttcccttgtgtggaaaattttacagagataaccttctacagtttgcctagttgcctgaagtacggctctgaggcaggaatagaataattggagaaaggtacaataatttgtacataactatgaacgtgatacttatttcaggaaaagtattgtttgagaattttgtatgggatattcattaagaatcatcagaggacggcctcatgtaggtttctagcattctctgtctttcatctaggtctatgctttccagtgtaccagccacagatggctatttatattattgattagcaagggggagatgggttctatttcatgatcacattaaaacttgagaaattttctggtgattcaagcctaaagctttatactagaggttagacatttaagcaggagttcttatatttagccttaaaaacagataattatgaagagaaatatgattgttttagtatttctcttccataat

SEQ ID NO: 59105 - DNA, 1037 bp, Homo sapiens
tgaaagcaagggctaagatcagattcatatgtttattataaatctgaaatagatgacagcttttggttcagtaagggggtgggtactgagataaaagtttaacctcttttcagagatagttgattggcaccatcacaactaatttgtaatgtgacctggggaaagactaattttggacttttgttttgttattgttataagcatgatagtacttgttaaaaatagagaattttagataaaagaaaaatgaaggtgatctatacaaaagagctttaaaaaatataaatgactaaataagtggaatgcacttgtgcaaatagataaaaagctggatatcagtgtgtgtgttttattctgagaacgattttctgctataagtgaatttaataatgttagcttgcaaaataaatttttcccaacacaattttaatttttacatattaaggagaagaaactgaaggaatggatggtcaaatctacaagagacacttagaagctatacttacaaaaatatcactgaagaacaacttagaccatttgttggctaggtaagctattatttttgacatgcttttgatttacatttttgtgactcagtataattttcaagattggttagaaatttcccagcattcctttttaatgtatatcttgttttgtctgtatcatttcattaactataagtacttaatccagtaactggcagcattaaaagcaaaagtaatttttcttgcatgtctttagtgcttatagatgaaaatggaaagttagtggttaagacaaatttgggtaataactaaatgcagtttgtggccgtttgaagttttctcttagtaaatggaccataatatctgaaataacacatcacaattaaaacgcagtaaatgtcatttagaaacaatattgaaggtaagcatagagtaaggattatttctttaaagataattcagtctttttttttttttttttttttttctcttaatgggcaactcgatacagtgaaaagatgtaggcgttgtggtcagacataggtgtaa

SEQ ID NO: 59106 - DNA, 1056 bp, Homo sapiens
tgtaaagcaatgacagaagcgtatcatagtggctcagaaaccaaatcgaaccagtaaagttactaagaatctagagaatccagattttgataaatacctttcaaaatgtgacatacgataagcaaacatctttcactaaatacctctgccctcattgctgaccttctcttttgaatttctaagtttacatgattttatgtgttaatttcatcaccaccaccagttataaggagagattatattttttatttatgaattgtagcagtatgaagacattactagggtaaatgctttaaaataaggatcagttgatgaatgttgctagtagtttgttctttccatcaataacagcaatctggagtgccgttagctaaaggaactttgattacccactgctacaaagatcttggattcatggatttcatttgcagtttggtgacaaaatctgtgaaggtgagcagtctgtttcatgagtatataattttatgaaaagattgcttgctttgaatgaagaaaacatactaaaacattccctaataacaatgatactttggataaatttattttgttaaatggtctggtgttttgaagcaggagcagtttgagagtccgtatctttttttttttttttaagaatcagtcttttatcaccaaaggtgtttttctacaaaaataaatgtctattccttgccagattctagttacagtgactattcaaagagagtgtctagaaatgtcgggaatattcaacctgggaaagctgtttaaaaaattttaaggccaggtgcggtggctcacgcctgtaatcccaacactttgggaggccaaggcaggcggatcacttgaagtcaggagtttgagaccagcctggccaacatggtgaaacaccgtctctactaaaaatacgaaaataaactgggcatggtggggcatgcctgtaattccagctgctcgggaggctgaggcaggaaaatcgcttgaacctgggaggcggaggttgcagtgacccaagatcatgccactgtactgcaacctgggcgacagagactccatctc

SEQ ID NO: 59107 - DNA, 1051 bp, Homo sapiens
tcaagatagcctcattgcttgtgttctgccataccacgagacaagaatatttgtgcgagtcatacagcttctaaaaattaataattcaaagcacagatggttctggttgttgccagttaaggtataattgctgaatgacatatgtctgtaatcattacagatcttgattaagggatttaattaggaaaaaataagtcattgctcctggggatagtccagataactacctccatcatttttatttcctgacttccaattgaaactattattaatgttaataatatttagcttttatttagtatctgacatcaggctaggcaatgtacattatattatcttggattatcacaaaacttcatttttacagatgaggacaggctacttgccaaagttcacataactataaagtggcagagttgagatttgaacccaaatctgattccagagtctgtgcctttgtatcgtaccatgccgtttggcattttaaatttggaactgagaacttaaaaaaaagttgaaggtgaagaaaggcagaaaatacttacaaaaattaaaaggataaggataacttcaggggtttcaagaatttactaaagttgtgaggaagatgctaggagttaatttacagactaagaaaaggatgcttgtataacaggaagggtctgggtaagaaaagacagcatgctattgtaggaaaaccaactgactaaccgttagcactttgtttgcaacatatggtggaggaaagtagatgtatgttgttagcaggaacttgactgcatgttgggcatggtgatccagggtagggggggaggcaaatggggatgaaggtaagctaacagatcacgaggctgtgcacattaggctgatgatggtagtggggtcagtgttcagaattagtaagataggagtaatgaggactttttaattagaaggagaatttaagaatctgaacgtaaagcacttgaactaaagaatgttggagaaggccagcctttgataaagctcattaactgctcttcccaacattcactctgcccatagcatcaaa

SEQ ID NO: 59108 - DNA, 1464 bp, Homo sapiens
ctaggagcagaagctcctttcacgacaatctcggcctcttcccactttgtagagtgagtaacaagctcggagagatgaaataatttggtggcgttaacccggccgacaggcgccagcgccaggatttgaacccaaaccacgtgacttcacaacccatagctttcaacactacgcggtgctgctggcacctagtaaaggctggatcactactgaatgaatgattctggctacggatccttaaagcccacagaaggcccatccagagaccgaaagcttcagacacaagccgcagagcagaccgctaaaccggagctacagaggcgaagctcagacttgagcctgagtccggcgggctgaggggcgggctttcgtctcgggaggcggagctgtctcgtcgcattcccggcaagcttgaacctcttcacttgccgtagcgcctgcagcaggaagttgctctacagcatgccttaggtttccgggtgagggttgggctccttggtaccatgtgggaagcgctgtgaagagttgttgccttccaagatatacccaaattcccagttccaggtaagcggcacagagccgcttgatgtggctgcggatgggggcggcatatcgagggagggtaagagttttccggatatctgcggaatcagggttgaaggaaagccttggcgcggtcgccgctactgtaattagttgttaacgctgctgccatcgtctttgcatctccggggtccacaaatctcaggacacccgcgttgtgtgtccatgacggtgctgagtgcagaagagaattgtttgtttacgaggcgccttataatttcgtagaaacttatcaaagtgcttacgtttttttagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggtgagccatcttttaacttagaaaagctcttggaagcgtttgttttctggatgttactgttttttttttttccccttgttttctcttctgtcccgtcctcttccttagcagtttctagcatgttgatgtatatttttaagggaaagagaacataacagtcaggtgcttggtgcttgaaatgtttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactag

SEQ ID NO: 59109 - DNA, 1071 bp, Homo sapiens
ttggaaaacttggctgtgttggggtggtcagggacccagcctcttaggtgtccctcccctggctcgcgatcacccacccgggacaccgacggaccccgcgccgctaaccagccgctctcagagcgtgggtggcaggcgtggctctgctcggggccggccgctcccctcacgttcccggaggcctcggcggaaggcgtgcaggcggcctctgggcggcggctgcaggggagacagtggaggggcccggcgcccttgtccgcccgcacgtgctcggggcggggcggctggggcccgacgggcggggccgggggcggtggcggcgggggcgtggccgggcggccacgtgacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaaggtcagcaggggcccgcgggccgcccgcgcgtggtggggccgggtcccccgcggggctcccgtgcgcgtggccgcgtggcctggcgactggcgagagggcgctttgtggaggtgctgtgctgtcctgtgccctcgcagccccgggggccccttaggaaagaggacacgtccggggacaggcaggacactgggcgtcgtgtgtgtgcgcgcgcgctagcagcatcggaggtacagatgtggttctgttcctcacaccaacccgcgttagaccagatctgaaggggtctctggtctgctcctgaccccttgagtctgtgaccttggcccccgagttatactctcctggcccgcttgtgtccatttaccccagcctctctcttc

SEQ ID NO: 59110 - DNA, 1009 bp, Homo sapiens
atagctaaggaattggacaggtagtctgcccatcatttttgaaagtgatggtctaatcacagtgctttctgttgccttttttttttttaagtacagtacagtagcaggatagaggtaatgacagtttccagaggccacattgacatcccttctgccatatttaatcttttaacttatttgcagtatttttggatatatggcttcgaattcttttaggtttgggattcctatgttgactgtattattataattgcatagcacttgaagtaaagttgattatttaaaaataacatacttcctgatcccagtccaaaataatgttagaaagtttaaggtgagaattttttttaagatagtttgaatgttgtacatgcttggggggcaaaaactacattaggagagatctagaagattctctatttctacttttggtatagaccctgctcaagtcagtaaaataatattgaactgtgagctcagtgtggccagagcagtggcctctatttatgtcccatgagacaaactgctggaaccggacaagggtaaaataccattgtttctattgtgggctgccttctccacacttgccatttcagtgatatgctgggtatgagatctgtcaacagatgctggtagcacatgatgacgtccgtggcgttataatggatgtgatgcctaattatatctacagttcagagagtctcatgggctatggtaatccttgctctgtggtgtggaaggaaagccttgctgtagaaggactttataaaagtgtaatgagttttataagagaagggaatgcagaagatagtgggtttagcatgagtgcgaataggcgtttcaacgtgtctaccttctctttcaagagtgtgttaggaagagtgtgttacacagaagagtgtgttaatagggttaggaatatttatattttctataaagaagtattttaattcatacaactcaagggtagaagaaaaatgcctgcagtattacagatgtgatatatata

SEQ ID NO: 59111 - DNA, 1044 bp, Homo sapiens
cctcaactgaagcctaattgggaggtgacttgtcagagcagcaatgctgaatatgtttgctatcttcacaagctcaggacgctgtccttaactgtactgggaggctagagcagaccttttaaggacacgaaatatgtgtcgatacgtaaagggtccttatgtccataatcagtccgtggcttgatgatagataaacttttctaagtgttctgattgtttttaatagtccctaaagaaattcagattcttctgtactcttcacagttgagatggctggattcaccttggagcacctcctgtcagtctggcatttaggcaaatgtgttgccatgttgggtcaggcagcctggcaggatgcgtgtacagaggcagccgcccacagggttcggattaaatagagagcctgggagccttcgagttgcccctgcccttgttctgtgggcagcagctgctgatttagagcacaaggtgaaggctcttcctgcctaatgacacatactcttgcataaatttttcctaggagaaaaggcactaattgtttgttccaatgattaacagaaagcttgtgacatttctcagattcatgagacccagatgagtcgaagctctgcctggtacccgactacagttgaatcactaaatgtttcaagtctcaatttcttcacctagaaaatgaagataaatacctgtctttcttaactcacagggttttttgtctggatcaaatggttaaactgttttatggtgaagcggctttatacattgtaaagtgatctgtaaatgttcaaatattattatccttgtgcgccgaatatttgttaatcagcactgcgcttagacttgtgagggacttgtgagcatgagatttggcccttggtgaccttgatgtactttgaaaattgtggggaaatacacataacagaaaatgtatcattttaatcataagtgtacaattcagtggtggtacgtctattcacattgttgtacaaccatcaccactctgtgtctccagaacttttctatcatctcacattgaaactctgt

SEQ ID NO: 59112 - DNA, 1043 bp, Homo sapiens
ccctttcatcaagagatgggagaagttcaaaggtaagagtatagaaggagaaagtaaccaaggtggctagaccaggactcaggtctcccaaagcctagctctgtatcggatatgtctgtggctcatggtgtgtttgtgcacgtgtgatagggagataatacccgatgctaaagatgcatattcaaacttagaaagttggatccacgaaaaagggccaggttatagagggcctgggatgctaaggtgagtgcagacttcattctccaagacatgcagagctccagaggttttttgagctgggaagacccatgcttacagaactagtattgttggtgagataaatctgagtggacaagggcctgaggctgggggacccaggcaaaagcctgttatgggaccatccagataaagtggtgaggattagaacaagggggctgttagaagcagtggtgaggaaggcatcaatttgagagtgatcaggagggattatacgaagtattaaataaccacatgttgttccacagtaggctgtggtataaatccaattaagtagatatgatcctccccattagagctcctgggctttaatgtcaagacagtggtattgacaagcaacaaccaaactaatgaggagagtctgtttatccactgggagattgtgtctggataagaagttaagtatttacaggatgtgtcattattctgtgcagggaaaggagccaccgtgctgaggtggcaaatccggtgtccatgtggccattgctgggagggagaggtggaattgtagatagtctttgagagccagagaaagttcttaatgggcagaagtgtcaaagaagaggttaaaggcagggtcttgtgtgggcactaagaaacctctgcacccagagggactgtaataaatatacatgtggtttgctacggagaatcacaggtgcaggagttctgaggcacaaaaaacactctttgcttttacatcctatttgggacaccgtgatgtgtcccggggttgccctaggccttcagccacattcaccaggtaa

SEQ ID NO: 59113 - DNA, 1500 bp, Homo sapiens
ttttagaattgaaaaaataattatacagatttatgtatatcataataaaatttgtcaccatatttatgagaaaaagttctggtaacctgaatttgatttgaaatgagttccccccccctgcccagattgaaaaccttcacccacttaataaagaaaattccaagttcatttatgattcagagacgtataaatttaaatttgtttttgtatagaaaacatggggaaatttttttgaagatgcagtgtgcttcacagtgctggaattggaaaatggagacaagattgcaggtgattctgtggtcctgggaaagaactggcatatgcagtcttcatacatgccaagccctagaccaagaagttggcataactttgatttgtcttatttgtttttgctagggggtaaatgtgttggtcatagtctttagaaattattatacactgaaaacagattcttattagtatccattacaaccttttcataaaaagccatgctatcttagaaaagacctatattttattagtgaatgtgagaaccaaatgtacaaataggtgaatatgagattgttttggggccaggcgcagaggcttaagcctgtaatcccagcactttgggaggccgaggcaggcagatcacatcaggtcaggagttcgagaccagcctggccaacatggtgaaaccccatctctattaaaaatccaaaaattagccaggtgtggtggtatgcgcctgtaatcccagctactcgggaggctgaggcaggagactcattggaattggagtgagtgagctgcactcacagctggagcgcagtgagatcgtgtcactgcactccagcttcggtgacagaagaagactctgtctcaaaaaaaaaaaaaaaagattgttttgggggaatgggagcagtatttaatatgaagctatgattgagttttgcaaaggtagttataattgagattgcaaagacaaatcaagaaatcctatcttctaaagtcatgtggagtctttaagttattttgttatagtcaaacaagatgtgaagatgacaattaacttttagaaggtaggtaatctcattgctgtttatgaggattttaagataatttatatgtaagatagaacgatatgaaatacttgatgctgaccattttgacctccaaaaattacagtctctttatttcaacccaaacaactttactgctgttgtcccactattttttttttttttttttgagatggagtcttgctctgtcgccaggctggagtgcagtggcgcaatctcggctcactgcaacctccgcctcccgggttcaagcgattctcctacctcagcctcctgagtagctgagactacaggcgtgcgccaccacgcccagctaatttttgtatttctagtagagatggggtttcaccatgttagccaggatggtctcgatctcgacctcgtgatccgtccaccttggcctcccaaagtgctgggattacaggcatgagccaccgtg

SEQ ID NO: 59114 - DNA, 1025 bp, Homo sapiens
atttttgaggggaggcaggtattcaggtggtcagattagaaaaatacaaaccatgcgttttgtgttttatagactgtaatatttccattctgttattgtaattttatgaaatataaggtggctgattattttattgcatatttggcctttcatgttagaatttggagcagaggatgttgtaatttttttcagtctaacactaaagccaaaaaatattccgatcagacagtaaaagtgataatatgtggatttttaccagtgaattgaaaaatgagagattttcacatattattcctagtatcccaaatgatttgctgaagaagacagagaaacaactattattgagaaattccaggcactgttttaaccttatgtatgattttactggatcttcacaaccatcttgaaaggtgaatattatcttcattattttagctaggctcaagttaagtgagttgcccagcagtggttgagggtggggaagtggtagccggaaaatgcacacagaattttgtctaatgtatgtagaaatagttctctcctataattgaaattttataaatatggagatactaattattttattgcatatttttggtctgaaagtggtagagctggatttcagatccaggctgcttaactgtaagggtcttgatttttatcactaaactttatctgtttttgttgctttctgctcggatttgtaaccaacccagagcagaagcctgggattcagtatttctgattttccacttacaaacctcctacctttgtggaagggcatatgtgtgtgtgtgaattttttaatttctaaactggtgcaactgggaatgtctgataacagtgagaaaacggaattttgaggcatggtccatattgtcattccaagattttcccccagtcaagctttaggagttgcattgtccaacagaaataccaaagtgggagggaaggggccacaggagaagtcagctaaacttcttgagagttttaggggccgtcccatgaagggcacattatcggag

SEQ ID NO: 59115 - DNA, 1036 bp, Homo sapiens
gggtgaccctatctccaggtttgtccgggacaatcccagtttgtggcttttgtcccagaggaattataaatagcacctcctttgactctcagaagtggcccagtttagactacaaactttggtctccctgttctgaggacatacacaggcagcctcatggaaggttaaactcatattgacacccaagtgactttttttttcccccaagtaatttgtacatagggtagtaatgccttttctgaaagtgctggcctgtttctggaactttaaaaatggaaacattggtgaagtgagatttttaatactttgagatatatgtatatatatctcatatatagtctagtaattctgaatcttttaattcataaatcttttagaagaccaagctttgtagaacaccgtgaaagtgagccctgtgactggagggctgtggggccaccagcccggctgagtcctcctgcgggccaggttgccctctgaaacggggttgactgttatacttttggttttgtattatatgctatgtatatggttttataaatgtcatttatacttacactttagacaatttgatgttaatatgggccaggcattaatgacacttattttacacatctgcaaaatgaagagttaaaccttatttaaagatctggaccagttaccaaagtcctgtctgtagatttgctcttttgacagtatgtcttttctgaaaattataagaatttatttctatgttcaggcacttgaaaatctagcagtgaaatggtgacaaatgtatttactgtgtgataaatcatgttgaatagaacaagttccctcatttctataatgagacacaggtagggctgtcaccatggaggcctttaagaacttggtagggaagcaggaaaaatcatgtcagaaatgcctgatgtgtgacggtgagttctattgctgtaactggtatctgcgtaactggatattaaggactctaaaggatttctattctgcagtcctaggatagggcagtctgtaccctttccagtaggattttaaa

SEQ ID NO: 59116 - DNA, 1025 bp, Homo sapiens
ggttcatttcactcagaaagccctacgtctgggatgagtttccattttaggaaatgtgatctgaaatgattattttatgtaattattattaaagaaaaagctagttaaagaagtataaaggaaatgtatagatatgttgccaaattttttttttggagaaaatggaatgatgaaggttgaacagatagttttacagaagccagcccaggcttagaaccgtattgctaaaagaattaataattcactgataagtgaaatggactgatattcagggaaccatgtcagactcatgattgatttttcgggtccccgtctgtgtacctaggtaataatctcttctaggtaaaattgtgcacatgcgtagtcaaagaggatgatgtaaataatcacatttttcactcattttgattaaaagacttttcctacccttaccttagggaatgtaggttgatatgatgtaggcttcattaacttaaaaagaaatcaaatacaaatgcatagcgattgaataacactggtttgtctcaacaattcagtaaggacatgcacattttctttttgccgttaagcacattgtgctgattgtcctgttacataatttcactttgagaaaagcaatactcttgtagttcccatggattagggactttgctagcaagtcctccaagccattgaatgagactgacaattgtagccagcaaatgcttctggaaaaccccttcaactgatatttcctcaaccaccatgttttggaggttgaggaacatcctccgggtctccagatcaggggctcacaacgcccagactgttgactggtactggtccgtgacctgttaggaaccgggctgcacagcaggaggtgagcagcggatgaccaagtgagcagaagctgctccccattgcccgaattaccacctgaactccgcctcctgtcagatcagcggcagcatcagattctcataggagtgcaaaccctactgtgaactgtgtgccagaaatctacattgtgcgctctttatgagaat

SEQ ID NO: 59117 - DNA, 1058 bp, Homo sapiens
cttctctgccgcgccctctgcgcaaggaggagactcgacaacatgtcacccgcgctccaagacctgtcgcaacccggtaacgctgcgaccccgtctgcgtggttgggttgtgtttcttaactcgtgctgtggcctcctaatccctggggcgattcccttctgcggcgggagacgcccggcggtgtttccccgcgtgtgggcggcacctttagaacttagcgcaggagcccggagggctacgtgttttgctccactctttgtccgaccttcacctctttctccccaggcaagccatcaaaacctgcaaaaagcgtcctcccctcgcccccgaaacacattcttaacgtcacagtaactaaactttccagttccacgcagcataaaccagctgggccctctggaagtttttttttttgcatggtgtgacgcttattcgtaaatatgtattgcgcacctactgcgaaagaaagttcaggcgcggagagacagacgaggaaactcagagaactatttaaaactactacatggaactttttattttctgcttctacgcacgctgctgcaaaactgcaatatgcatagactcactatgttaaaatagatgagcagaccccacctccagataccgaaatgggaggtagtaatttcaagcgattctgatgttggtggccctgggatcaacagtgagaaaaagctagtttagcacgagaactgaacgtaatgttagctttataacgagctctagatctctaaggtcatgcctgattataatttgaggacaaatacacccgtaaaaacgggtgaggagatgtagaaacgagaattagtgataagtacaaaacagtaaatatcctatcacatagtggggatgtttagcttcaggaagagggggaatactaaattcgtaacgcacaaggaaatttatcagaggttaaccggtgactctcttgattcttgggttctgataacgggactgatataattgttcttgaaactagtggaactgtggctgagaaacacatcactgctgttattaaataagatataaacctccctat

SEQ ID NO: 59118 - DNA, 1038 bp, Homo sapiens
ggagatcatatttatttggaaaacatcttttactcatgatttctggcctcccccttcccatttaatttaaacaagtaaagttatttccctttcatctgaatttaggtgtcattatcaggagcaaaatgccactgaagacttaaaatactgtgaatagtgagtgatttaaaaaaaaaaaataaactgaaaggaaaattgttgaatgtttgaatcttgcctagtcccctcacccccaaggctggcttctagagttgagcactgagtggagtttaaccaagtctagggcctctgaagttctgaatcaggccattgtgcctagaaaagaccttagatgtagtccagcttctgtctatgtgagcaacttttattgggattagaatcaggttttaacttcctaataacccttagtaatttactggcgtacaatcttaatgaaattttaatggagagctgggaattcctgattctcaaggttgggccttaaaactaaatgtgacttcagaccatggttgtgtgccctggggaaggaggatggtgggctagcaaatacatcttgggagaaaattttaactacagcttctaaaagtttcttggtttcatccttgcttaggactgtgagtgttatttggaactcaattgatgagtgattaatgaaggaatgaataatccagtgaattggtatcaattgatgagtgattaatgaaggaatgaataatccagtgaattggtatcagcctaattcttctccggcttattaaaatcaaagggggaaataatatatattaaaaatggaatactgcacaagcaaagagatgcccccaaagaagctgggcgcggtggctcatatctgtaatcccagcactttgggaggccgaggcgtgcgggtcacctgaggtcaggagttcgagaccagcctggccaacatggtgaaaccccatctgtactaaaaatacaaaaattagctgggtttatagtgagcgcctataaccccagctactcaggaggctgaggcaggagaatcgcttgaaccctggaggc

SEQ ID NO: 59119 - DNA, 1001 bp, Homo sapiens
gtcttgaactcctggcctcaagcagtcctctcaccttggcttcccaaagtgctatgattacaagcgtgagccaccatgcctggctgatgtgttaccttatgttagcatatagctaccctgtgaagtagggttataatatatttgaatgaagagactgagactcagagagtttaagggacttgattaagttcttataaccttagcatgttaacattgtctgaattcaagtttcgtgtttatttattcataccacgtgcctttctgtgaaatccttacacctttttgcatctctaccttctaatgcagtgccttactcttagtaaatggtcaaaaggtagctgctgataatggtggtaatgaaagggcatgtttattctgggggcacaagaaactctaaagctcataattgacattataatctcttgttgcaggaatacttgctggctggggcagatatcattgaaacaaatacttttagcagcactagtattgcccaagctgactatggccttgaacacttggtaagaattccattgttccatgtgtctaagatgcttacgagcgtttgctgcattggtagttgctagtgagtaaagcactggaagctgcagagtcaagctaatgcctagttatctgttgtttatgatgagacagggaaaatggtgtgaatccttccagcttgtgaacacagtggcccattcattttccaactggcttcttttatgggcaagtaataatcaaatataaatgatacttaattatgcagtagctgttgataaaggcataatcattggccgtatgcacacagtattgtgaggcctttttaagtattagatggcagccttggtttctttcttttttaaaaattgtgattaaataacactaaaatttatcataattatttttaagtgtacacttgagtggcattaagtacattcacagtattgtgctatcatcaccactgtccatttccagaactttctcattttccaaaactgaaa

SEQ ID NO: 59120 - DNA, 1178 bp, Homo sapiens
ccaactgttgtacatgaatcaaggcctggaaaagttgctgtgggaactgcctggccaggcagtgacagactagtgcttgaacctgcgtgttttgcctcttaagcctatgctctttccattgctttatttttttcttaattctcagaatatttaactacgtaagttattctctgacatgctagatgtctagggattgccctttttactggctagctcatggtttgggaggagaacctaaaagcagttcccaaggactcttgtctttccttgctgcctttcaagtctggagctgatatgcctgcttggctaagatttcactcagacctcagattaattcactctacattttgttactgaagaaaactgagtattagatggtcatgaatccattatttattgtgcggaggaaaagaaggacaagctaacgtttgtggttgatacgttaggcctaccggatgaacatgtgctctgcaggagtggccagaaaagctgccgaggaggtaactctccagacaggtagggaatgttcttctctttttttgcacacgtggttcctttgatactgtcagctataatgtgctgtccttattgcagtttttccttatgtggcctttggcttacgagtaacactgcagagactgtattttacatgtttgtagattacttctctgcagtttcataatcaagcactcaacatctttgaattgatgccaactctgtggtccttgggctcggaatttgctctttcaccctgggttagcctgactttgtagctaggcccctgacttccttgtgtatttagagctgaaataatttatgtctctttggaagcacatcatcatgtcattaaaagtaacagctggctgttttgatgatcttggctgttattaggataattgatctcatttttttaaagccaccctcattcccatgattggctgatataggtaaagatattgcctttcaagcattttccctttatactattgatgtccttgaaggctctgtgaagcacacaaaaaagtgtggcattagattcagtcttgcttggacttgaaaagtggctcctgaaataactagcctcctggctggatgccatcagaacacttgggcaccagctggtaggaggctttgagggagggaaaggaatataagaaatatatgtagccccttaagac

SEQ ID NO: 59121 - DNA, 1052 bp, Homo sapiens
catttcaagttaaatgctactgtaaggtgattttgcagaacttacgttaagttcaaaaccttcagggcttcataaaaataggaagagagggaatttgtccaaacacagctgtggtgatagaaaaggattacttactgaaatgttttagttagttgtgtgagaattgagagttgtggggactggtttcgtgatgatatgtgtatatctcctatatggcataatttccttagtgggatctggggcagccccatgatcaaatatatgtaagcagaatctatgaatcatctaagttggataaagactataaatagtctctcgttagtttaggagaggtcaagttttattgtcaaactgagaaaaaagtttgggcttttagagctttttggatttcagagttgtggacaaaagattatagacctgtgttccagaaaaaaatcttattggctattcattcacgacaaaaaatgttcagccacttagagatctcacacttgtttttcttttcccaaaggaattaagaggtttgtggcaggggctctgggtccgactaataagacactctctgtgtccccatctgtggaaaggccggattataggaacatcagtgagtatttaccacatataatcattgatcttggggaagtactccccaagcttcagtaagctataaatctgtaaaatggaatcaataacaggatctaccttagagttactgtgatttaatccatgtaaaacgtgtacagcagtgcctggaatatagtagacatctaaatagaaagttagctatgatgattattattatttgaacttgctttcaaatatatatggtggtgtgttaatgctgctttgtcagctgtggaaataaaaccaactaaaataaagctgtaaactcagaagttgaacaaatttggatactaggtttgtggtctattataaaatagcacacaatatcctcatttatcagaaggcagtccaaactatctagacatctgtattagtccattttcacactgctgataaaggcgtacaagactggacaatttacagaagaa

SEQ ID NO: 59122 - DNA, 1015 bp, Homo sapiens
ctattgctaaattgctttaaacaatcaccttccatcagattttaaaagagtgacatcaaatgtgctgtttaaaattgttcttttataaatcacaaacttgagagaagtgtgatctttgtatcaagtacttcacattcataatagatcataagtactttgtgtgagatgcttttggcggaggagtcacacagaaatgtcagcattgaaatgttggctccctgcttgcctgtcctgggaacctcagggtcagactaggatcgggcgtaccctgcgactagcttggaaggctggggccatgaggatcattgccagatggaagagaaatcataagccagtaccgtgcatggaaagcgataatctctatcagtgcaccaaggggcctggaatgcttttgtcatgacccagtttatagtcattatttttctctgcctcatatctgtttcttcctcagctcatgctttggcaaaggtctcaaaagccattttcttttattaacaatgaaagcagtgattatgggtgctaattctgtgcctgtcaatgttattcagtttcatttttacaataacagtataaagcagacactttactgtctttgtaaactcagaggcatatgggaagttgccccaaggttgttcattcaggtaagtgatttgaacccaaggccgtctgtacccagaacctgcctataaccatctaatgagactgcctctcctaatactttaaatgtaatgaatagaacaaaaacagttcagagccttttctgtagtgatactttacactgtatgtttttacttcagtgtgatatatccacatgtattatctgatatttgcccctaaattggccagtggcaggggagatgttattatgttggtggataaggaaacaggcaccagaagtccacctggcttacctagagtcagctcattagtgatagacctgccacagtgactcctgtctctcaggtctcaacctggatccctgattcagccttgttgattatgggttctaggcctc

SEQ ID NO: 59123 - DNA, 1049 bp, Homo sapiens
ccctttacagagaaaagtttgctgatcgctgacttaaggtatcactgtaaattctcatttttatttgtattgcccttagtctggcatggacatggggatagtgaatgctggaaacctccctgtgtatgatgatatccataaggaacttctgcagctctgtgaagatctcatctggaataaagaccctgaggccactgagaagctcttacgttatgcccaggtagagagacaagtgttctaatagatggatttttcctatctttgaatgtattactcacctacagttagtagaccttcatggtggaatagaagcaaatatcgaatcatatatttggatcactgaagatttctacagagagttgcagagatggtggtgtagctagggcaaggaagggtaaacagaccatgcctagggtgcttccgtattctgaacttaggtttctttaaatttattgtaaaatgtaaaattaatttttcttgtaccaagtaacatattagttctagaaaatttacaaaattctggtaagcaaaggaagaaaataaaaatcacttgtaatcctaccacccaaagttaaacacttgagattttgttataacctttaagtgatgggagtttttatttctttttgcaaaatgaatatgcatgcataggtacatatacatacattttttacaaaaatagaactatactctagatgcttttatggtaatatttttttcttagcagtgtactgggaacatatttccattttacttgatatttttctacctcattatttaaaatagctgttctggattttcttgtgtggctatgttagtgttacatggtccccactgttccatgttttggtttgtatacctgtttatgttaggatctggtccatctgtggcaaagttctgcagttcaaggcttaggtctgtgcacatttgatgtgtaaaaaatgagtataattatagctaattcaaacaccagcttgtttctcatttatatgttgggcgcagtcctaggcacatgaagtatctatcgtagatggttcttcttagaattc

SEQ ID NO: 59124 - DNA, 1055 bp, Homo sapiens
tgtgtcataacatggcagagggcatctcatgtcaagagggcaagagcaagagagccagagagatagcaaacctgcttccatggtagcaacattaatccagccgtcataaattcgttaatccattcatgggggcagagggattaggtttccaacacaacttttggaggacaccttcaaaccataacaatggcagagtccttgagagcatagtctgtgtcgtacacctcctagtgtgcccacctttgatgtctgacttagcttcattatggcctccctgcatctgtttttgggtactggtgatccttgttgagagctttgaaggctcattgggtttggagtatagcttctcttactgtcctggaaattttgtgttgagttgttatttttagaaaagagggaaaggaaagaatggaattttactctgtctctacactaacagttcaaaccctaaaagatttctcatttttccctctccttccctcaaacattcattgagatcttattttatgctggacagtctactaggggctggaaaagtaaaagaagaataagacacaggtttttttgtttgtttgtttgttttgccatcaaacagtttggttagtgatgagttgtatccatttcttggtttcaatttcaattcagactcaaggcacaggagggaagaaagtcattcagactgatgagtggagaaatggccctgtcgaagaacgccttgagtatgcccttgtgaaggtaagttacaggggcctgaactggagggctggaggctcatcatggctgactgatcctgttgtgggcggtgtgacagtagctggagaaggagatgcctagaccactgattctcaacctggggaggtccctcttgctgtcccccagctgcccccccccccccccccccccaccatagcacatttgacagtgttcagagacatttttgattgtcgtaactgtgcctgggaggtattactggcatcctatggccaggggtgctgctaaacatcctgcagtgcccaggacagccccaaaccacaaagaatattccttcccaagtg

SEQ ID NO: 59125 - DNA, 1099 bp, Homo sapiens
aatctggtaaaacacgaagatacaaaatggattttatgcatttgaacttattagtccttctctgttagcacattttactgaggtatattttaaagcattttttaattggcatataaaattgtatgtatttactgcatacaacattctgttttggaagtgtatgaggtatttactttgtttgtatcaataaagccagctaagcactttatctcaatcctcaaaataaacatatgagatactattgtaatattctaattgaggaaactgaggcttattgaattgcctaaattagtgataggaagccagattgagtccatgcactctgcttctggaacctgtgctgttaggcattttcatgatggctctgtggaggtaaggcagttttttaggtgattttttttttctttctttctttttcttttttttttttttttgtcttttttagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttagcaaaatatggggagaaattttcacagttgcatcttttctttgtcatttaataaatggcgatttgggatatatttctcaggttttaatttggacaagagttcaatggtattggctagtcattccttctctaaatatgtttaggagtcatgtctgcaagaatccgtcttcagagtggtgtggatgttggaaatccgaaaattcttagcatcataatctatcataatccttatgttctaatttttgtatcacctcttacccccagtgcctatctctcccctccaaaagtaaagtaaaacccaagataaatgtagagttactaacattaagacttgatttgaccaggcactgttcatctgtaaggatgcatattttgagacaaatgttactgttttaaatgacggtacattaagtggtttgtttaaagtaaaaccagaactcttactttgatttacagcagctgctaaccacatcagttaacacatacttgttgagcatg

SEQ ID NO: 59126 - DNA, 1045 bp, Homo sapiens
tgatcctcctgccttggcctcttaaagcactgggtttacaggcatgagcctccatacccaacctctcttctgagcactttaaaacaaatactgtaaaatcaacaacttccgtaacattcatttttattctctttagcctcccatgtggcgaaatacaggaatgtgtatagggagaggcttacagacatagggtatggctcaaaatgacaaagggaaactgagggagagtcaaggaagatggggttatgtgtaggggtaaaacaggaggttgtggtagaggtgagagggatggtgggaagaatggtagcaggcacagagggcaggctggatctgacctgtgccctcttctccgacttcacataccctgggattcctagctagttcaggactctgggccctcatagtgctggtctctgcctagacttccctgtttccttcagctaatacccacttaatttttcaaaatccatttcagactttcccctaggatgcttctggttgtcacccattttgggccttccatacatagtacactgtaaatgctttcattgtagtacttgccacaccatattctaattcagagcttgccaacagtttctcaactcagatgtgccaggaaacccattctctttcctgctggagagtggaactgggcctctgtcctacatgggttgaccagggctgtgagcaacttcctttgtgcatcccagtaccataagtgtcatttcagtgtgtggaaatagtgagaattgccctctaatcaatagtacatttgactatttccccagcaagacgactttgaaggcaggctaattagctggaaattgaacttgtcacccaggcctctggctcagtgttcttggtcgttttcttacctcactgatctgtggttatgattctctcctgctgatctctccttctgggagtggtctttaaacacagaaatgttctggggctcagcccttggacctcttctctgtcttcactgtctagatgtgtgtttctcaaactgtaatgtaccttcttgtcacctggggattttgtt

SEQ ID NO: 59127 - DNA, 1096 bp, Homo sapiens
ttactgaagattccatatgtcatagttttttttttaactttttttaaaaaagtaatatgagtacaagctaaaaatccagtggtatgaaagggcatatagtgagaagccagtccccttcctgccccagcgttcagcacccattgttaccagccagtatgtcatgttgtagtcttaagcattcttttttgttcttgttatttaaacgtttttgcctatttaattttaagaattgttgatgtaatgaaataagtaaaaatgcatgctgtaagtttttcaacatcttttaacaaatagaagaaggttaaattatcaaaatgacattaaggtactctgtaaatttaaaatagaagtaattcctagaacattttccagggcagacattcctgtttcctctgagttccaggaagctctctcctccatgaattgaaatttgtctggcactgttccgttctctgagagtgtgctccaggcttcctctgccccagcgcctgttctcctgtgtgcccatctagagtctgcctttcctttcagtcttgccctcttgccctcggtgacctgcaccctgaatcactctccctctttttcttgcgttaagtaatcagagttccctgacagctcttcgtgtgcaggacctgacctctttttcatgatcttccctgttggcttccaagttcaacaggtgtttattgaggaacttccctagccctttttattggcctaaatagataagataatggattttggagtgagatactgattcagatcccaactctgcctctaattagttgtgtgactagacagattgcttaatttctctgggccccttctcattaaaatgagacccatagtagtgctttcatgatagagttactatgagggtttaaatgagatcatttatgcaggccgggcactgtggctcaagcctataatcctagctcaagcctgtaatcccaaaggaagccgaggtgggaggatcacttgagcccaggagtttgagaccagtctgggcaacatagggaaaccctatctacaaaaactgtaaaaattagctgggtttagtggggcatgcctgtggtcccagctactctggaggctg

SEQ ID NO: 59128 - DNA, 2083 bp, Homo sapiens
attctttgctttttcttggatttctttggcttgcaataatctttttcttaacactctcacttgcgattcagttcctgagaattataatgaactcttctcgtgaaattaaaccgagtggagaagctgtgttttttggcacaaaatcattacttgaacttttgcccactctgtcttgaagcaggtgtctgactgaatgattacaggttcctttgaaggaactctaaccttgtagtagtttggagacagaaagcccatctagcaagaatgaactaaatggtcactttggggagttcctgaaaggggagctttgtgggaacctttgggttaacaacataaagaggtataaaatgtaaagatgagaaagttcaaatttgttcacatgataattattcagtttaccagatttttcctgggatcatgatcatagtgatatgtggtaagtgctacgttaactgtgggtactagactttttatgccatgtacagttcactttctcagcattatcatactggaacattgaacacagtggtcccatagcatctagtttatttttctgatgcagaaatacaataaaggtctggttataggtatgccagaaatacaataaagatctgggtataggtatacaataaaggtctggttccataggtatgccacaataaaggtctggttataggtatgcaaaagaaaagtgttccttttgcactacaaacaactgtacttttagccaatttgtatagggttgttcagaggaacagaatcaataggatatgtttatatatagagagaaagagatttattttaaataattaactcctgtgattgtggaggctggcaagactgaaatctgcaggctggagacacaggtaagttgattttttgagtctaaaggcagtctagaggtggaatttcttcttccttgtagggctggggagtgaataagggactccttgtcttgtctcttaaaggtcttcagctgactggatgaggcccaccaacatagtggaggataatgtgctttacttaggtctactgataaatgttaatcacatcaaaaaaaatactttcacagtaacatttaggttgtggttaaccaaaaagtagataccatggcctagccaagtttatacgtgaaattaaccatcataccatttaaaatttgaatgagtcatcttcataagtagaaacagtattatgtgtcttttatccattagctgttcttcatacttgaaggattcgatagtttgactatcgttgcttaacgttagaaaacagggtttgcgtttccacaaaggacttatgtaccaggaaatgtggcagacttggtctcaagggatatggccacccattaataatgggttttgatgagcatgggcttgggtaattgatgacaggcttagtgaagagaatggtaagaggacctatggactgttgtcagaatgaaagactttaatatcaactgtgaagtagaataaataaatatttaaaggaacataattaaaatacattatgtgttatgtaaatatgatgctggcttcaaaaaaagaatctttttatatggtgggacactacactcagaaatttgcttcttgtgcaaattggaactttaccaaatagtccattctatcatttactatgtaaaagctaccagattaaagaaaaaaaaacattgagaagcaacgtgactagcctctcaagatacattattggcaaaattagcttgctaatgattcttagcagttgcaacctgatatatcagattagaattaacaagataggaaatcaccaacatctcttcagttactgcgaaatatctattctcattgtctgggaaactgtaaatgtgtttggcctgaaggtagaaagctgagtccactgaccacctaaggtttctttcaactctccagagcattgtttctgtatgagccctgcctcttctggttctcttctcttccatgcctgttgcagtttctgggaaattacttggaaaataagagctagtaggtagcactgcttcccgggaaccattcccttctacactgtggtgctggaacagcctttggaaaacagatttccacgcaac

SEQ ID NO: 59129 - DNA, 2398 bp, Homo sapiens
actctcttatcaggcaggctgtcccaagggtttagagtttgtctcccagaaaccagtcaaaggccagtcccttctttggcttgtgcagggtttgaacatcccaagcccactgagtttaccttttcctgcacgccaggcaggaattagcacagttggtgaagggagaagaaatgaagttaaggaagccttcctgaaggaggtgttatcagcattgaccattactacaccagttttatcatcttttgctcatctatggctatcttgcattttcagtgttcccagctgttagatgaaaatctaaaggatgaatactttgaggaaatcatggaagaatatgaagatattagacaggaccattatgagtctctcaaggtaagtggtagaaacagatttttgcttgtttttaatgtgactgttttttatgatcctagtttttaatgtgactttttaaaatggttttgaggagtgtaaaaggctttggatcattttagagaatttctgtcttctagttcaaatcagaggtcttcagtgtcttaagttcccaaataatttttggttgtattgaaatgaattttatttattcagccaaacatttactgggtacccagtaggtgttaggggctgtgctagatatcagaactatggtaatgaataaaacatgagttcatactcagcagggaaacaggtgctgaaacagtgtactgaaatgactcccacagacccccattcttcaggagctaatggaagaaaatggagacatgaggcaggaccagtataagccttttgcctgactgcccaacactgactgtgcagaatgatgttttaagaactgtccgtctcttgatcagcttcagggaatccatggagaacaggcataattaggctttggaagtcactgaaatatttctttccggttatctgccttctgggctttggtgggagcattttgggagttgctaggcaagtgaaatgagatcaacagcatgaggaaaacacgctgttttgcttctgaggtggtaggtaggccaagacgcagtggttggcttttttctctctccttaggttcgcccacagtggacagtttctttaattctaccttctggtcctcagggtgggccatggaagaccagttaacagctgacctcaggtgttctaaaagtacaggtcagacacccctagtacctcaggttcaggccgcagaactaggctcgtatttatatatcagcagttaatggatgcttattaagtctttactatctattgttctggtgccaatgtgaaaccgactgggtagaaaaggaagagctttttagaataaacattctcatgaataagagcatttgctttcttgcaaagcttacatactggccttcttggacatgttttcacagtagttgtagaaaagctaagagtgtctaactaatttttctttgttttttaacaggagaggagatacttacccttaagtcaagccagaaaaagtggtttccaaatggattggctgtctgaacctcacccaggtctgtttggctatggactagagaaagactgggtgtggtaactgacagtgtgctgaggaaatacatgcatttacttggctgcaaaatcaaaccagcagctaacgactctcaactgtgtctaatgctgatgagtgactgatgactggaaagaaagggaataggtaccatttatggagcaggtgttgtgtgccagataccatcctgagatggactcatagcagctctctgagtccttcagacaactccataatggacatgggaattatctgcattttaatttgaagaaactgagttttgggtggaaacttgaaaggttactaggaatctctctctggtctgtcttctaaagccatgctctttcctctgtgctgtgcttgcgtgggtccccgtctccttgaaggaagttctgtggaaacctgcctgggtggtactgtcacctgaggtggcctgggtctttcgcaggcccaggggcagatgtgaaatgtctaaaatgggaaacgcctttgcattcacacatctttaaaacactgcagcaaagcaggatcctctatttcttgctttctctctgtcctctctctggatgtttccctctctttttatttcttttatttggtttcttcctttttttaaatttctagccacctttcttgcctcatataggtgttcacaagggaataaaacgtgtaagatgttttgacaggcgcagagaggcgtgagacacaaatgcaaaaccaagatagagtgaacaggggttatattaattgaatccatatttccaaggtaatgtatcaaatcagctttcattgctcacgacatctgtgttctacacatgcttggcagagttgagcggattaaattggaaatgtaggtgtgcttgg

SEQ ID NO: 59130 - DNA, 1086 bp, Homo sapiens
tatagttcaagctccgattatttgctctgtatctttccctgtgaaattggaataataacacaagggcaagtctgtttggattaattcaaacatccaaaacgtattttgctggaaataccctccaaaggcccacagcacctggcagcggttgggatgcttttttagtggccgctttaacctctggcatgggctactgcagggtccgccctgctgccccagggccatgggccactgagggctggccctctgaaatatgtcttgaggacagccagtcctagggtagttgcaggaagtcggtagggaataaaagagggttttcttttacggccctgatggtaacacctcaaacatttcttaaattctgggagacgagagagtccatcagtggctctgcagcagcatgttctctctgccttcccaggcgggaggacgcttgaatcaagggtctatctgtagattccttttagtttctctactaaggggactataaaggctttgttaccaacaaaccaacataataggatatttccaaagaagggattgtcccgtgtagtagaaggatgatgaggaacaaatgggaaagggctaccgtgaacaagtatgaaaaggtagagatttccaggcaggagtaagaagtcaaatgagagaaaaatactctagaagcttctgtgttctcccagagcccctgagattggtagaataggaagttccctgatccctggttacaaatcaggaagtagagagacaggaaggctcggatacggcaatggagccaacaccttagactccagcctaatcctgccatgtcagaccagagtctgaggtgcagaccacactacagtctggagggcagatggcagtgctgctctacctgccccagaaagcccagcagcaccatctgtctctgaagtcttcaccattatttaaattatgatgtattttagactcaccaggaggtataaagaacaatatattaaacatccacgtatacccactagccagcttaagacataacctaccatctgatttttaaaaaacgaaacaatgcagagtgaacagaggttatattaattgaatccatatttc

SEQ ID NO: 59131 - DNA, 1623 bp, Homo sapiens
attgagctgcagagcagcagctgatgaaagtacaaaccaatcaagaatccagcctgtttcctcttgtcaaatttcccctggctgtggtccagatgagggagggtgtcctcatggttctaattcagggggtggaggctgcactgatgctgtgagcccctgcgtctgcctaagcatgcctgctgctttgggtcccaaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggtaggagccaggaggctgcgggttcctgtcttccttcttcagtagatactcttatcagcatactggcacttagggttaaacatgtttttaaaatggaagggcttctaatcacattgtcccttatgctgtcctttttcactcgtagctattctgcattttacttcagtattactgattagtattcttacatcattatttttagatgtatcaatttaaattatttcctcttggcctacgccagatgggagtttagcttatgtataccatcctgtgcctctcctgccccagtttcctgtcacaggcatggtgatgtctttaatccctcccttagagaccgacctttgtccctcagtaatgtcactttgcttcatgctcttgtctcattgcttgtggatggtgtccctgggtgctggtcttgcagagcgcccagccttcccttcagccctcttttctctttacttttacactgttagtaacatttatattcttctgtaatcataattctctgttatgttttgcctgtggattgattctaaaagctgaaaatgacaagctggcatgtgcctttctgagacaaaggcccagacacccggcctcagcgtcctgtgcccagagctgacttggctcgtggttctgtggctgcacattgtcatgtcaatgtcctggttctgtcattactgcagagttcatgtagttgagatggcccaggctaagctcacagttttcagcggaattaataaaaagcatgccatcaaagctgataaaggcatccagatttaagtgagaaaccatgagctgtgctgaatctgcttcagcaggaacaacactaactctaggagtcatgagatctgggtttgagtcctgtttctgccataagctagctgggcgacctctggcaaagcactcacccttcatgttgctctgtttccttgttcatagaatgagtggcttcgaatagatatccttgagggtctgtttgagctctcagatcccaaggaaaactgtctcttctttctcacaatgttgtgggttccttcttcactggagctctcagtcgtccctagtatcagtggccgcacagagccggtggaggctgttcagttgttgttctcatctccaggggtagagctcctgcctgagaaggtctaggcttaggagcaaattagggcacctgtaactgatctgggatggctggaggtgggagtgtagagtctttcccaggcctgtccccctg

SEQ ID NO: 59132 - DNA, 2154 bp, Homo sapiens
tgtggtcaagcagccatgctttctgggcattttcgtcctcccataatttcatatttccgtacccctgaggaaacaaaaaggaaatgaggagagaaagttactgttaagggtggttaacattttttttgttttgttttgttttggtttttttttttttgagacagagtctggctctgtcgcccaggctggagtgcaggggcgcaatctcggctcatagcaagctccgcctcctgggttcatgccattctcctgcctcagcctccagagtagctgggactacaggtgcccgccaccacacccggctaattttttgtgtttttacaaaatacaaaaaagtagagacaggatttcactgtgttagccaggatggtcttgatctcccgacctcgtgatctgcccacctcagcctcccaaaatgctgggattacaggcgtgagccaccgagcctggccggttaacatcttttaattgtttccaggattgagcaggttctcagctgggctctgatatcccgtgcggagttggacaagtgggcagcataaagtcactcatttcttaccattttattcccctcaattctcaatatattcagtaatgaagaatggtgccaccactcaagcaacaagcctcaaactcaaccatgtcatctttttcttggatgattgcagttatttcaaaaatttgcatgcaaaatatacactcatcctacttcaagatggtggtggcaatagtcaggagaaggtaacattggagtcctggtttgattcgaaggatgaagacgaagaagcaagggaggaacaaatgaagaaccatctttgttcatgaataggaatattcaagattataaaggtatcaggtctcctaaaattgatctatggatttaataccattttcaatggaaattccaacagattttattgaatgaaacaagcaggtgtttatatggagtagcaaaggacttaaaattaccaaatgcttctaaatatgaaggagaggttggggacacgcaccctatgtgataccaagttttattgtcaagacagtgtcatggtgcagaggtaggcattctgagcaggggaacaaaataagggcctagaaactcacccgtgcatatgttgacctttgcaaaatgacctggtgacatggcaagtcagtggggacaggaaggaccactccctaagtaatcccagaacaatggctattcatgtgggaaaaaaagaaattttactttctctcaccttacctggtgataagttccaaatatgttaagggctttaatacaaaaagcaaaaattgtcagtgtttggatgaaaaaagccttagggcaggaaagaatctcttgagacataaagtagtaatcataaaggacaagatggttaagtcaattctgttaaaactcaaggcttatattaagcaaacacttgaagtgagaagatgatccacaacttgagaagacatttataatacaaataactgatgaaggattcataatcacaaatatagagaattcctatttaaaaaaatagaaaaatagtgaagactacacaagaggaaatagggcttttaaataaatagatgttctgtagcattggtcagggaaatatgaattaggaccacaatgagattccattttatatccataagatttgcaaaggttgggtctgacagtaccagttgttagatctgtagggacttgtacaacattgtggatgtgtaaacaggcaccactgctttaaaaaacaattatcccttacagacttgaacatttgcagacgttatgatcttgcttccaactcccacctgtatgtccagcaaactcttgcatgtggccactaggaggaatgtgtaagaatgttcatagttacatatttataatagttaataactggaaaaagtgaaatgtatgtctgtctacaggaaaataggtgaataattagatatatatattcattctacgggatattattcagtagtggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaa

SEQ ID NO: 59133 - DNA, 1051 bp, Homo sapiens
gtactgttggcccaagaccgggcttggaagagcctcttcactaataccttggtcacggtgtataaacctgctagtaatacagttgtctttttcatagaaaatagactataagggtttttttttttttaagtaattaacaccacattagatttttctcaaaactaaggactattttattcaggtggacaaatacggttgctgtataatttttcaatcaattcgtatcaaactctgtggggttaaaactagctgggacattttggtaggcttcatgcactcaagggcttcctgcgggcttaactgttaagccgagctcatggaggtggtgttatcagaatgcttaatggggaccgagggaacgtgctggctgatgaggttctgcacatatcaagtaatgtcaactctgtgccactcagcagctgcctgtcagctagagcagcacctttgataagtgggtcctgggtagagatctggcagtcccaggctgggatttttcttttaataaaacatccgtaggttgctgtgctgacgacaaatgaccttgaaggaggtgacacagtggagcagggggatttttttttttttggtatagcattaacatctaaaaggaaaacatgcctttcctcacaattttccaattttcatatggaaattctcaaatcctttaccggcttctccacccattaccctccatccttccctcccccaccccccttttttttctcttaacctgagaatgttggtggttcagaaatgctgatggggtgaataatggggagactgtagtatagttcccacattgaagtcgcttcttttttttctgagggcatttatttctctgtcatgtgcaagcttgtcaatatgagttatttcttcttcttcttctttttttttttttttaaagcaaatagcccaaggagtattaggaatctgtacatcttgataaaacagttgtagatggaagaattcttgatagtgatggatgaagctgttttgcatagaaaaacaaaaacagtcattaagacaccgtaattgtgaatttgatgggaca

SEQ ID NO: 59134 - DNA, 1087 bp, Homo sapiens
tcatatccaaacatatccatgatttggaatgtgtgttttattttaaagattttattaacttaccaatgtagcatcaaactgtcatttggcatttaaaaacacgcatctttttcgttatggtcctctttttttttttttttccaacaatcatacagaatgttatagaagatattcctctgactttaggaaaaccatggtataaaatgaccttggtcaaggttttttttttttttttttttttttttgagtactttgtctttctttcatttgtctaagcacagttgagttacccttgtggtgtactgtgtcatgtagttttgtatttacccatagattgagacttaaagcttagtcctggctgtaagaatgatcctgataggaatgcttacggtcttcctcctgtcttcttttgcagaatgaagtatttcattatagatttcttctcagtgttcatacatcttgttccacaatgacaagaagcatctttaaatatactcatctacaaatggtgacaattatgcagtatagatgctggtgtacaacactgcatagtagtttggatgggaatacttagccctagtttgtagaggtccaggaaggttaatggtatgaagtcagtactcagcagtgcagaacgaggactaaaattcaaatcttaggctaatagtgttctttccaggagagaaaggcttctttatctgctgttcaagtatgttttaggtttatagcaaaagaataccaagtcagttttctcagctgtaggaatgtcacagagtacaaaggaaaagatggaatgagcagtggaaattcgcactttttgctcccttcataatgaagctacgaggagctttagatagatatgcactatggtattttcccaaggaactgatggaaagcccacccaggcttacatcatcagacttattttattttaacttagaaattagcatgtacacattggcaggaagggcaagatctaaaacgcttagggcactaatttatttgacattcaattgtatttgtactttggcttcagataagtgtttttatcacggctgaattacccaagaaaggactccagcagcac

SEQ ID NO: 59135 - DNA, 1816 bp, Homo sapiens
aatgttacagtccctcacatggcctgaatcttggtcctggaagccaagattggaatccatcctttctagcctttttttttttttttttgcctccctatccacttactccttctggtttatcttgaagcctgttaatttctcccatcttaaaatgtctgtctttgacccggataccttatttggttgctcccctcctgcagaagtggtcttctcccactgcttgtacccctctccatgtaattatctagcttctcttccttcttcaatttactttccaggatgttgccagtaactccctccttgccacgtctaaatgtccctctctgtccctattcccttagattccttctcaagctctactaccctgactttcctttttgaagctactcttttgactttggggacatggtaccttctgggtaattttttacatttctgatcatgctttttccaggtgcttttcattccttttactccaagtgtgtggttatcccaaaagattctgtcctatttcctgttctggctcttctgccttcatgagcttatctatgtcacaaaatctgggatctcttgaataacagagtctgaaaagacttaacaatgacttcatccagctctgagagccagagagatgaaaggaatgttcccaaagcgactcttttttgtaggagaaacccaccgtagattcgacagccctgggccttcacttcaagcctctgtttagacttccctcttgcctctcggaccccagaaacaccagcttgacatcattgcctgttcggttccctaagcgactttccttcctagtgtctctgctgatcagtggcactgccgtttgtggctgtggctccagtgtgatcctaaccttcagaagacctgagtctgaggccggaatccaccagcacctagctttacggacttagaacaacagtgcctggctcatgggagtggctcaatgcatttgtctagttctctttcttctcttctgcatctaatttgtcatcatagcccatcgtgtttctctttgcaatccaactcagatttcgatgtgtttcatactccgttagcttcttgttctgatcccagtactcatttcaaccttcgtcatccttcctcctgcaacaaatcggcaacccacctagaatccgcctgccattttagtcctcctgaaaccctcgtgtccatctcccagcctcagctcacatccttgcatatcctgtctaatttctctacttggccttttatgatctgccccttgataccttgcttatgcttttcatcctacacagagttttcttggatcactctaaccaattccgattttacctttctccgaccatttatcactaataattaataaaatgtatggaactgattgggaaactcaagcaatggtcagagaatgctctgaccctgatgctctgtgggtgagttgggaccgtgttgggcatcggtttcccatgatgcttggtgcactgttaactacaaggacagacttgagagaaatcttgtggcaaggagaagatcgggacaagagaaaggatcctcctgcccacaagtttaatgtgaacatcacttgaatgcgtccaaatgcagaaagaaggaacctgctatgaaggaagtaggcaaagatagtgggggtggaagaatagaggtaagatctcttctggaagcagaagagtaggagtgttggtgggtgaaattctgagatgaggacaccggaggtgtgtagggtgagagaggccaggtgatgattgctgctttgggaggccgcagtggctcccaggtccagtgggaggggacacccggagaaggc

SEQ ID NO: 59136 - DNA, 1064 bp, Homo sapiens
agagaggaggtgggagcttgaaaggggaggaagggtaaaagttagggatgcttttcttttctcatgaaagagaccataatctaaggttgtagaggagaagtggtgattgatgttgcaagttcctaagtacaagatgggatagagatgccccccagccccaccaacacacatcaccattgttgggcacacgcctaagctgatgcatcgcctctctttgcagatacctaattactgcttttcttaattcgagagcacatacgattttcatttgcctttggtttagctttgcatcatttcattttctgctagggaccttttgatcattaaaattagagctctataaagctttgttggttcaaagctgggcgtgttttgtttgcaatttgcagtggtttggtgatgaaataatccagctaggcttgaagcaagcatgtctcattaagacaaatgggagaagctgatattgctggcgggttttttctcatagctgttaactcaaaaagaaggtagggcttatataggtaattatgtatactattaagcaaatagtcagtctagggatatattggagggattttctgaaagctcaggtcaggggaaaatgttgaaatatcttaggaaacagaatgattctgctggtagtgactgccctcagctctcctactatgataggatctggctaagaaaattccagtaatttttcagaaaattagcaatttatattttgagagttttttcctccacatttttgtgtaattggcactatgctgtacatataatttgttgcttgcaaagcactgtctttcaaaaaaatctaaccagtaaatctatacagtatttacatgtgtaaattccacatttgttccatacttcacactgttgatttaaaggtaaaagctttcaacaaatgtctgcacttaacaacagagcatatatcttcatctcttttgtgttctgaatgagcacctataacactttctcaaaaggaatcttccttggaggcggggcgtggtggctcacacctgtaatcccagcacttttggagccagggcgggccggattac

SEQ ID NO: 59137 - DNA, 1076 bp, Homo sapiens
gtgagccatggtgcctgaccagaattgtcttttttaaacattaacttttggggagtattttatatgatgtgaataggaatcttttgttagatacgtctattgcaaatatcttttccaacactcttgcttttcccccctctgttactgatgttgttagtgtcgaagagcagtttttcactttaatgaagtccagattatcagtttttttaaatcatggtttgtggttttttttttgtatcttctttgcctacccaaaggctgttctcccatgttatcttctacagcctttactattttaaggctgatatttaggtctgtgctcttagaattgatattttgtttatagtttgaggtagagatcagtccctccacctatggatgtccaattgatccaggactagttatttaaaaggctaccttttcatcactgcattgcagtggtacctgggtagtaagtcaggtggctgtaagcagggatatctattacttgactctcttttatttcattggtctatttgtcttttcttgttccaaatttataacttttaaattaactccagatttctgctgttttgttatatgttggtgttcatcttctaactttgctctaagtcttcaaaattatctttgctattcttggctcctttcatttcagtttaaattttagaattagcttataaatctccacaagatgagctgctggaatttttaatgaaatagcatcaaatctgtagacccgtttgagaagaattaacatcttttcgatattaagactcccaatctatgaacatggtatatctttcttttatatatttagatattttaaaatttctctcagtatttgcacttagttttccatgaaagactttgcacattttgggggtcagatttatttctaggtatttgatgtttattgatgtcaatgcaaatgtatctttaaaaaattgtttcttagactgtaaaaatataattgactttacatttgaccttgtatctagtaaccttgccaagttcacttattaattctaatagtttatagattcttttggattttctatatgcccagtcatgtcatc

SEQ ID NO: 59138 - DNA, 1099 bp, Homo sapiens
ccatccatttccacagagtggtcccagctggggagattatatgcaaaggagacctctcagaaagcaaggtggcatgtagtgggcatgtgataagctactcactgcatggctcaacatggctcaggcaacaactcaggcaagaggattctgcagaaagagagatggatgtcatcagaataggcggggaagtggacttgtggttgaccttgaagtctgggcattccaggctggagggacagcctgggccctgagaaaaccaccttccactggagccattctactagaatagttttcatttctcatgcagaggtctggtcttcaaataaatgattctgaaaaattggacttagagactatcacgggaaaatgatgaaggtcatagcctctgggatcctgaaaattgtttgggacttttatagactttcacagtcctggatttctgggtgggaggaataaaaaccggattggacagtgtcgtccttcaacagaagaggcctgacgttaagcaatgccctatttcaaatactttccactgcagaaagagtgctgtccaattgccagtctgggaaatctcttcctgggcttgttttgttttgggattaaatcacatggaactcttttcttcagctcatgttgtcatacttgagacactgctatttcttcccttttatttctaaattgtgaaccttctccttttgtttcaacctagaaatgtacacttctcgttaattgttcttatgagaatggtttctttacagcaataggtggcggataacaagactggaaactttgagtacacaggaccacactggtttcagttctaattttcctaagtggctttgctgagggaggcaatatacattggtatatattggtatatatttggcaagggaatatacgttggtatcttatttttctaaccatagtaatggtatctggaattgttgttggcttttaggctaagccattcattatttttaaccttcagaaaaaaatttgaagatacttaattataaaataaaggctgctcagattttaccacttggacaagagatgaaagttccagaagagtacaaactgagctgctctggcatgttcg

SEQ ID NO: 59139 - DNA, 1058 bp, Homo sapiens
ctcattcttgtgtattaatttttaataaggaagtgaaccccagatgacagaactgattttcttttattgggtgacggttgagatctcctattgcttaaatcaggttaaataagagagaatgctgctctgtaagtctggcctctgggtctctggtatatttacaaagatttaaacgtaatacctattcctgtttctcaggcatcctcatgacaccatcttccagtataggagaccaaaatggataagatgaaagcaaaacatcttgtgtaatgcaatcaaagcaactttaattttttggtttctggcaaggaggatatgggcttaagtaaaatactccattgcaccgtttctggggatttatgtttttaaaccaagtataataatattccatgtacatccactaccagtgatattagctattcccagtccgtgtcacccccagggatggagtgggctggagacctggggagggagaaatcaagcctcatatgctgtgatgtcttgacaagtgagtgcccccaatcctgttggcatttgtgctgcaggagtttggttgatcagatttgtattttagataaatatattaggtcacagtttgaatttcaaattgcatgtcctttgccatttttctttattaaaatgtatgcattaaaattgttatgcatgaagacaaatatcaagattgactgatgttttcctccctattaatttcccgtaggaatggtaaaaatgcaattattcatctatgaaaatggtgtttaagaccttgaaaatgaagagaatttggaaagccacttgtgccataaaatttctgaacacagaaacgggccagtgattcagtcgatattgattgattggttgattgattttaatttcttctccagctttattgaggtataattgacaattaaaaattgcatatactcaaaatgtacatatgatgttttgatttcattgtgaaatctttactataatcaagccagctaatatatccatcacctcacatagttgccattgtgtgtatgtgtgtgtgtgtgtgtgtgtgtgtgtgtgtgtgt

SEQ ID NO: 59140 - DNA, 1064 bp, Homo sapiens
ccacccaaacctttatttgtacaaaagcaaaagcaagcaacctcatcgttaggagaggagttactgccccataacccaggaaagtcttaaaaagaaattataccaagtgtacttttcatctctatttctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtgaaagcttcatggtagacttttgacttcaaggtcaaagacattgctgtggactttggtggtgtgtgaaggcttcgtggtagactggggctgagatgagcccctaggaaggaccaggatttagacgggagcttgaggaacaggacagacaggtggggggagtgctccaagggagcaagggatagagagggagtagatcagtctgcctggagttgaggctttgtttacaggcgaggtgctggtgagggtggtggagaggcatccaggaaggttgaaaatatatttctgtagccacctgccatcctgcatgcaggcacacacacatacacagcagccgtcctcttgttgaatgcctcttctcactaaatacagatacatccatgaggcttacacttactgctcatttagtaaagtagtaaagtcacagtgggagcccgggaatcaggaaataaacactcagatgttttccttctagttttgatcagctgccctgagagaatgagattttaaaataatttgacaggccggcatggtggctaacgcctgtaatcccagcacttcgggaggctgaggagtgtggatcacttgaggtcaggagttcgagaccagcctggccaacattgtgaaaccccttctctactaaaaatacaaaaattagctgggcatggtggtgtgcacttgtaatcccgctactc

SEQ ID NO: 59141 - DNA, 1068 bp, Homo sapiens
tttttgcaaggattacaagagttaatgtgttttaagtacatggcatagaaagtaccaaataagtgctagtttctttctcttcccatagaaagttaattaccataaaatagttatagatggagtgagttgggtgtttagagtgagaagactttcagctgtggggatcagggaaggtttgtggtcttatgagctaaaggattggaagaattaagacttacagaaataaagggaaaggacattgaagagagagaacaagataagcgtctggaagaaagagattagagttcagatgctcttaaaaaatatcgtgttcactttcatattttatccttttcatatatgccttctcccgggctttgaaggaggaaattggtgatgttttcctcattagacatttatctataaggatcacaaatcagacaattttcccttattttcctttttctctcctgttttcttctgctattcttaaaaatgattggatcccacccttcccatcttcagctgtagcattttgagacattgtgcctttttgtctaaaatattctatttgatgaacggttaaactaatagtctgtgagctcctttagggcaagaatcacgtccaggtttcgtctcctcagtgctgagggttgtgctcaaaacagagtaggtagggaaggaatgattgccgaatgaatgaatgaatggagaaagagtggatctagttccatgggcctaagactgaggcccatagtctctaatgtgtttatgcaaaatgctgcatggtagctgctaatagaaagcaagttctttcctccagttctgatgtgatgtgatctggcagagggcagcatgcccataaatcaacacacggtagtgtaagtcatccactggtgttagaaagttatgagtaaggccaggcgcagtggctcacgcctattacataatcccagcactttgggaggccgaggcgggcggatcacctgaggtcaggagttggagactagcctgaccaacatgaagaaacctgtctctactaaaaatacaaaattagctgcgcgtggtggtgcatgcctgtaatcccag

SEQ ID NO: 59142 - DNA, 1126 bp, Homo sapiens
attttcttttgctgtaggttgtttctggcaaaaccggagttttattgatggacttcctttatgtactcactctgcgttagcatgttggagacataggatttgctggcatcatctggttatgaatgtgactgtggggccccagggaggttcccaaggttctggttggtggttcgagtcaggactcaggttttcctgtctctggaacagtcgtttgtgttataccaggccataggcacagaatggtgagtggatttctatcctaggagaggtcctttgctgtgttcaagtacttgggatatcgaatgacagaacttgtttttagagagatgacagcaataagcctgctagtatgagctgttggcaatcatatagcccatttaacccttatgataactgttaaggttgttattattattactaatactacaaaagcatgttgacttaaatttgcagatgaggaaaaagaggttcagaaagatgaatctgcaacccaggtgccttgatatagatgctgtagatacgacaaactactctttttttttttttatcagcttattgcatccagacagggtttgaaatggctctgaaaacaaaaaaggaagcaagaacccagtagttgtgtgttttcctgcttctactggggtttgaaattgaagacaattggtttgagtcctagcactgttcctcattagctgtatgccttgggcaaattacttaatctctccaaacctttatttcctcctttgtaaactgaggacagtaatagaatagaatccatctcactgggttgtggagagaattacaggactcctacacttgaaaagtggtcggaagggcacctgcacaaggtcagctgtttgtgattgttagtaatattgagattgctttgagaatacacactctgacaataaactgaggatgcttgttggaaagagtagctgggtcaggtgagtctttcaccttggagtgactgatctctttctctgcatgttaagttttctacacaccgcaaatacctgtctatacacgcacacagtttatatgtgtgattcttaattgcttggtaggcattataaaaggggacaagagcattaaaagagagtttgactttcatgataaaagatta

SEQ ID NO: 59143 - DNA, 1053 bp, Homo sapiens
caagtgattctcctgcctcagcctcctgagtagctgggattacaggtgtgtatcaccatgcctggctaattttgtatgtttagtagagacggggtttctccatgtttgtcaggctggtctcaaactcctgacctcaggtgatccacccaccttggcctcccaaagtgctgggattacaggtgtgagccaccacgcctgagccaccacaccaggcctccttcaatcttttctatacattcattaggaagtgttctctatttgcctttagcacatatgtatgcatatattgaaggagtgtggattagtggttaacaagtatcatatttggcatcaaattggcataggctctagtctggtcattgtatacccttgggttagctatttgtccccttttgacctgtttcctcatcagtaaaaggaggtaatactgcccacttcattgtgcagaaatgaggaataaatgagaatatatgtatagggcttaagaaattacccgggaagtaatgagcactcaaccgacgttaacattgcttattattgttgaattgtgaatattaatgacaaaaacaattatatgagaaaggtgctttataatttcagtgttaaaatagccaatgatcttagcatgtcttgtccggcatgttgtaaaacatttgggtattgaagagttcctgaaagaaattcatgcgaccttttaaggacatcgtagcagtgctttgctttttataagaaatcattaattacaaatgtcaagttaatggcagcttaagaaacaactgagtatattgtggtctaggaagtgtccttttggtaggcttttcatgttctagtaacaaattatcttcagaagcatttttaactacaataaatatattgagacaaaatttaaaaaaattttggagtcggataacttgggtagaacatggaaacatacttgtctggctctataataataaaattgccttctatgttttatggtataccttgtgcttttcaaagtgttttcatttgcattatcttattcacttctccacaaaattctaatagctagct

SEQ ID NO: 59144 - DNA, 1194 bp, Homo sapiens
aattaatatagcaatccctggccaattttggatgtctcatttcttgtatctctcatgcatggctctggggtggatgttggactgagtcagggttttctcttgcttctcttgtgaggggatgctcctgttttttctgtctctgccattccattatatgctggtcctataacccaaggcccatagactccctggtctttgttttttctcatagtttgcatcactgggtgccgtgtgttggtcttgtgacaatctctgcaaagaagctctgatgctggctgggtgctgtgtgttgtgggggtgggaacttatcccactatcttggaaagcaggcaccggggaccacaggtaggcttagattcctagggaaggcagcactaggaccatccaggccaaagttcagggtgattcctcagggattgatacctacttaattggtattttacatcttcagctggtttacctttgaagcttttatgtgttgtcatggatatttctgttggaaaatgtgggatggcaaatggagcttagcgagttagctgtcactgccgcagagacgtctcacacagatttgtcagggacgatgtttgggctgctgggatagtggcctaattcagtaccatgttcaatctcagcctgtgccctggataccgcttaggttattggatggcattactatatggtgacacggacgcggatgcattttatctttggtgagatagggcacagaaactttaaaccttacatgtttgacagcatcacagagtacaaagctcaccgtggctcttttcaagtacagccccattccatggcactgactcaggaagcttgtcatagactgtgccagtatttagatttgactatatgtgtacaagttatcaatgtgctctgcagtgatggtacagaggctaagatgtgtaggcatttgttatgctctttacaagatatctttgttagcatgataattttgcatttgtactctgaacaatcttctgatttttttcagagttaatattctttcaggtgaggaaatgaaggtttagatagacaggcttgctggagttttcccagctagtacgtggtacagctgggatgagaacagagcttttcctctatttagtctaggacatttcctaccattgcaccaatttttaaaacaaaccactgaatcatctactttccagaaggaaatttcat

SEQ ID NO: 59145 - DNA, 1034 bp, Homo sapiens
actaacttcttatttgatcttttcaggattatttccatcagcatgtaaacatgtgatcatatcttcttaccgtccctcaagtgtatcaaaaacactgttgttggaactttctcctagctagcctatgattttctctctcacaaattcagattatgttagcagagggatcttccctgtatagcccatttaaaatatcaactcccattattgctctgtcctaccctactttattttctttataccaattccccaacagatgtgtgtgtgtgtgtgtgtgtgtgtgtgtgtgtgtatgcatatagatacattgtctctccctattttatttctacaaagacaggagttttgtctgtttcgatctttcctttccatagtgcccaaaatagtgcctgaaatgtcacagacagccccagatatttacttttttgactccatatcgtcttcagctactataccatttctttgctcacctttgtaaaacaagtcaagagttgtctgtacctgctgctctgctgcttctcttctcattcattcttaagtcccctccattctggatctcttccccacagctccactgaaatggcccttgaccagaccaccagtgaacaccacgttgccaaatgtaatggcaattctaaactgccttctcactcaacttccaggtagcattctacctggttgactattttttctctttgtaatctgtttagatcggttggcccctgactttctttctaccttagaggtcattctttataattagcctttgttgaattcctcccctctttccaacctcataatgttggtgtgcaccagggttcacttttagatcgtcctgtctttagttacctattcattcccttagtgatctcagctggtatcatgtctttatatatgttcttcacagggatgagtcctaaatatttatcttcagccatgacatttttcttgaattccagatttgcatatccaactgccaacttgatatctcacttggaagaacatcatcacaaacctaactcatctgaagttgg

SEQ ID NO: 59146 - DNA, 1091 bp, Homo sapiens
gttctcacaaatacaatgctgagggcttattgcaaacaggaacagcactggtggaagtacagaatagggattgtggttttgatgatggtgtatccattgtaataacagagaacagaactaagggtaggggaaggagaagctgttaattcagatggtcagagctgaattaagtgaatgtttgtgaaaaactgaaaactacacttggagtatatactgcagagggcccgctgccaccgttagaaccctggtaacagagtatatactacagagtgcctgctgccactgttagaaccctggttatagagtatatactgcagagtgcccgctgccactgttagaagcctggctataaagtatatactgcagaaagtatatactttctgaatctaagagtatgatttagccatcactggagtgaacacactgcagcaaatgaagctctaacacagaagttggcgcatttttttttttttctgtatagagccagatgggaaatattttagttttgtgggtcagatgttttctattcagcttggacattgcagtgtgaaagtggccgtggaccatatgtaaacagatgaacatggctgtgttccaaaaaacctgtacttacgggcactgaaaattcaatttcatattttcatgtgccataaaatatttttttctttttcttgcaattttttttcaactgttgaaaaatgtgcaagccattcttaactcttgggctgtgatttggtccatggccatgatgtgcttagcccagctctaacatatggaaagtattatattgctaaagggaaagctagacaaataaaatgggagcaactgtcagagatatgatagaggcaaagtttgctgccaataggttagatgcacttgccctcctaaagctgggaaggagaatacttatgtcaggagctactggtgaagttttatgaaagtatagggatggcatttgagtgggactccttgacagatggtacttaagttaatgaatgtttttgatgtttgaaaggatgagagaataaatgggtaaaatacgaatatagctcaatagagtgtgatatagaaggaagcatttcataaggaga

SEQ ID NO: 59147 - DNA, 1038 bp, Homo sapiens
ttgagaatcttagcaatctaataataaagagagaagataaatataatgtggtatgaatctgctttcatagtaaatagttcaatcagagagcagagaagagatctaattacctacccaacactctccccttgtacgtcctcataactgtgaaatgctgaatggattagtgtgtgtttatattgtagacaatacgatgctactagctatttatatctgaaacttctattctcaaatatctagtctaacttaaccttattttaagaggctgtgttctgttacctacctattgaagaacatccttggtaaagcataaatagtacttcaataattagattataatgccaataaattcacaaatttactaattaatgtaatatttagccagcatcttgtccaaagcctctgtatataaatatttacctacctgtcatctgcaaaattgatgcagtgatgtaatggtgaatgtgattataatctcttgaagggttcatagctaaaaatattcactgagcaacaattatccatctgtcacttaggtgaatgtggaaatttgtctgtggttgaaagatgcatctttcagttttactgcctttctgtttctagaaagacaactttctactcagaagccaaggatattccatatttctaagtatttgaatgacgtggtttccagactctgtcatcaaactcaataaagacgtcaatttaagcaggatgtaatttaatcacagtggcgtagttaggcactgttttagattatgaatcttaaatgtatagattattttatttgattagtctcattcaatttggacatcttcctcagctatttgtgtgtgtttataatagaaaaaattttcatttgtaaacatatgatagcaaataaatgacatggcatatttctgattcaatcttaataaactattctgcaatttatgagtgacttaaagatatgtggaacctattgagtcagccattctcaaacatttttcttttttgagatagagtctcattctgtcacccaggctggagtgcaatggt

SEQ ID NO: 59148 - DNA, 1121 bp, Homo sapiens
taacaaatgatggtaatctacttatcataatattacatgagctttcacttggacacagatatgagcacgggtattttgaattattttcagagtttggttaaaatcggtgtcattcacatggatttgtatgtgtgtgtgcctgtgcacgtgcttttttttacactaggttattgaaatacgagtatttatggaacagcttaaaatgtgtgtttttatgtttatgatactttgattttatgatttttgttagcttctccacatacgtgtttactggataacattgccagatgctaggaacacagctgtgaacctgtgtcaggtagcttctaaaagggaaaaagaaaataagcccaagaatttcactgtgtgataattgctttgaagggaaatatattctgcttgtttgttaaagcagatgggatatgatttatttgtaaacaattaaacagttttaacatactggagaagaaattgagtcaataaaggaatcttagctgggattacagctaagactgtaagaatgacagattgaagtaaagaagaaattgtacaaaagcaggcagctagttgaggttgaggagaggaataagagcaaattattgccaagtcttatgtatcaactggtaaactttcaatcttattcattggaaaaatgactgataaacactgtgtacatatcacaatgtttaaagtttctttggttttatttttaagagaaagagagtgaacgacctcttcttgatggtgacttgagaatagtatctttatgttaaagagacccgtaggatgtttaaaaggcctgtggagtacacctaaggtgactactttaggcgtgactgatcatctaaataagatggtcaagatttctgggaaatttctggtctgattaaagtctgtgaaaacttaggctgtcatcagcattggcaaagcattgcagaaacattgcagggatattggcgatgtttactgagaagactccacgaaaacaggtggttgctctatgtatgtttgaaattctagaggcagccaagttatgatgagtaaaataagcaagtaattttgtttttcttagttaacatttgataattcagtcttatggctctaaaagatattaagtatgt

SEQ ID NO: 59149 - DNA, 1075 bp, Homo sapiens
atagccattctgactgtgtgagatggtagctctttgtggttttgatttgcatttctctgatgattagcaatgggaacattttttcatgtttgttggctgcttgtatgtcttcttttgaaaagtatctgttcatgtttttttgcccattttttaaatgggggtgatttgttttttacttgttgggttatttaagtcccttatagattctggatattaggacctttgtcagaaacatagtttgcaaatactttctcccattttgtagattgtccttctcagcattcttgattcaaattctagcatccatttaactacctatagaaacttagacaaatgacttaacatcttagttgtttcctcatctgaaaaaatgggattaatattaaataatataggcaaaagtacttatgtattatatggcacatagtaggccacaagcagctagctgttaccttttcttctgatcaaaaaatgtgaatttacatcttcatataatattggtcatttttatctgctttttggccatttggtttgggttatatatttaatacatggattcttaactgtatttcagaaatgttaaaatttgaaataatttattcttaggaaaagctggtacgcttgtgatctgctttatcttccttttattgtagccccaaacagagatttcaagcctgtattttgcccctacatctttgggactgctagctccttggctggatttgcatgctcatcaccctcccctctgctctggagcagggaggctcatcagcacagaaagttaaaatttgctgaagccatctgtcttttgttggaggaagcagcttagccataagttgtagctactgttttaacagatttgcaaatagttagggtgggtctggctcaggcccaagtaactgattgggctcatatgcactaatttaagatccactgccagaatgaaaacttcccttatatatcatcaggctctgttatttgcagggtgtcaattaaggtaactggatagaagatcaagaacacaaaggacaggaaggtgggacccatattttacatgtgctgggggagaggcatg

SEQ ID NO: 59150 - DNA, 1049 bp, Homo sapiens
ttaaaatcaactttttgttttgaggaatatctgccctgcagaaaagtgcaaaaaaatgctttggtaacacctgtatattcttcaatcgtcaattatttttatttgccatattaattttatctctctctacagtttattttgttgagccctaaagatgacttttaatggctgcacgtatttactcctgtgtatgtatcacagttaattattctcaggaatagattatttctctttttacctttttgtaccatttaaaattcagttcactgagcattcgtgctaagcattatacatacaagatctaactttaaaactataaccctaaggggcaggagttacagaagataggattaaagcttagagaatttaagtaacttgccaaagatcaaatagctaacaagtggaggggctaagacatgaatcctggtttactggacttagaactctgtgtttttaatcacttcatagtaatatctgtctgccatcttcttagatgttaactcttctacaaaaccttcctgactcccatctctccatacttcctttgctcctagaaccctggctgcttagatggatggtacgctatttcagtataacaacttcttttttttttcttttttttgagacggagtcttgctctgtcgcccaggctggtgtgtggtggtgcaatctaggctcactgcaatgtccacttcccaggttcaagagattctcctgcctcagcctcccaagtaactgggactacaggtgcccaccaccatgcccggctaatttttatatttttagtaaagaagggtttcaccatattggccaggctggtcttgaacttgtggcctcaagtgatccacctgcctcagcctcccaaagtgctgggattacaaatgtcactgggcccagccagtataacttctttacttttctttgtatgttattagaccacgagcacgttttgccctggatctgtgttagtcatcttttactcctactttctgacacatggtagttgcttagtgagtaattatcgaataagtaaatgaatggttgaaagc

SEQ ID NO: 59151 - DNA, 1125 bp, Homo sapiens
ttagctagaagaaagatcaaggcaaagggaaccacatccattctcatattagttacgttacaagtagcttgttagaatgatgaaaaatactttcctttttatgtgtgggcaatgtcaggctgaatctgaatatatagaattataagataaatttccgaaaccgtctttagaaacagaagcagaactctatgactatatccatagcacagtaatctgtttaatcatctcttacaaaatgatgccatgtgtggaccgcatttgggattctgaaaacgtgatgtgccttagtcatctttagaatcaggaaattgacaatggtgattggaatgtgaactatcgcttcttcgtttgctaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaaggttactaatttatacgctgtgattttaaatttgtagttatgtgaggaaggttacagtccagagtaaagggtctcctagtgtaaattttttcctccttctcctcctcctcctcctcctcctcttcccccttctcctcctccccctcctcctcctccccctcctcctcttcccccttctcctcctcccccttctcctcctcccccttctcctcctcccccttctcctcctcccccttctcctcctcctctttgtgcaaaggatgctgtagggaaaaattaagcaacctgttagtcatctaatttgttagcgtaggtgcaatctatctcaagagttactttttaagatgtctgtgtttacattcttgcctgaaacttgcagagcattttctccaaatagtattttttatgataaaggcgg

SEQ ID NO: 59152 - DNA, 1041 bp, Homo sapiens
gcatttttgcttttgtggtagttgtgcctttctttgtttctttctttctttctttctttctttttttttttttttttttttttttgagacaaagtctcactgtgtcgccgcccaggctggagtgtagtggcacaatctcggctcactgcaacctccacctcccaggttcaaacaattctactgcctcagcctcctgagtagctgggactacaggcatgcaccaccacacccaactaatttttgtatctttagtagagatgggttttcaccatgttggccaggctggtctcaaaatcctgacctcgtgatctgcccacctcagcctcccagagtgctgggattacaggcatgagccactccgcccggccctgctgtgccattcttgaattcacctttcttttcttcctccttcttcctctttcttgtttttcaaactttcagatcaatatgcttctcaattttaaggatgacaaaagtgaatgtccatgtccagaagaaattcgtgaccaactattggatttccatgaagatttgatgacacattgtggtaaggtctttttgattaaaagcttttattaattgtatgtttttaatccatatatcctgagacgaaattaagtgtatatgcgaatattttcacgaatacacacgatacctgttagaaagttatataaaaacatttattattatggcaaaatggcaaaataactgtccctatgtggggagtcctgagggatagagaaatcagagaggcagttaaactgagcagaagatgaccaaaattctttctctctttttcctctttccattagtggcaggaaatgggaagggggacatgtggccaggtgcctctggcagggaggttaaggttggtttagtcaatgggtacaaagtttcggttatacaagatgaatgaattctggagatccatggcacaacagggtgcttctagttcacaatactgtattgtgcacttaaaattctgttaagagggtagatgtcatgttaagtattcttaaaacaacaacaaacaaacaaaac

SEQ ID NO: 59153 - DNA, 1107 bp, Homo sapiens
attgatctttgcccctaagagagtctttttggtctctactcagtgttatattttgttctgggtgacagccctgagcccacaggaatagaacaaaaagagagaggaagaaaagaggctgaccagtgaatgttatttatgagggctggtaagcaacattgcttaacttaatgttagatgtttttgacattgttctaagttgtgcatgaaagaaattacaaggcctcagaattatttgcccaagtgtattctttaaatatttttttctgcctctctgtttttttatactaggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctgtaagcagtatgagagtgcactggcagaatgacccaactgctgacacttaactcatcctttgaacgaatgttttactggatgagccagtgagataattgagtttgcaacttccaagaatcagactcttaagtagatgcctgtagctcccagaaataaacagcagcatcagtctatgtgtatagcaacagactgagaggtagcagcatgataaagatggatggtctccatagagaactagaaatttaggtattttatcagagaccataaagagaaagttaaaaggaagtatagtaatttagccttcatatctaaatatgaggtcgattttcaaatattattgcatcaaattaaacttttttcttaaaatttaaacagatattgtctttatattttggttctgaaatatttcctcaactgttgtatacttctggttgatccatatcctatttcagaataataagcacccttgggctgtgagtgccttgggcacagcactctgagtaggtctgagggatccagcctactttttacttcacttctaagactgtattgattttaagatgcagcaatggtttgttaatagctttccctgaaataaaaaaaaataaacttacgaaaacttttacagcacttttttttgacttacaacagaaaacctttattcatacagttac

SEQ ID NO: 59154 - DNA, 1050 bp, Homo sapiens
acaaatgagctggaaaattcgtgaaaaaagatacagtctcatgctgttacccttatgcaataaaactcttttacattagagatatgtcagtgttaagccaagcaaattagaactcaatatttcatcatttgtgactcctaaattgtgtggatgtatgtatgtgtccattttttttaactgaaagggaaagtaaatgagttgtaatattttaacagtaagacatgcagtccactttaataacagtaattcttataatttattttcttcgttagatataggaaagggtcaaaatatgtatagtcataagatcattttattaatttgacaaatatagatcaagaataaattatccaaagaactaccaaataattgaaagattctgtgcttgtccttgaccttccagtttagttctaaacaagcaatatgcataggtgaaaatgtaaggagcaacgtagacaatcagtaaagtaataaattgcatccataaccaccaaagaaatgtagacaaataagtgatcagagtagagcaattttggaacttcacttggagaagtaagttttgtggcaagccatagagaggcagagagggagcaaaaagaatcacagatgtatagttcctttattgtgcttctgggtcatcctgacatcagtcccttcattttacacacagattccaagatattaataacaattcattaaattattagtaaatgattaacgtagaactcagggatacatagacatccaaacaacctcataaagaatcctgttcaagatatagttacttgtaaaattgggcgtctggtcttcatattgcaatcagtgttaaatttgaaagagacatagtgtcttagccggggttctctagagggacagaactaataggatagatgtatatatgaaggggagtttattaaggagtattgactcacacgatcaccgggtgaagtcccacaataggccgtctgcaagctgaggggcaaggaagccagttcaagtcccaaaacctcaaaagtagggaagccaacagtgcagccttcagtctgtggc

SEQ ID NO: 59155 - DNA, 1027 bp, Homo sapiens
tgttgagtttctttatattttgctgctaagtgtaatggtggatagaaggataaaatatcactcatttcacaatctacacatagaggccggatatgcatcaccctattagtatttgtgataaatggtacttttgacattagtttctttaatgtttccacaaatctgatatttttgccagcatttattgttcagaagaaaaccccacatatacaaatttaatttaaaaataatgaccaatgttggaagaaaatgaagtaaagatacctataaaatttctgaagctttcccctcttaacaatgctttctcatttctgtttaaaccaaagggttctttatggactcagttgtgattctgctggggatatcaggtccttttactcaaacttctgctagaatttaatatacatgagaatcaattacagagcaagtttacttctctaatattacattgcccaaaagtccataccaagcttttagattgtatcggaacaaaatttctataaaagtgaatacacagtataaagcagaacactggagaaaatacagactttccttggacttgacgtcgatgctgtgctgaaaggcagtacggtctccacctattagacagagtgagatgagattgcatacagcctccgtgagagggtggagaagtggaaagattcctgcactacgtaacactggggaatgcagctggagtggaattgtcagttcatctctttcacttattgtctattttaccaagtagcaagtggccagtcatgtgatatgggattgcaacagtataaaacatgtcctcaaacttcttcaaatgataattttcctataaaattgattatagttaaaataacagcaggaatccatcccagcggcgtgctttgtttccacaaattgctgccacatggagagaggcaatgcagttactttccaagatgtgaatttccaccccttcccacttgaacatggccttccttcccaccttcactgggagggagagcagctcctccctcatcatttcataagcacc

SEQ ID NO: 59156 - DNA, 1020 bp, Homo sapiens
ttccctgtactgtcttgtatttcctgtactatcttggtttaaagattttttcatgacctaaacctaagagtaaattaagacagaattgaaagttgaggttgacaagaaaatacttgagttttgtgatgatcagagaaggtaaggatgtagaaagatacatgttaaccttaaatatgtcagaaagtggagacaggacaggagcattaaaaaaaaatgaagagacaaaatacatgttctggtggtagtaattgtggtgagcagagtttgatgggtaatggaatatttattctaggttggctgccacattgtaattatatctccaaacctcgcctgtggttgaaatatttttctgacatatgaaatgaggattctcaaaactttggcttttatattttttgttatctactttaaaatatttcttctgcattgatggacactatacaggaattaagataatagtgtttttatgcctaatctattatttttgagacatttaaaccattttatgttatgtttaaaaagctaaggtttttaaaaaggaagacaagcggtattacccatagaattctgatgaatcaattagaataatttatggaatgaaaaagaaagaaaatagcttcttgtctaaatataggcttccctgtttgaattctgaaatgcttgctagtgattataagttggtgcacataacgaattttggaaatccaggtaggacataaataggacgtaggcaggttgacaagtgatatccttatcatttgccattttcaaggaccagtgttgactaaagaaacagtgctttgattcccagagttacccctgacttttgctgcctagaaattctgattactattttcaaggcagttagaggatacattagcccttctattacagtctgttagaatctttcaatcatttttagaggaagcagcatctgataactaagagtccaacagtaataatgatggtggcacaggtggtgcttatcagagtgccttaaaggctttctttttacatgtg

SEQ ID NO: 59157 - DNA, 1025 bp, Homo sapiens
tataatgacctaggaatctgagggtaggacttgaaatcagcaaaagatactaagaagggaagagaaaaattattctcaaaacaggaggattttcaaaactagggagcagcagaaaatgaggaagatgaagtgacaagttagggaagagtcatagtggttctacatgtgagaaaagcaggttcagatcccagcacttctctttgttccataggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctggtaagtctccttttcatcccagcggtaatgatcatctgacctccagactctcagtgtttgattcctttgtctcactgccctatgtcaatatttcatttgcattacatgttttattaagcaggttttctagacaggcccaagactcaaacataaagactgctctttttttgaggctgtttttatttgtaagttatgttaatcacctccgggacacattcaagaaccaaacaggaaagacacaaaccaatctctggtagtgaaaaaaatggatttcatataaacttctatataaagtttgtgatgagaagcatactcaaatttatgaagggtgatttttcaatgttaaaagcataatatattgtgccaactgtgggtagataaggtgttgacttttaaatcagctgctgttctcctctgcaagatttaagttcctctgcaagatttaagttctcaagattttacaatgtcctctgagtttctgttcttcatagctatgcaaatgaggatgcaatattttgtacattggaatttctattttatatttatgtaaattggaggacatattctccattccacattgaatcactgaagctcgtcactgaacatgcatcgtttgacattctaaaatgagtgaattgagggg

SEQ ID NO: 59158 - DNA, 1077 bp, Homo sapiens
aaatataaaaacaatctaatttgaggaacccatgactattgctggctgagaaaaatgccataagattaatttctgtatgatttctataatcttttctaatgtatatgttttctattctcaaagtcatctttattgataagaaagtgaggtcagtttagaatgagctgtgagcagcagataatattgtttttctgaagtgcacagcatttatagtctatccgttgtcttcagagcaattgtttattgctattttgcttcttgtcctcatccttccttaaggtcacaggatcccaacgcagcaaggtaaaactatatatatgtgtgtatttgtctgggtctgagtttcggtttcttgtgacatttacctttgttagacccaacatcttggattcttttgtgaaaaggaggtcttgaaaatctttctacaagtttgtagctccaatgcatttggtctcttcaggatcccttcctttgacacaagtttattcttcttgcaatttaaatgactcataatttgaaattttatcctccagctaactttgagctgcatactgtgctgggataaaggagtccagccctttggatgacaaactttttaagccagggacttctcattttcggtgcaatgttctgaccttatccctcttgatgtttttcaacaccagttttattacttgaaaacagacatgataaatggtattgctggtgagattggaaagaagcctgcttttccattgtgctagtaatcacttcaattagtaactggagattatattccatgatttcaatattgatttcattgttgcattaaagggaagaactagatgactatttctctcttaatattttgaatactgggaacatttgctaaaagaaaacattttgatatagaattacaaaattacttacattaatatgaaccttgttaagcttatgttttattttcataaggctatatggtaggaaaatcaatcataaacattctgtgaagatgatacctataaagactttagttttgtttgtttgtttaaaaaaaaaaaaagctttttaggtggccaggtgcagaggcttacgctt

SEQ ID NO: 59159 - DNA, 1043 bp, Homo sapiens
caatctgccaactacatttttatacaataaaattatgcatctcaagtgattatctcgtgtcttagctcagatttcctggaaaacacaggcaaaagcttacgtgctaacactttattgggggaaggggtgttaaaatcccagggaatgaagagttagggaaatagagaaacgatatggggaatgagggagggcaagtagaagatagagtgttcttgagctgatcacagctgttcagcagtacagtgtgttgctcagttgtgtgggatgcctcctgagagaccatatgcattacagaacagaacagtgcctccccggggaaggaggataggcactttatatgcaggttccttacatctcctgtcacttactggtcacagagtgttaatttcatcatacttcctgttgatattaaccagttcttccaggcaacccctggggaagccagagctgccttgaatacagcctgttgagtgtccaggcaccacagtctctccttatccattaacatggggtctccttggtgagtggtaatgatggtagcagctggctttcataagtacactgtgtgggggcagtcatttctagggccattctggctcagaagcaaggcaagtagccaaggcttagaaagaagggcataggttgggctggggggtcctggccttgacacaaggaagattcccagaaagcacaaccctctatattgtatatggtaattcatgcatatgagtatgtggaccaaaatagcagtctgtatagaagacatgcagctggccctctttatctgtggcttccacatccttggattcagccaactacagatttaaatattcgaaaaaatatttgcttctgtagccaacaagtacagacttttttcccttgtcactgttccctaaacaatacagcagaacaactacttacataacatttacattgtgtattaagtatttattataagggatctagagattatttaaagtagacaggaggatgtacgtaggttaagtgcaaacactataacattttatataagggacagatgt

SEQ ID NO: 59160 - DNA, 1001 bp, Homo sapiens
agcctttctacttgtttccccaagtgttaaaagcttgacacactcttagacaaaatgaaataatattagcaatgttattacaaacttcagttataaccaaaagcaaatcatgatgtaaaatacttctgttcattaccagtgatttgaacatgggtctgaaatatgaccatattcgaccttggaaaaacctcctaacaagcttattaggatatgcactgataattcttggttgctcttggcaatcagaatgttttgcctaagggaaaatttaaattctggagctgctctttttttcctcaccttactgtgtaaccttgaaataaccttgaaataacacaaagactaaactgcaggtggtgtttatttaagagccttaggcagtttaagcagaagctgctgtgtcagagaactctattcttgaaaaggtgccttcaaggtgttattttcctgagtaagatgcttataaaagatctatctacaatttgtttagaaaagctaatctgcagtttaaaaaattgtttttacataattcatcttagtatctgaaaattttctggtttagctttcagagttttttttttttttttaatttataataaactttccctatgacagattaaattacatgcccagaagctgttctcaaagggcaaagtactggaaagaaataatattaaagaatcctgaagggagagcttccaatttcagttcaacaaagaataaattcaacagagaggttgacttgatctctatgaaatacagtatttttctgcgtctagatcagtatgtctttttggctcaatgtttttttttttttcaaatgactttcatcatcttcctcaaaacattgattattaaaatttagatgcgatgttaaaaaaaatgagtgacctgtccagggagtttatttttaagcaaggtagtctgagatcctgtctatttcttggtccttgtaaggttcatacatcatgtgttgatttcagttaggttaccgggacctt

SEQ ID NO: 59161 - DNA, 1074 bp, Homo sapiens
cattttttatttgaccaaaagttatcacaccccccgtaaatggctatatggttttgtgtctatgtgcgtatatatgtgtgtctgtgtatctgtgtatcatacctacactacgtgtatatttgctatttgtgcatttgtgcgtatatatatatatgcatatgtgcatatactttgtgcatatgtatcctttacatatttagtttgtattgccttcgctatctgaaaaagattactactaaaatttagtctgcttaactgagccctttttagaacagcattgataacaggaattgttctgctcttccagatttgtagagaagcagtattcttatttccttaaacctttgagcatgctttctatcatcttgtatgtgcttttacatttgaaatctctaataaattttaaccatgtcagaaatagctgtttcgttatgctatgtaacagtaagctaacaagacaaagcattgctttagcgtttttttacatgtatgtttaaccaaaattttgaccatagattctggacgtcattctgagaacaaaggagaacattttaatagccaaatgattcctattgttttttcaatttacagactatggtaatggaaactgaatttccgtctatagcattagcatatggcagtcacaactctcagattgtaatgctgttcggggttttttgttttgttttgttttgttttttgagatgtcacccaggctggagtgcagtggcaccatctctgctcactgcaacctccgcctcctgggttcaagcaattctcctgcctcagcctcccgagtagctgggactacaggcacatgctaccacgcccagctgatttttgtattttttagtagagacggggtttcactatgttggtcaggctggtctcaaactcctgacctcatgatttgcccacctcagcctcccaaagtgctgggattacgggtgtgaaccaccacgcccagcctgtaatgctgtttaatgacatcaccttggtatggaaacctgtgaataacatctataggaattttcttcccagttaacttgcactagagtatctgaatcaccaaat

SEQ ID NO: 59162 - DNA, 1057 bp, Homo sapiens
tgcacaaaagcagagatacacgtgatcttagaatttttctctctctaaatagatgctggtataaactagaaagtttagcatacaatgcatttaaagcagaaataacctttgctgccctttcattttagcagtatttattaagaaaaaaatcttcagtagtttttggtttgatttgtttttattcttttgtgtttgatttttaaactagttttactcagggccccgtatgtttatctgtttttgtttgttttgtgtggtttggatatgtcttcttgtcaattattagttttggaacattgggtcttttattggactaatcttatttcaaaaaataattttttctcccatctgccatttgtagtctatgtttatttctctgaaatattttaggattaactaatttatctatgtatttttttcttctcacaaataggaaaaacaacatttcttattgtattttaaagtttattattaatacccattctgacattgctaccactatgtggctcccgtgtttattttattttctgcttgacatttggatgtacaagtgcagtcaacaaaaataagtcatatggttactaaactgagttagctaccttcaagaacaatcactgacaccattctataacttcttaggttttctggcctaaggttctggcctgaggttcagaaggccagacctttgagaaaagtcaccagtgccactctaaaccgacttaggttttctggacccatctgcagaacttggagccactgcagatctcagggcctatcacctgcctacctccagcatctctccaaagtcctaagcaattttcagctataaaatttctaaaaatgaatgaagtctctgtccaaagcctgacttccctgtcttggaattagaaatcaatttcattttcccctgtagttattacctaatgttccaggggctcctaccgcaaatccatagtcattcttagtcgctgttcatatcagctcccaaaaggaatagcagccacttaggttattttcctcagcctcctttccttcgtcaggcggatatgggttggaa

SEQ ID NO: 59163 - DNA, 1053 bp, Homo sapiens
ccatggaatactatgcagccataaaaaaaggatgatttcatgtcctttgcagggacgtggatgaagctggaaaccatcattctcagcaaactaacacaagaacagaaaaccaaacgccacatgttctcactcataagtgggagttaaacaatggtaacacattggggggcatcacacaccagagcctgttgaggggttgggatagcattaggaaaaatacctaatgtagatgacaagttgatgggtacagcaaaaaccaccatagcacgtgtatacctgtgtaacaaacctgcacgttctgcacgtgtaccccagaacttaaagtataataaaaaaaggacatacattcaagtacccagtctaatacctgatgcatagtcagtgctttataaataattataaagctattaatagtatcattgttgaatacctactatctgcccagcacatgtattaactaattttaccatttcaccaaccttatgagaatggtgctcttattttatgcatgaagtaactgagccacaataagtctaaggaacttggccaaagtgcacagctaaacagggctggaatccatctatacccaggcaatctgcatccagaccccttcaaccacggtgctgtattgacccactagctcttccttttacttccgggcaacttggagtgtggtgtttttctctctcagaaaagtcatgttatcttttccgcttaacacatgtatcctggcttgaattaaatgtctgtaaatgtgacaatctcttttaagttccacagacatcaaatgacactattttttagtcaaataccatggacaagcttaagggactcataattcattcattgtgctcttattgagtgtaaaaataacgtgttttctaagagggcaaagttataacttcgaagaaagtgtgaagccagcaggtctcaggagggaaaaggagcttaaaacagctcaacacagtgtttctgattgtcacagtcaatgaaattatggaagcttacttataagggacttgtgaaaaaagtgatttggggcctggcaccatg

SEQ ID NO: 59164 - DNA, 1050 bp, Homo sapiens
gtcttattcatggtcttcttgccaaagaaatgactaggaacaagaaaacacagcatcctaagtgtttttctcctgaaactacaagtgagaaaagagtatataaaaggaagaagaaatactaatcactagcattggtatgataaacaaataataaatgctacccagaaaacagagcctgtgaagaggataaagagttctaaatgtcttgtctttcatgcctacaaaatcacatccagcatgaaacatgggctgtctgtcactattatttccagagaagaaatacacttacaaaagttttaccaatctgttcattctaaattgctatggctattaggaatttcagaaatatcttcctatgtgaaaatatggaaaatgtactttcagagctagcatgtttccatcattcttttaaagcttaatactgaaaaaattcaaaagaattcagataagtggaaggcattttaaagttaattgcttcgttttaaaaattgcattgctcagactcaagagtaaaagccatttcctagtttttgtcatgtctttctttcactgtgtatcagatgtcacttcattcataaagtttgcagtgatttaacagccttattatgcagttgtttctggcaatgcccttcactcttgactttgcaaattgaaataggttttattgatctacatgcattaagtgtttccgacactctttaccatattccaccttgctagccgttacttaataatgctgacttcaacagaaatgatgagtgtccctgtaataaatcatggccttccaacaatggctttgtaatggtcaggataatcacaaagtcatcatgcattcccaaaagcatttcttagcttttgagcaaaaaattatagagagggtttcaggtttctagttgactctttttgagaaatggcttcattgtgaaatccattcagaatttacctaactcagtgttgacacatattttcatttaaactttagatgaattgcaatttccaaatccactttctctcaattagacaagaatttcctttgctatgtatagacaa

SEQ ID NO: 59165 - DNA, 1034 bp, Homo sapiens
atagaatgggaatttcagactcattttggagataagctgtaaagaactaatggtggatgatgttctcctcagggtaaggtggaagacggggcaattagaccccgtggtgaatgcagattaatgaatctaagtgagtctatttggttttttcagtttagttggccggagtggaggagcaagtcatagaaaattggggcttttttttcttgtttcttcatgccatgccattcagtactgactgagggtcaagcactgtgctaagtacttaacatgatctcttcaattagttggtcttaacttaaataactcagttaatctgacttccattttctgatgtgaaaactgagacttagggtaatttgcccagagtcagttgttttgtaagcggcagaagatggaattccaacccacgaaggctgactctacatcttgtgccctttctccaccctccatagccaatctgttggccttttttctctttctgttgccatcactctggtctaagccgccttagtgttgaggctggtctcaagtggtagtcccctaattagtctccatgggtccactctgctctctttagttccttctccacaaaagagtgattttttttttctttttaaaagataggatttctctctgtcacccaggctggagtgcaatggaacaatcatagctcactgcagcctggaatccctgcactcaagtgatcctcccacctgggccccccaaagtgctaggaatacaggtgtgagccattgcacctggccttgatttttaaaaaccaagtccaatcttgttacacttggagatgctttaccctagggtcatactgtagctcttatttatgacctacagggacctcccttagctacctgctggctaggtcggcagcttcatcttatgctattctgtgttactgtgctgcctgggaatatttataaaatgcaaattcttgggctctgcttctggaaagtctgattgactagatctgagactgggctctgggaatatgaatttttgataagccagattcg

SEQ ID NO: 59166 - DNA, 1043 bp, Homo sapiens
ttttgaaacactgtttgatattcactaggtgggctgtactccctgaaatgaacaacaaatgagagagagggtgtaggaagtgttgttccaggaagtgttgttccaggttactgagtttatcgtaacacttacagagagcagtttctcaaaggccaaggcagacttcctttaagcaaagatcttcagagatcagagacctctaacatgatagcacctgaaaatcaagcaagtaaaaggacttttcgttttcaaaggaaaacacacaattaaaagtattgatcccattttctacactactctatttatgataacatttattgatacaaaatacttaggggtagatatagttgaattaatcagttgcatggagagcccttttatcccatgttttgcatcattgattgggtgatattttcatgttttctgttccctactgtatcattctcaacttttctaactgaaacatttatatgatattcttaaattttagggaactttataaaacattatgaaacattttatgttgctggtatatatactggtggagcacttgactcgaagttaattgaatgtgataacctgaattttagtttggtaaaagatgatagttggaattgataccaggaagtttgtcacctggtttttgcttcatgatttgatgtagcttgcaaaatgctagagcaagtgatttttaatgaaataacttgtctcctttttaaaaatgcattcttgaagaggatgatggaggtaagaagtaatttaacttagtgacttatttttctcttgttgatctataaaccccagcagtcatatagcattttttcatcagagtgatctaatgggtctttctaaacttcttctgttgtgactccctgacgtaaatttggagagacacttccatgagacagcctcgttcccagaaccataccacactctcttctaatcagtcagttgtaagagtgggcatgtcagtatcataggtaacctttgcctacagtctcatgttttacatcaatcacaaagtttgataatataattattaa

SEQ ID NO: 59167 - DNA, 1019 bp, Homo sapiens
aatggcatgatctctgctcactgcaaccaccgtctcccgggttcaagtgattttccctcctcagcctcccaaagggatgggattacaggcacccaccatcatgcccagctaatttttgtatttttgtagaaacggggtttcaccatgttggcccagctggtcttgaactcctgacctcaggtgatccactcccctcggcctcccaaagtgctgggattacaggcgtgagccactgcactgggccttttttccagctcttaaaattggttacccaattcacatgtccagctagttcagatttgtggtactctgtcttctgcctttttcatgtatctcactttaactgcatagggagcatctcactttaactttttcacgatctgttctgtgaaagatggtgttttcctcctttatggattggtgaaggaactgacccttctttgtatgaattggaagggctgaggccatggtgaggtcttggtgcctcttctcaccagtgagttgcagattcctggcagtcctttgttctcatcctggctccctctgcagttggcattgtctccacagatgggcctaaagtgttaacattgaccttttgaagtctgcagaacacccctgaaggataagactggctgggaaaaaaggaagtaatgtgcttcccatgttggtggcattaaacaaataaaaaacccaaaccagttggtggcaaaaacattgatacaaagaaaccctttctatttatcattttctctttatcttctccctcagtttcccttggctatacacagcagtctcccacccatccatggctgtttcccactcatggacccttttctggagtcccatgacatcctattcatctctctgtcatctgaatgctttacgtattgaatttttctgtttatacatatacatgtcttccccatcagctttcagaatttcaagactttctggcacatagtatgtacttaaatatttgagtgaatgatgaaattcttttgctggaaaagatctaaata

SEQ ID NO: 59168 - DNA, 1051 bp, Homo sapiens
tagtattatgacctctgttaccactaacttgggtgccatgtggaactagctggcctgtgatgtggggcagaaatccatgtagaaagaggtgtaataattgttactatgctaggccattattaggatcattttctttttattactattgttgttttttatatttttagaggcagagtctcactctgtctcccaggctggactcctgggctcaagtgctcctccagtctcagcctctcaagtagctaggactacaggcacacaccaccacacctggctatttattttccatttttgttgagatgaagtcttgttatgttgcccatgctggtctcgaactcctggcttcaagtgatcctcccacttcagcctcggaaagtgctgggattacaggcatgaccactgtgcctcatcagaatcactttttcctctgtgtgtgtatgtgtttatataataatatcctttaattttatgctattttcattatattcaaatttatgatgaaacagagctggcataggcaataacatttacaaactgagttttggaaaactcctccagaatctacttcttacatgctatttatcaactaacctttttatataatcatagttcatgaaaaaagaaaaccctagttatgtaccagcataactcaagaaataccttttaatgattaaaggtcacctttaagagtatgctggaaaaacgaaaatgatctgtgcattttactaatccagtcagaaatactaattgtactccttattaagataaatttgggtgctggttttttggcttctggtttcttcttgtactcactatcatcatacaattggagaatggaattatgtatagtggccatacaggatgttaaaaatggttatgttccattgtgaaagacagtgtggcaattcctagacctaggaacagaaatagcatttgacccagcaaccccattactggatatgtacccaaaggagtatacatcattctgttacaaagatacattcacacatatgttcattgcagcactagtcataatagcaaagacgtggag

SEQ ID NO: 59169 - DNA, 1016 bp, Homo sapiens
cataccccctcctccccctctacccggagcgggcataccccctcctccccctcttcccggagcgggcatacctcctccaccccctctacccagagtgggcataccccctccgcccccacttcccggagcgggcatacccccacctccccctctacccggagcgggcataccccctccgccccctctacctggagtgggaatacctcctccgccccctctacctggagtgggaatacctcctccgccccctctacctggtgctgggattcccccacctcctcccttgccaggtatggggattccacctgctccagctcccccactccctccacctgggacaggaatcccaccgccccctctgcttcctgtatcaggccctccactcctcccacaagttgggagtagcactttaccaaccccacaggtgtgtggatttcttcctcctccattgccaagtggcttgtttggattagggatgaatcaggacaaagggagtaggaagcagcccatagagccttgtcgaccaatgaagcctctttactggaccaggattcaactacatagtaaaaggtaacatgaaagtgagctcgtctttgcacagtgtgtgtcagtattagggaagtgtttaccttcaaactcgggaaaattactgttgaatgtatttttaagcacaactctaaaactcgtctagatttttacatcaatatatagtgcagcagtttgctatttaaagctttaagcttttctccagaagtaccaaagatgtaaaataaatacatatacgtatcaatgtataagatgtaggtatacccatctatgtagttattgatatatctcttaaagattgagggatatatttttcttaaaatacatgctctgttatctagttgtaagactgctacttatttatgcctaaattccagtgaaagtatgcttatatgccctttggaaaatgaatgagggcaggtaagcagagacatttgtagcgaaattattttccatgtaagaatctactc

SEQ ID NO: 59170 - DNA, 1056 bp, Homo sapiens
ctttgaagcattacacaaaagattagctgagaaggtacatagaagtttatcagaatatagtttgacatagtttttcataaccaaatgagtgtgacactttgacattagaattgtctgatgtagaaccccgtctcttaaggaataaagaggaaaatagaaaaagtgatcttggccgggtgtggtggctcacgcctgtaatcccagcactttcagaggccgaggcgggcggatcacgaggtcaggagatggagaccatcctggctaacatgtagaaaccccgtctctactaaaaatacaaaaaattagccgggcgtggcagcaggtgcccgtagtctcagctactcgggaggctgaggcaggagaatggcgtgaacccgggaagcagaggttgcagtgagccgagatcgcaccactgcactccagcctgggcaatagagtgagactccatctcaaaaaaaaaaaaaaaagaaaaagaaaaagaaaaagtgatctcttatgatgttcatgctttagcattcacacacattcacacttgcccaattttaaggaaggctttagagccagtaagtgtttagtccaatctcctccctaattccagggtagttcagtgatttttaatgtttgtaatgaccctaagtcacctcaggatctttggtgatcaaataaggattaaaaagtttaacccactgggtatggtggctcacacctgtaatcctagcactttgggaggccaaggcaggtggatggcttgagcccaggatttcgagaccagcctggggaacatggggaaattctgaatctataaaaaatataaaaattagctgggtgcagtggtgcatgtctgtcatcccagctacttgggaagctgagatgggaagatcatctgagcccagggaggttgaggctgcagtgagttgtgagagtaccactgcactccagccagggtgacagattaagaccctctctcagggaaaaaaaaattcatccgcactcattagcaggaaagtgagagaatttacttgggagtgattttgataataagggttgcatagtttt

SEQ ID NO: 59171 - DNA, 1038 bp, Homo sapiens
tcgtgggaactaatagagtgataactcactcattcccatgaggagggcacaaagccattcatgagcgatcctctcccatgacccagtcacctctcgctaggactcacctttaacagtggagaatcacatttcagtgtgagatttggaggggacaaacatccaaactatatcagccatataaaaattaaactcttccagggatttctttcagggattttgttttcctttttgctactttgggtttaactttttatggaagtgcctttacaaagttaagtgacttattctttatgtcttcagcaaagtcaatattgcttccactaatggtagctaaggacaggaaggatgtgagtttttgttgttgtttttcacatagctgggaatagtcatggagtaggctaggatttggatcttagtttcttaagccacatttctacctcttatctcatgaaacaaaacaatgatttaaagactgggctaacagttctgtctttctaagagtttgtttgattgctgactgtccctgttgatggttcttgtgcggataattaacaggtatagtcggataagttgccaccaacttagaaaacagtcagggatctttttttaagagctgcttacagttgttcaagtcagccttgactcagctctgcataccagctgctggtgaccccagcttgcccctttgcacagaccatgtgattttaagtgtcaaggtcttgtccgttatcagtttcctaccctgtagaactgctgttatgcattttgtttactgatatgcattttcagtatctttcccttctctggatttttcgaaatagactaattaaataccgcagctggtctttttatcttgggatggaatcacttacagaatgggacacgtcttcctctcagattgagtcatggtgtggtgacagaagggaatttcattggagcattaagataatcagagactccatgtggcattaattcactccattactgtttattgaagaataactgtgtgccaagcactgggcttagtactttatcttg

SEQ ID NO: 59172 - DNA, 1018 bp, Homo sapiens
attgtctacagattctaggcattaagcagaatgaactagctggaaaaatccaacccagaaataaacattcacctgtagtcatttccagcaaatgcttgtatacttatcgaaaattcaaatttacttttaactaaatacctttatgcagctgactgtagtgctttggggaagataatggtgttaaaataaggtaatgatgattgagaagaaaggactgattcgaggaacatttaggagttagaatgacatcatttagctatctattagatattcaatagagatatttatgaaaacttgaaatatgtttaacattgtgtatccttataaccactgcttctgaatgttcagccagtgatcttgggtaaagacattaaaacttatttggtgaatacctaacagtgtatctcttcatcatgtgtatgtatctgtagatgtggtattagaaaccactgacacatataatgacttttcaagatatttaactagtttataggctcctgcgtgacttatttaatcttgtgattttgttctgaggtagctaataattttatcataacaagataaatttttaagaaaattattggaaagtatgaagtttttatttgttcatttcattagttgctctgctagagttacaaacaagtacaattacgttggaaatctacttcatagtaaatactcaggttcaaatacatttaccctaggacccagtagtcataggagtagcattacttgaaaaaccctaaactgcaaaccttctaaatatctatcaatattagatacacggtggaatagtaacaatgaaaaatagcaatctgttatactcaacaacaatatggattttacaggcaaaagccattataaacaaagtgtttccatttatgatgctcaagaacaggcagaagttatctgtgacgatagaagttagaaggagacttttgtgtgggggagtattgaaggaggtataaatggagccttcaggagtgctgataatgtcctatacaatgatctgagtgat

SEQ ID NO: 59173 - DNA, 1036 bp, Homo sapiens
tcctattacgtcttatgggagccgctgcaggagctctaatccagacacttatggtaatgaagataggagcttccactctcccaagctcctacgctgaggttatggcttctcactgagtcagcaggctgccagaattactcattccaccacctccagcttattgcagacgttctgttccagactaacaatgcagataagagggggctccctttctcaacacttccttacttaaagggcagatgctccagctcaggtgtagccaaccgagaatgctgggccccagtgcttccactctagctgattttagggcagagattctacaccaggagggagaatacatgaagactaggggccccccacctcagctccttcttacacagcaggagtgttgctttggaagaagtggaccactgtcctaatcctagctttaaccattgtgcaggtgcacagaagtcctgcccagagctctacagatctgcttgagaaggcagattttgtttggaacagaacatgaagaatttcatacctaagagcttcgtctgaaagaatagaggtctagatggagagcagttgagagggcgttcgcagctccatgatacagcagcaacaagcaaaatggctaagcaatcagaagtttaacagagagatcaagggaagaagatagccaagaaggatccttttgggatcataatcaatcccagaggttggaaggctgtgcataagcttactaggctgcacccactaatgagcatcagatcaggaggtcaggctgacgtggaaacaatccccaagctgtgtagggatccatgaatatatgctgtaagcctcactggcagcagggaactcagcgcaaccgctggccaccactggcagaacaataagatatgtaacccaggggcaactcatgggaagccaggctaaaaaataaaatcacctatattccttcatatagtctgtctaatagccacaaaataagcacaccagcatcagccgagttaactgcttctaggaccttgtatgtaagcaggcagaaaca

SEQ ID NO: 59174 - DNA, 1052 bp, Homo sapiens
gaaaatatgttttaatccctctagtaatactgtggcatggaaagttgcatctatactgatttttgacagagaaagggtattactggcacatgaaaccctagatgagcatgaataaatgtagatttcgcatcctacttccagaaaattgccaaactctattgtatattatttaacccactaaaacagctcccaaagttgactaggggttatttttaaatggtatgaaaatatattcttacaaaataatttacaaaatcttttttgttgtttttgtttgtagtcttgacattgttagcaatgaatcatgagtttttcggggaaaaattgatgaattgatcaaaattatctgatttgaggatattgcacgtaagttaaagagaatagggatatttgacatagttttcaaaattggtctaagaaatatttgagcaactaggccaaacattcttgatttattctaagtcttaagtagattcttaagtctaagactctaccagaaagaaaaggtagaatgaaaaaggcaataagaacaacagagattagaaaataatttcaataaacgggaaaaaaagaggaaattagaaagaggacataataaagacattgtgatagctacttgttcaccttgttttattctaggtttttgcagctgaatatccaaagtatcatatcccatgttttttttctgaactgcaagttagactttaccattttaaagttgatttttatttcaagcattcaatgatggttgaaagtatagtttaatattggtaatataggtactttgtagtcatttatttagagaaattaaagtatggatgcattaaaataaccataaaattatttttttaatattcaatctatgaatcgaggtgctgattgattcatagtttatgaatcaataaactatgattagtttacacgaaaaaaacttagattcttgagtttctcctgaagcctctcagattctccagtggtgtcttaggcaaaacaaaacaaaacaaaacaccagtgccttataggttgacaagcgtattttcaaaatctatatt

SEQ ID NO: 59175 - DNA, 1007 bp, Homo sapiens
ctcagcttctgcatcttgacctctgagatatgttggccttaattggcttaggaaaggctaatagagatcctgacttacatttacactgagagaagggcttgtttcctttgggtgagagagaatatgagtacacacagttaaagaaatagaggggcattgtcaggctggaccagagaacatagaaactcagtcaaagtgccccagtagcttacaatggtgtcttcttggtgacattgtcttttcatgtttggacatcataggagatgggccctgtagattcggactagaagccaaagaatttttctttatgttataaactgcattcgtgccttcaaaaatgttaggatgccaaagaatctaattagcttgcaaatacttctatggtagtgcttgttctctgccttaacaactgccgtgaggctccttgctcactcttataagaaagatattccactcagtgtggcaatgctatgcggttttcaacatgccaggaatatcttacaaatatcgttgggctagtgaaacagagatttatccaagcactgaaggaacatttttaaaatgccaaatagtatgtgatgattattattttctttttttagcttcacaatctctgaatttaccccagggtgaaatttaggtttgtgtggacttggttgtggtgagtgcctcctacgtgagaaagggagttctgtcatagttctgattgtcaatgtcaccgaagctaaggttggatcgtctgtgccttttgtatctatatctaagatgaggaggggctgcagggctttggaggccttagccagctggctctccccatgttctggtgatgaatgggtagggtcattcttagtacccattttgcaggtgaggaaatgaagagagagaacttcacgtctgttaaatgacttcaccagtattgtggagtgcggtagcacagagccgagaatggaattcaggccttcgtgaaagctgaatgctttgtgagtaatagtctgctctgcaatcct

SEQ ID NO: 59176 - DNA, 1065 bp, Homo sapiens
ctcctgatttcaacttctcccttctagccattaatacatttactttattatcataaaataacgacttaagaaagaaacaaaaagcaattccttgcctgtacattccctttccactcttttttttttttttttgagacggagtcttgctctgtcacccagactgcagtgcagtggtgcaatcttagctcactgcaacctccacctcctgggttcaagcgattctcgtgcctcagcctcccaagtaactgggactacagacgtgccaccaccaaaaattagacactggctaatttttatatttttagtagagacggggtttcgccatgttggcccggctagtctcaaactcctggcttcaagtgatcctcccacctcagcctcccaaagtgctgggattacaggcgtgagccaccatgcgcccagcctccctttccattctttgtagccaatcttctcctcctcattccatctgtacttatgtcccttgttgatatttatgttatttaatcttgcctcattttctgattttgtagccagtcttttaggatgtttctctattttattggtctttgaaagaaccagaaattttgatttgttgattatctctctcttctttttttttttaagttgtttttttaattggctttctatttcacaaatttctgctctttaatattctcttatttctgcatcctgtctctcctggctttgtccgttgtatgaatagttcatttatttttaatttttctttttttaaaatcatatactcagagctctagctttgccattaagttcactttaacaatatcccactagtttttaaatgtagaatagattttattgttgttcagttataactttgttattttctctttagctgatgagttacttatgtgtatattcgttgtgtctgtttcaaatgcatgggttttgtgtgtttgctttgctggtaattattttcctattgatttacagtaaattgtattacacttagtttgggatctagtatggaacctgtcttagtaaatatttgtatgtccttgagaagaatcagtttgccctgtg

SEQ ID NO: 59177 - DNA, 1022 bp, Homo sapiens
tttttaccctgtgtattttcaaatgctttcgttttatgcctacatatctagagtttttcatcttcctggttaacctaatcttgttttcagtgctatctcttttctggtaatgctttttgcctaaatttgtactttgccttatgttaatattggtacatatcagctctttttggttcgcatttgtcatagcacctccacaattttactttcaacctttctgtgtccttatgggcaaaaaaaaaagtgtgagggttattcctcaaacacctgagggcatcaatcccagttgtgtacccagagtgggtgattgaccactacaagctgtacttttgccaggattccattacttctgaccgtgtaagctcccgcagtaatggaagtggccatgtggaagctgtgggtctctggaaatcagtgtctcctcagaccctgtgtcctgtggccctcgagacatctgagtatttcccttttgcactatacagtctactgagtgatggctgcaggtttctttgtagaaggactaggggaaacattacagtgtatccttgctaccatgtttcagggtccttcctcacagggatgcaattcctttggtcagggggtcctggatctgaaattggctcagttctgggaactgatcaaggaatcatgattttctatagagcagccacctgtagcctcctgttttcccactcttgcccttttctgtggtcatagaggttgagcagcacacttgtcatttgcccctaaggatgctatgctccactaaccatctccacaatccgctgagagtcaggcctccttggctgccccttggctttttggttattatggtaattgtggtacccgggcttctggtcattgagctttaccacttggaccctattatttaggatcctatcatcccagtggattttaatgagcccagctctgcaacctcttcctacagagaagagctccaactgcactgttcagtgatgctgatacccctcttcctgatgcattctttatggcctctgggt

SEQ ID NO: 59178 - DNA, 1094 bp, Homo sapiens
agtatctctttatttagttcttctttccaaaaattgatttctttcatctgagttttgtggttttcctcatatagatcttgtacacattttgttaggtttataccttagtattttattttttggtgatactgtaagttatataatttttatttcaagttttaattattcagtgctggtatatgggaaagcagttgagttttgtatattgacttgtgtcctgcaaccttgctatatttgtgtattagctccgggagttattttgtagattccttggcattttctacatagacgtattagtcttcaaatagggacagttgtatttctttctttccaatgtgtatatcttttatttccttttttgtcttattgcaataaatataagacaaatatacgctgactataatggtctgattcctaattttaggaacttttcttagttacttgatctttgggatcagcatgggtctcagcttacattgtccctcaaggccagtcagtacctgaaaatgtgtcacttagattttcaaacttctcttccaccttttgtatgaactaatacttgttcttgggttgaattacctttttttctaagagcagttggctgctctgaggtcacaattaccctgaaggtgtaagtaccacagttcttcatttcaagataaaagaaatgccagtttatcctcttaccattctgaattcctctgattttttcattgcctgcaacaaactgagtgttggcataaaaatatctttgtgctttttagaagacatggaggatccctcaaaggcttttttaataataagtgaaaggggatttattcttccttattggagtaataaaatttgttacactttatgtaagttcctatggagggtgggggaaggaggtggaaatgaagacgatgatttaggattccaaaaattaaagttacttgtggaaggctttaactgaaaatagatcttcctcttgagattttagtttgttctgaagaataatattacaaaatccaacactgcacaataaaaaacgcaaaagcaatggaagatttatgatgatgttcctttgcagttcgtttaaactggtatgctctctt

SEQ ID NO: 59179 - DNA, 1028 bp, Homo sapiens
cttttttaggctactctaaattctttccatttttaaaagttctttctaactaaaacttttatctggtgtatttgttttcagaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcattt

SEQ ID NO: 59180 - DNA, 1015 bp, Homo sapiens
tttatctaaattgcatccatctataagcatggatatattatgtgtatatctacagacaccttggtaaatttttcgtatgtttttggctgatactgtacacaagcccagattgggcaaaatctcctgccctcttcattgtgcaccatattttgatggctgttgtcattgtttttgtcaatggccagtacctaataataataggaacacacattggacaatcctaaatacaccacttattcctgtaatttcaaccagcagaagccattactaaaataggctgtggcagttgttggaaatttaaagcacattctctagaatgctctattattcctgggggaaaaaaagttcatcatcagttttttgcctctttgagtcatgcagattttattttggtattaaagaagtttttcatctatttcatcagccaaattacccaatagacatgggctcagttactacaaaggagaaaaacaagtccctattatcaacactgttcacctgaaataggcatattaatatctaacaagaatatattcctaacatgagatagaaaagattattgggagagctttctcttttctgattataaaatgtaaatcttcaaggtactttcaggagatctggggaatgataaaatttttgcagtttcagaattgaaaggaacttagaggtccctatttccctgggtccaatccccagcccattgcaagaatcttttctgtaggctcagtgacaaatgggtattcagcatttggcagctcctgagtatctgagatgtggtacccgtagacagcagaccattccatctcttagaaatcccttccctaatccacttttctgtaacttccagctattaatcctagttctatttcctgaagccactgcagagtaatacaagcacttcctctagatgacaactagtgaattgcttgaaggtgtgatttacatcacctccctcaagttttctttttctttcccttagttaaaatctctacattggctgggcacagtggct

SEQ ID NO: 59181 - DNA, 1052 bp, Homo sapiens
agcctcctgagtagctaggaccacaggtgcaagccattgcacctggctcctccatgctattaagctattacaataattacagtaatggtgagaataagaaaggcaatgatgctgttagaaagaccgtgtgagggagtggttgtgagcatgtcatctgctgcagatcttctgggagcaaacctcagctgtgacagtaatagtgagcaaccttaaataagcaacttaatcttcatatgcttagtttcctcttctctaaaatgagggaaataatagaacttgcctaatagaattactgtgggaattaaatgagttaatataggtgaatcacttagagcagtgcctgcacttacataacagtgtaggtgtggttattaacttctcaacccctttatattttatgcttatttccaggcccatttcagatgtcactggatttagaatagctttgtctagatcccccttttccaatccagcacttgccccagcagaggggctctttcctgcttgcctttcccagaccgtctagttcgttctcttcctagagagccattcatgtacttcctggtgttacggccaattaaatggtttatctttttctctactcattctttgaggacagagactgttttgattgatgtgttcagagtgtgctggcatgaacttgcctgagcatatgttaatttcaacacttctgctccctcggattatgcgtagtattccctttttttttttttttttttgagatgaagttttgctcttgttgcccaggctagagtgcaatggcatgatctctgctcactgcaacctccactttccgggttcaagcgattctcgtgcctcagcctcccgagtagctgggattatgggcattcgccaccacacccagctaatttttgtattattagtagagatggggtttcaccatgttggccaggctgatctcaaactcccgacctcaggttatctgcccgcctcagcctcccaaagtgctgggattacagacgtgagccaccatgcccagcctcgcatagtattcctattagagtgcacag

SEQ ID NO: 59182 - DNA, 1073 bp, Homo sapiens
gtcaaggtcagtgttaaaccttgactttctttagtcatggaatgtcagagctggagggaatctagcatcccattcaacagtttcaggtaaaggtgaggcagccaaagtccggagatctacaggaatcaccaagccaagatcacacctctccttcctggccaagtttagaatacactaaaaagttagataagtaggaagatgcctgaatccttccctagagtatttaacaaagattttctataacttattcttaagcagctgtaccttttctcaggctcttaggtataccaaatttattacaccattgtatttctagctttgttatgggacagattttgtgaagctgtgttttatgtgattgacctgagctatgcttttttgctaggtttgaggtgttgggttcttgttaaagaggctcctctttgagccaagaaatgtttttctaaggcagcccagtgccctgctgttgctttctggtttctttgcaaagctttggccagctgccagctgttataataaaagcaacagtgataacacattgtactcctagtagatcactgtgctatttgtccaggtccagtgctataccacaggttggattccccagagggaggtagaaatggtaaggcttgcaaagactgcttatacttatttctgttttaggcatgtttttctagcttggaaaagaaaaatgtctttgcttaggttatacggaggacctagaatccctctgcccaagtgactgttccaattcttggttcataccacgagatgaaacactctagagttcagtgtgtcaagagggacgtctgggaatggagtcaccagcacactactttgcaattgctgagtgcactctgaaggttaaatcctgctcaaaggctggtgcagtaccctgggagggcatttaatgatgtacctgtgtgggctatccaaagcacagatacgcagacacaggaggagtcatcaaagagaatcgtttcaccacctctttccagagtgatcaacacagccttgttgtgaactttatagatatttgcttagagttcctagtctccatctagtattactat

SEQ ID NO: 59183 - DNA, 1036 bp, Homo sapiens
ctcagggaagccaaaatactggacacccctgatctagggcctgtatatggaaaattctgagatgactgaaccctgaattgcacatagaagggtctcctttctctctctttttctcctcgtcaaaagggggttagggttagggttaataaaaggttaattcccaagtataaaatcttttggttttcaagtttttgttgctcgacctatttcttcttatgttagtcttaagccttagacaacccaaaagtgagttaaaaatagaactaacattttctttaaaagtttaaagaatcttccacttttggatgtgagtgagattttctttaatattcgacttttcccccttctttttttggcagcctttaaatgtacaaatctcattgaagtcattccaggctgaaaagcatttaagaacaaatatcataaagctaaaaataaatattctactctttctgtagaggctattggatatttctcttaacattctggtcaggtggccttttagcaagagatggatgctaagagttgtggggggcaaatgcagtgggaagctcagtaaataattcaaaaatagctacactccaaaccagccttctgtgctaagcaatttggcttaattcaaaacttaaatttttttttaagtggtgatgcagccaaaactccagggccagtattatcttacactaattgtagctaccgcatatactggcttaaaagccttctccccttttcctggcaacatttccttggatttcctttgtgtaacaacctgacctgactctcggttcatatggtttgagcagggcaacccagtcctctggagtgagggtgaggaggaggaatgtgactcaggtttggcaagtcagagacttgtggccagtactttcgctagaactgttggggaaagagaatatttctgcactgattgctaagctgttaggtgtaaacacgagaatgaaatctgtctgaacgtgaagccagtacagaagagggaagaacctaacaattgcgtttgaatacctggctccagctgtac

SEQ ID NO: 59184 - DNA, 1068 bp, Homo sapiens
ggataatgggaggtattacaggttagagttgggagcatgggctctactccttagctgtgtgactttgagcaagttaccttaatctctgtttgagctttgcttctctcatttaaaatgtgagaatcataatatttatggaagagttttattgtgagaatttagcaaggtagtaagataatgcatgtatcctcttggtactattaataataacgataattatatagctcaagagctctgctttgaggccagaaaatcataccattcatccagatgaagcctttcaccaacagaaccctcttggtttctcttatccatgaacttttaactctggtctcagtcatcctgtataacagtagttcttcaaattattgacatattagaatcacctggagagaatttagaaattccagtgcctgggctatacctcagaaaccaaagaaatcgtaatttcggggtaaagaccaagtatgagtactttctcaaagctttaagatttttttatgcacagctgagtttgagaaccactgctttagaatgtcagcgataaagggaaattaacaaccatctcattcaccatctgctatattagttagatcaagtaatgctggcagctataacaatcacaaccacaaatttcagtagcttaacacaatgaaagtttatttcccattcatgctaagtccatgtggatgtccctggttggcaagaggacttccaacaaagaaacccaaattctttcttcattcttaagagttcttcctagaaattcattgtattagtcagggttctccagaaaaacagaaccaatagaatacgggtatgtctatgtgtgtgtgtataaagtgtatatgtgtgagtataaaatgtatgtgtgtgtgtataaagagagagagagagagaaaggaaagaaagatttattttaaggaattggcttatgtttatggaggctagcaagtctataatttatagaataggccagaactttggaaacccagagaagagtagatgtttccattcaagttcgaaggccatctcctacagaattcttttttcagttgggggtggtca

SEQ ID NO: 59185 - DNA, 1009 bp, Homo sapiens
cctttgagtcctctctttttattttgcactaagctgctagttgaataaaagtgtagcacatacaattacatacagtacataatacttaataatgataatgactatgttactggtttatgtatttactatactatagtttttatcattatttagagtgtatttttacttatgtaagtagaagtatgtaataagttagttataaaacagcgtcaggaaggtccttcaggaggtattccagaagaaggtattgttgtcacaggagacgacagctccatgcatattaccgcctctgaagaccttccagtaggacaagacatggaggtggaaacagtgatatggatgatctggaccctgtgtaggccgaggctaaggctgcatctgtctcttagtttttaagggaattagtctctgtagaaggaatagtatggattaaagaggccatgacacagtttctggcttgttcggtgattgtactacagatggaaagctcctagtgctttggttaaaatgttgggaattctggctgggcatggtggctcacgcctgtaatcccagcactttgaggctgaggcgggtggatcacctgaggtcaggagttcgagaccagcctgcccaacatggcaaaaccctgtctctacaaaaaatacaaaaagccgggcgtggtggcaggcacctgtagtctcagctactcgggaggctgaggcaggagaatcacttgaacctgggacacagaggtttcagtgagccgagatcatgccactgcactccagcctgggcaacaagagcaaaactccatctcaaaaaagcaaaaaaaaaaaaaaaaagctgggaattctctgagccagaaagggaaagataaggcttgcccctaccttcccttcagtaggcaacattgccccattttatattaatagtatatctggacaatatactgttttccaccctagttgtcatcctcaatgtagctctaaaagttggtgaccagtgaaaattcctctaaggattttta

SEQ ID NO: 59186 - DNA, 1144 bp, Homo sapiens
aaagtttcctctttagtattaaggaagagtcagtttgataaaggagctgcgaaaattgtgacttaaaaaaaaaaaacccagctaattaaaacaaattcaattggacttgataaccatttatttttaattcaggaagctaggaatgaatttgtgtctcctgcctgctaccttactgcatgacagatttcatcattccagtaattatagaaaatatctcaaatcagacagtgcttgcaggcacctgcagccagactgagtcccacacagcagtgtctgaaagaacaacttcatttccatgcaggccacagactagaatgtagttagtgctgggcagagttaaagtacaacagttgctctgttggttgctgtggtggtggcctcaaaccattagcactcaagagatgaacgtcttccgtccatgtggacaaaggaggaatgacttgacacttaggatattggactccagatgtgtttttaaaatggtagttcccacaggaaagtgtctattgcaatgacattggacatgttgattttatttcttattttttacttaaaatttttttatgtcacttgagcgcctaatcactatttccagtagcgacttgtcagtgtgcagcctctttgaactttgcataacatttcacatcaagggtgactctcttgttggtgtttgtttcctactctgcagtgttgaaatatgcactcctctttctgtttgctgcttctggctgtgtcagcggctacttcttttctgtagtgtggtcctctggtatcttctcctatcttctctttctgtcttatgtgcatcccttcttccccttcttcctcctcctccctctcctgctcttcctttcctggtctcctcctttattatctgaccacctctcctgtctatacagataattcccaaatccacaccaccagcccaggcttctctcttaagttgcaacttctcagaatcttctcaagatactccatggacactttaagctcaacatgttcgaaataagctgcacatattcttcctccaacttttgtgactaatattgatctctgattcatcacccagaatctagccttcaaagccttcttcagtcctgtcttctcccaggcggtttatacccaaccattggctgagtcttgt

SEQ ID NO: 59187 - DNA, 1050 bp, Homo sapiens
cccctccccaggccctgcctgcgcctgcctcactgcgaggacttctcccctctcagagccactcaccacagttgccagacgtgcagtgctttattttctgctggactggagcatttagcttgttaatgtttctttagaaagataattgtttctagttaaacatgttgtttgaaaaatatacccagatgtatatttttatgtcgtggtgctataatttctacttttttccccttcaaaatatctaagttactggaaaatttcaacttaggaacaaatctgttggagaaagtgaggtatgtttaagtgtttatttcttaaggaaagtaaatgttctacataaaaaatgattattgagataatcactgttaactaatttaaaaacaaaaaatgtcatttaagaggcccatatagcatcaatatcaagtaaacaattatgtcaccttttgctttaggaaaccaaatatcactgctaacccatatgtcgtctttttattttttcttcagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaattttctcctatgttaattgacttgtattatagttgaatctatgatatttgtgcatgttgtctttgtgacttcataagttaccaatttctaaagggttttaattttggaggttattggtggtttaaaaaattgcccgattatatcttattatctcattcccaaactatgtccttagcca

SEQ ID NO: 59188 - DNA, 1061 bp, Homo sapiens
aattttataagaatatgcaaatgacaaatatggagtatatttaatatattcactaaatatttattgagtaccattttctatcaggcactgtactggatgcataatagagatagagcaatgaaaagacagatttcttgctctcatggaatgtatatcctagtggtaaataaaaacacaggccagagcagaactcagactgttaaaattttgctctcaggtcagattccaaacagttaacacgagatacccagcatttataggtgcataacaataaatgccttgttaatctttttaaaattttatttttaatgtaaaataaagataatcaatatttgccttattacaaggtcattagtagcaaattaaaacttagattatatgtcttagagtccattgttggaagtctagttttcagaccggagttttagaccagaggatattaggatttggatatatcttaataaatattggaaatgttgccaacaaagccaaaacaaactaattgattttatactgttttttaatattatatgaaaagttattttacagtgactggagtattcgttaaagcatagaaaacctagaaatttggtgatcattagattttgccctgactttactaattgcctcacactcatactgaactttcgaacctctgcatctttgctcctcttccttctgcgtggaagattctttttccttctctggccaagtcctctccataaaataggatttcaccagttccgacaactggagttaatttctctttctctatggtctctaacacttcagacctctgttttaaatacttgctatgggctattttgtgttttagtcatttgtatttatgtctttttcaccttttttagatttctgtgccttcaaatgttcatgctttctttcacatttgtttccttggttatagtgccttaaaatttgtagaagatctatatgtttattgaattgtatatttactgtcaaccagaaaataatatgttattggacaaaaaacatgttgccttagtaatgtctctctctctctctctctctctctctctctc

SEQ ID NO: 59189 - DNA, 1079 bp, Homo sapiens
tacactcctgtaattccagcacttcaggagaccaaggtgggtggatcgctagagcctaggagtttgagaccagcctgggcaacatggcgaaaccccatctctactaaaaattaaagaattagctgggcgtggtggtgtgcacctgtagtcttagctactctggaggctgaggtgggaggattgcctgagccatggaggttgaggctacagtgagctgtgattgagccacactgcactccagcctgggcagcagagtgagaccctgtctgaaaaaacttaaaaaatgtaataccagattctttctactcctttaggacttcttttaaaaatgtagacaaaatttgagtcttaagtaaacatttttttctgaagtaaaatttttattttttcgtatattggaactttctgtttcacttgctaatggtagaaaaatgtttagtttaacttgttcacccatctaggatatttttcttttctttaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggtaatcacatagctagtaaatgttggagctaaaacttgactaggtcctaggcattcttagctatggaccatgtctctctttgtttaaagttatcccgcagctggatgcgcaaggcgcactgttccagcatgtctgtggtcctctggtcaggactgctgggcacgtcacctgacaagataggaagaaagaatctgacttagcagcaagtatttcgaatcccacattagaaaatgtagagcaggctgttaaagtgatcagcgcgggttgaataaaaagaagtcataccaaacttcacttatttcattttttgcattccgttatatgcctgttagatatagcaagtgacacaacagtgtatgtctggatttcagcaagtcatttgatagattcgcat

SEQ ID NO: 59190 - DNA, 1061 bp, Homo sapiens
ctcactgcagcctggaaatgctgagctccagggatcctcatgccttagcttcctgagcaagtgggaccataggcatgcaccgccatgcctggctaactttaaaaatgttttcagagacagggtattgctctgtgttgcccaggctggtcttaaactcctggcctcaattgatcctcctgcctcagcctctgaaagtgctgaggttataggcatgagccactgcacccagcttgatattatgttttaaaagtacagggtcaacagttgaggaaagagcactgagtatatactacctggctaggtctcaggtttgccagttgctaaatattttggcatttatacagtctctttgagggcttggctttcctatttttaaagtggtaatctacctcacagaatttttctaaacttaataaagagctgtttatgaaagactgtatgcactgtataattgtaagatattcaattataagattttataagaatatataattcaataattgatgtaatttgatataattataagatattcaactacattgaagatactactgctgtcttcaagtgcagttgttaactatacttctctgtattttgctgtcatttattagcaggcagatataatacgtaatacataatataatacataatatattatataatacataatataatataatacgtaatacatatataatacataatacattcagtatacttaatgtgtataatacagttctgagtatgtgttagaaaccaggatgctgcttatttgattctataataactcacctatgacatgccacacatacatgtaactgagctgggttttgagtagttagttggagagttttttaattgagaagtttaattcagaagtttgtttttgttgcctctgatttaacattttatatttcttttgaaaaatttccaacagagctcaaatgatacttttcccacagcaatgcacattgctgctgcaatagaagttcatgaagtactgttaccaggactacagaagttacatgatgctcttgatgcaaaatccaaagagtttgcac

SEQ ID NO: 59191 - DNA, 1098 bp, Homo sapiens
gtgcaatgaagtagctattagtgaactcacattttcaagttactagctcattagcatgctgactctggcaataacatctgttggatattcctgctgagcaccagcaacaaatatatctagagactaaacgtatttgccagccttaacaggtggtcctctgttagaggaggctgtgggagagagataagaaagatacctttgattcccttttcatttgaaaccagtgaattgtcataccattcactatagataatatttcactttttaaagtatctgtggttggagcaagtgatgcttcagaagcttagatatgtgggtcaactgtattcaaactctgtggcataatcagcattattatttccttttttaaaatacatttttaacattttttctgcaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccaggtcagtatgtgagctttgctgttttttggttataaattgaaaagcatacctgagattgttcttgtaaaacaagcattcactttttgacaagaagtgttcattatttaatggataaggcttcttatggttcttatttcttgaaggaatcttggttttatgtttcaatccttataaaaattatttttaggacacctgaatttagtgtatgtatttttttattgtttaaaactctattttgaaataattttagatttataagagaattgcaaagatagttcaaatagtttctatatcccttcactcagcttcccttattgttaacatcttatgtaaccatggtacatttatcaaaactaagaaattaacatagatacagtactcttagctaaacaacagactttaaaaaaaaaacaaaaaactgaggctttcctcagtttttccactcatgttctttttcaggatccaatcaatgctatacattacatttagtcacatgtccccttggtttcttctaatctgtgaca

SEQ ID NO: 59192 - DNA, 1056 bp, Homo sapiens
agtagctgggaccacaggcgtatggcaccacatctggctaatttttgtatcttttgtaaagacagggcttgccatgttgtccaggctggtcttgaactcctaggctcaagcaatcctcccacctcagcctcccaaagtgttaggattacaggcgtgagccactgactgcccttctgtggttccttttatggataactattttcagtataatttccttgggactatagacactattactcttggctttgagagcactctatcgatctcagatactctgtaaggtatttccagtggagaatgtatcacgtctcttatgcccggtttccccctgcaccatgctatacttttccactttctcttcttgcagggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatggtgagttgaagactacagatgcccccctcccaaaccacatccagggtagaaaattttgtctggaaaataatgaaagtcttcctatgtcatcagtagttgcccagaggtagagcagttctaggggacttcccatctggttgaattttatgctatgagtcactctctggaaagatcaatgcggaatagcatttactctctctacatccctctctcaaccaaaagaaggaaagaaaaatcttctgactgacaaaatcagcaaccaaaaaaccctacattatccaacactcttaaaatttaagaatttaaaagagggaactccacacttcccataactttgtttattcagaggtcatatgaatttgactagag

SEQ ID NO: 59193 - DNA, 1040 bp, Homo sapiens
aaaagccgaatcgtttaacactctccgaagtctatttcggatgacattcagtgagttaagtttttcacattaatcagaaactttttcttttgcctggggaaggagccaagaggagctctaggggattgggtctagaagcccaggacatcaagggcttagggagaggaagtataaagaaattcgatcataaagtttcaataccaagaaattctgattaagattaattttatttgccttcatcttgatggatcaagtgaaagtcatgctcctgttgcgtaaaggtggctgcttcctctgaaaattttcagatttttattttagtatttttaccttcattataaagaggtatttgtagtgtagttcatttccttttaaccagcaaccaaatgtattcacatttcaacagcagggggcacagtacttccagctttctgtaaggcacgaacagtacaaaagctgagtgattcacctgaaagaatttggctataacaaaaatatatgacaacagttctgctccagcacttgtaggaatacttttctcttgacaactacattttcttatgtgatcctcaggacaactgtgtaaggtaagaaagggcaggtatttataccagtttctttgtagataaaacctggaggagttaagtgacttgcctggactctcctactttgtattgagacccattaatgagaaatgaaatgctactgtttcgctttgcttgcatctcaagagtgatttattacatgtaagaatatgtaacacataaagcactatttaaaaagtggtggcttctggaactttagattggcttttcaacaaatagcgaaataatcctataaattacagtttttataattataataaaatgggccaactccgattgaaagagaagggagttaagttcactcctgaaatcagaaaaacgatctctttattctgatatgtcgagcttaaaatctttatatataataccttcattggtccctgctgatgtcctatgattcttggcatttgcttgttgctaaatatatatttaatt

SEQ ID NO: 59194 - DNA, 1207 bp, Homo sapiens
tggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactgaactggtgagaaaattactgatttcttagaagtttctaaaattctattttaaattaaaatatacatttctaggtgttaaagtcaaaaaagatcatcttcagatatgtgtggcagaaagttttacaaatcttggtggggaggaattcttggtcaagatggacttcataatttattttttcttagttgatcaccattaaggaatagtaatagaaatattagtaatacattctaggacatcagcatgaagacgtcatatactaattaaagtatgcccctaaatgcaaacatgtcacttgggaatcttaaaaaccgtggagatgaaagttggattcatagatgtgaccgaacctggtttgcagagagacctgtgcgaaggccagatcttgggggactgaggatgcgacagaccctttcttccagtcagcgtgagagatccaaatcaaggtgatttaatttaataagcatccattgaacacctactgtgggttatgaattggcattattctgggaaattagagatacaaaaataagtgctctgtacctgacaaacattctgttggaatgttttccttaaggtaaggtaccttttaccttaatgagcatttaaaacattttttacccgtc

SEQ ID NO: 59195 - DNA, 1054 bp, Homo sapiens
ttgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaa

SEQ ID NO: 59196 - DNA, 1041 bp, Homo sapiens
aatgttcttcagtaacacatctcatgatctgaagattgtgttacaaaaaatattatcaggccaaaatttgttcggaatacactaatttttgctcctctatatgtgaggaaaatgagactagacagatttaagtaattgacaacttacttaaagtagcaaagtcatggattgtattgacttttaaaaatatagtaaaagtcatatttaaactttatcctaaagtttaaatctaacagaacaactgaaatacttgaaatagacctataaaatagtaattaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttaaaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattggcaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaatgatttaatagacttctcggagtctgttaagtacttaaaccaagaactaccattattcctactgggaaaacataaacatttctcaagtggaaagtaaaca

SEQ ID NO: 59197 - DNA, 2982 bp, Homo sapiens
aacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtggtcagagggttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagctttttgctacgccagtcaggatatggaggacaacgttgaagagattggtgctctgcagaaaaatccttctttgggggtgtctaataccttcactgaagttctggattctgcattacctgaagaaagccagttatcgtattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaaggagaaattccccagggtttctgtaggatgtgtgcagtttttggtggaatctattgtcttcgtcataaagtacaatgctttgtagtcgacaaagaatctggacgatgtaaagcaattatagatcactttggtcaaagaataaatgctaaatattttattgtggaagacagttacctttctgaggaaacatgctcaaatgtgcagtataagcagatctctagggcagtactcattacagatcagtctatactaaagacagatttagatcagcagacttccattctgatagttcctccagcagagccaggagcttgtgctgtacgggtcacagaattatgttcttcaaccatgacatgcatgaaggacacctatctggtacatttgacatgttcatcttctaaaacagcaagagaagacttagaatcagtggtgaagaaattattcactccgtatactgaaacagaaataaacgaggaagaacttacaaagccaagactcttgtgggctctttattttaatatgagagattcctcgggaatcagcagaagctcgtataatggcttgccttccaatgtttatgtctgctctgggcctgactgtggcctgggaaatgagcatgctgtcaagcaagctgaaacacttttccaggagatctttccaactgaagaattctgccctccacctccaaatccagaagacattatctttgatggtgatgataagcagccagaggctcctggaaccaataatgtagtaatggccaaactagaatcctctgaggaaagcaaaaacctagaaagcccagagaagcaccttcaaaattagaaaagagcaatctcgaaatgctgttttggacctccttcatggcatcagaattttctcatttaaaggacagtttcccatatgagtaattagaagtggttatatatgatgaatgctatgcagatgttgtctttaactctcagacattcagcattgaatatctttgttaacctatcaatgagtgatttattgattattgaacattttgtttagaatgggctatatgacccagaatcttaaaacagagttagctttattttagtattgggtatatatgtaagggttccatattagcaactcagcttaaaggtaatgtatttgctaatgatcttcagattttatctttgtctacagaacaattagtaatacccaagtaatattttaattacttttgcagctgttacagttgctgcggcctgttcgaatagtgaaacatacacaaatggtaaattatgtggatcttttgcatataatataaatgtatagacatggtggtaggaatagcaactaatacaaatgccaatatgataataaaatacatttgtctataatcgtttaaagattagctttgcatgatcctttatgcactgtgaaggtctgaagtttataatactcacttgacccttgtaactgatgaggcaatgatgccaccacagtattctaatttacaaaaagaattggagttcaattagtggttgtaaagctcattttggggaggttgattgcaaaggaaatttgaaagataagatttattcttatttaatacttcagaaaatttctgcagagccctgccctggcacttaaaatagcttccaataagtaacttagaccaaaaggaaaaatgaagtgccccaggagaagatacttcagaagggctgttctgaaattcctaaggaggaat

SEQ ID NO: 59198 - DNA, 1065 bp, Homo sapiens
gtgttctgcgttgccggccgtgggtgctctggccacagtgagttaggggcgtcggagcgggtttctccaaccgcaatcggctccgctcaaggggaggaggagagtcccttctcggaaggtgagaggagcgggctgtgcggaggctaatgggtgggttcccttgggggtcgacctgcgcgtcacctccgaccctcctctcgggattcgggtcttccaggaagggaaggagagggtctggcgtgatcttcccaacccaacagcggagcccttagcctgagtggagtatgtgttttgttccgaggggacgtctggcaaccagaggtctgcagttcagtgaacggagggagataagagagcagacgattccgggctggagcaggcgccagggttgccagacttacctcatttttccgcagaagctggcagtccaggttttacatgcaatctctccacctttaaatgttgacaagtacattttcccataatattttgcaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtaagagactgtttttctgaaactgtggcttgaggaccacctgcatccagattaactgctttgtttaaaattcattcacagcagaactagtgaatcccagtcactgagtggagttgagagtctaagaacctctgaaatttgagaactgctggaccagagcctttagagctctgataaggtgtcaacagggtaaagctgcctcctgatcctgtactttctttcttcctttccttccaaacttaacgtttgataggagagatttgtattatgaaa

SEQ ID NO: 59199 - DNA, 1023 bp, Homo sapiens
tctgaacaatttctggccgggcgcggtggctcacgcctgtaatcccagcactttgggaggccgaggcgggcggatcacgagttcaggagatcgagaccatcctggctaacatggtgaaaccccgtctctactaaaaatacaaaaaattagccgggcgcggtggcgggcgcctgtagtcccagctactgggaaggctgaggcaggagaatggcgtgaacccgggaggcggagcttgcagtgagccgatataggccactgcagtccctcctgggcgaaagagcgagactccgtctcaaaaaaaaaaaaaaacaacaaaccaatttctgcattggactccaagctttctcttcatttgtctaagatgttttaataaatgtatttttctttaaatattactgttctccctgtctcttttcatatcaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtaagtctggaccttatgttaattctttgacaattaagaatgagacctacagtgcctttttttctcccccagaaacggattgttttcactcaatgccagaacttatcaggaagtaaaagttgtatgttttagaatattcccaaatcagggatgacttccttctgtgataataggcctagttttctttctttataataagccagagtatcaagacactgatggacaaagactattaatatctcctttattctttttttttttttttttttttttagatggaatctctagctcaggctggagtgcagtggcacaatcttggctcactgcaacctccgcctcccaggttcaagcaattctcctgtctcagcctcccaagtagctgggattacaggtgcacaccaccatacccggctaatttttgt

SEQ ID NO: 59200 - DNA, 1012 bp, Homo sapiens
agccaataatccagatatagtaaaggtaagagtgatttgctaagtgtcatattcaatttctgaagcatttccttaataaaataataaatcataatatggatttaaatattctgttatgcgaataacctatattatattattaaaaggagcaaatgactgaggcactagaactttgccttagcaactaacatatattgggaaaatcatgttttctgcaattggcaaaaaagtagtgatttttaaaacaaagactagtataaagaggctcaaggagaaaatattctagggtaaaattaaactcggagtcttttgacttctgtgctataactctatagtagtggttctcaaactgtttggtcgcaggatccctttacactcctcaagctcctttatggtaatattttttgtttatgtaggcgatagctattgatatttactgaattaaaaattaaaacaaaaatttaaatgtttatcaattcacttaaactttataataaactcattacatgttagcataaatagcatgcttttatgaaaaataatcattttttaaaacaaaaattatgagagagaggaatcatacatttatgcaaatctctttaatgtggcctaatagaagacagctgtgttcgtatacaagttgaacatccctaatccaaaaatctgaaatgttcaaaaatccaaaactttttgagtcccggcaggcaagtgaaaaattccacacctgatctcatgtgaagagtacacaaaataattaaaaatactgtataaaattaccttcagtctatgtgtgtaaggcttatatgaaacataaattgagttttttttcttcttcaccctcttgctgtcagtgtgtggaaacgtaaatggattttatgtttagacttgggccccatccctaagttatctcataacgtgtatatgcaaatattccaaaatctgaaaaaattcaaaatctgaaacacttctggtgccaagcattttggataatgtgtacccaacctgtatctgc

SEQ ID NO: 59201 - DNA, 1978 bp, Homo sapiens
tgtgaggcatttagtaaaaagcttgcacattattttttgctctcttttttatagtgaaatctgtatattgttcatttaaattaccatgctagtgaaaattgagaacaactttttgtttataaacccgaggctcatccactatgcatcctgattacttagattgactgacagtagcatgcacagggtccgtcacttacggtacacattccaaaggtggctcttgagaggacctcctcgtggcaagcaagctcgacttatcaggaagagcattctgggcatttgagtgcatcaggagaggatgcccttcccatagccactggccatgtacatgcaggctgatgcagagccctgagtcacttaggtggtggctaggactttcccctctgtttcccttaaaggcagggagtcagtgatggcctgggccctcgtcagaagacaccaactcctgcagagacagatagagactagcaaactgtgtctgctttcagtaatgctgatgtataaagtaaggagactccatttaagtcataaacctatggattttcgtgacaatagaaaacatttttccatcttagtataatatcatttggttggttgttaataaatacatttttccttaatcttgctaatctagatatgttgatgattccatagctcttcaaatagcacttggaaataaagatataaatacttttgaacagatcgatgactacaatccagacactgctatggtaacgttttgatgaccaccctatgaaaacacgttttagttatgtcccgagctgtgattaaaggcaaatcttcatacactaagcttcttttaagcgtttctatatccaggctctgtgcagaatgtacattaaaaacaacttgatcctagagaaattacatgtattagagcataggtatattggttaattttttaaaattaagaagtgactgttatttattatcaaacccttatccttgagcatttcatttgaatataccaagcatttgatgcctttttttctcatctcactccgttcggcttctgtggcatttggcatcattgaagacccaagcctaggaatgctacgggagttaaagctgttttttcactcatgcacaatttaacaaatatttaatgcacgcccctgctgtttctttaaacaatttgctgttttcttttatttttcttttttgagacagagtttcattcttgttgcccaggctggagtgcaatggtgcgatctcagctcaccacaacctccgcctcccaggttcgagcaattctcctgcctcagcctcctgggtagctaggattacaggcatgcaccaccacgcccggctaattttgtatttttagtagagacaggatttctgcatgttggccaggctggtctggaactcccaacctcgggtgatctgcccacctcggcctcccaaagcgctgggattacaggcgtgagccaccactcctagccgcgatttgctgttttcttctgcttcttcagtattgtatgtattccttaagatactgtctcccatcattgtctttctctttgtatttctgtttatcctctgttctcttttctgtttacatttcttccttaggtaagtccttagggctttaatcccatttacgtaaagaactcacatctccatctttactccagtctctcgcctgtgcaccaaccacagaattctcactgtctcttgcgtctctgatttcctgtagcctccaagtctatttataggcaaaactaaactcttcatgtttttaatcaacttttaatcacatttctcttttatttcctacttagcacttattactgtataacatgcttctattcttttctgattctttccaatagaatgtggtcttcataaaggcagaacttggtgatcctcactgctgtatgatatttactatgtttatatgttgagtgaatgagtgttagccacaggtctcttttgttctcacactggaaaactt

SEQ ID NO: 59202 - DNA, 1083 bp, Homo sapiens
ctcacaacaatattatgagatacataggattgctgctatcttctctatttgaggttaagagattgaggctctgagaggttaagcattctcaaagttgtacagttagtactggtgataggaagattcctagtcacagttgatataatggattggaagcggcatacaatccaataggcctggatttgaattctcactctgtcatctttttagttgagtcgtctttcacacactgttcacctccctgagcctatttgtttataaaaaatggatgattatatacataaggctgttgtgaaggtaaatagaaactgcgtgtcaagcacctgccataatgcctagtcattaatatatgtgcaagcattcattaccactcctctccttttaattgaatgcaactaaaaggagatactaaacatgtaaaacgttgtcaccaatttgcctgcattttggaagcctgttttaagtcttaattatttttattatgtaggtagttatcacagaaacgtgccagttttatctttcgagatctggaaatacaagtcaattaagtaacagtatgggccagttgggaggaagtagccatgaactgggaagggttctgagttttacttctgtttgttgctagccaagtaattttataaccctgggcattgtcactatctcttctcttgcctgtgaaatgatatgtaggagaatacttgggcatcataggaattgccgttgatttaaaaatgaatttgccgtcctatctaggagctcatgttttctgcttactgaaaagcctagtaagagcttttcttccacgtactgcttcctgccccctccccatacaactaatctagggatttggtgaaaggatagaaaggatttttactctctagcatttagtaaatattctgttcattatcttggatttgaactaatgcctattaaggaggtaaattctctttaagttttttatttatctgatcatgtataataggatatttgttaaacctaaaaactctctttgcctcctcaataatgatactgatctttcattttcattggaatttttttttaaagctgctatactgaataagt

SEQ ID NO: 59203 - DNA, 1053 bp, Homo sapiens
tttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggtaagtcaaatcctgaaggctttgttttcaaatttatatgtaagaaaaaatagattgttgctcaaactgaggaaatttttcctacatgtgaatgacgagctatattattttttcattctaaactctactgtgcagaaagttcacattttattcatttgaaggacttctctgtatctttcacattttaaactgcaatacatttaaattaactctgtatatttcctgaatcactgtatgttcgattggtgagtatctcaaggggtgccacagttaaaaccgaggcagagtgataatctgtgaaatgaaaaattattatcaatttactgtttaaatccttaatatgctcttgaattcagataacatttaagaccttgtaaggggccaggtgcgatggctcatgcctgtaatcccagcactttgggaggccgaggcgagcggatcacttgaggtcaggagtttgaga

SEQ ID NO: 59204 - DNA, 1643 bp, Homo sapiens
agagtcaccaatactgttagctatgagcaaagaatgttagagtttctgtaaggtataatacaagttaatggagtgcttttcactattgggttttttattgctcttttgttttgttttgtttttttgttttttaagtctgctctgttgcctaggctggattgcagtggtacaatctcggctcactgcaacctccacctcccgggttcaagcgattctcccacctcagcctcccaagtagctgggacaacaggcatgtgccaccatgcccggctaatttttgtatttttagtagagacaggatttcaccatgttggccaggctggtcttgaactcctgacctcaagtgatctacccacccaccttggcctcccaaagtgctgggattacaggcatgagccaccgcccctggccttactgtcctcttttatttgactttcatgggaatgcagattataagggaactctccatctatagagaagtcttatctgatagaattgggggcagaaaggtctgaaagtcattgctaaaggtgaagtgcatttaatacaatgctactccacttgaaagtggatgcgtttttttctttttaaagttgaacgtgttacatgattaaaagaagggatggagctgcaccagttcaacttattttagctagtaagatgaaaacttaaccacacgtgcgtaacgcagcgtttttacattaggagactcttgttttatctgactcagcattttaacatcctcttctaacagttcagaaaagactttaattttaaatagatattttatataatttacctctccagctgaaacatcttgttagcttcttcaatgaaattggcaaatatcatcctttccatattattcattttcttttattaattctatcccatgttcttatttatcttccattttgttgaatattagtttgttgtcataaaaattctacagtaaaaatctaattttattttattttttgatctggggactctaggaatctgattgcaatattaagttacttgacagtcaaagtgaccagacctccaagctacgtttatctcatttctcaaaaaaagacacacctctaaggaacaaggtaaaacatttatttaattttttttttaatttcagaagcggtgtatgcttacaactagaaaatgagaaatacaagcagaattaaaaatcaaaatacctgtagtctcatttatataaaaatgtctactttaaaactttatgcttgactgtaggtgtttaagttgtgaaacttattttctcttgcagtgtatatgaaagatcactttccaagtacttttagtcattaatgtaatgactttataatatgcagttgtataggtttggtcaatccccttatttttgtcatttaccctaaatttttttgctctagcaaataatactgcaaccaagatcttgtggataaatatttgaggacatgttcttgattagtttgtaaggatgaattgcatggagtggtattactggtcccaaggcatgtatgatttaacattgatacatactgccaaaaggccttctagaaactgtgtacccatgataaactaggtttgttgaatcaaaatatataaatatttgtgttactacatagtaaagcatattttatatatta

SEQ ID NO: 59205 - DNA, 1032 bp, Homo sapiens
ggctgaggcgagcagatcacaaggtcaggagatcgagaccatcctggctaaaacggtgaaacgccgtctctactaaaaatataaaaaattagcgaggcgtggtggcgggtgcctgtagtcccagctactcgggaggctgaggcaggagaatggcgtcaacccgggaggtggagcttgcagtgagccgagatcgcaccactgcactccagactgggcgacagagtgagagtccatctcaaaaagtaaataaataaataaataaataagtaaagaataaagaatagcttgaaattaaagttagttgctttaacagaatggtcttaaaatgggtgtttaatcttcaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaagtgagttgccttgtttcttattctgaaacaagataaactgttattttctgtaatttccatccctttctcccaactcttcctagtttcgtatgagtttttgtttctctcactataaaataattatttttctctcttccctttagctaactctttatacttaatatcaatttctataccttcttttcataaaaagatggcaaactaaaaaccagttttcagtctggttttggagtctctctgatgtgaagcaaattgctttcctaggccttaagtctcctgccttccttttcttatctctcaggattgtaaagagaataaaattttatttggttttttgttttttgttttttgttttttgtttttttgagagagttttgctcttgttacccaggctggaatgcaatggtgcgatctccactcaccgcaacctccgccacctgggctcaagcaattcttctgcctcagcctcccgagtagctgggattacaggcatg

SEQ ID NO: 59206 - DNA, 1034 bp, Homo sapiens
ataaaaagttattggttcaaagtctggacccttaattctagtagcttcagcttccttttgtttctcagttggaggtgataataatagttatctcacaggaggattgttggcaggattaaatgagataatctatgtaaagtgctcagtatactgtttggtacacagtaggttctccaatttcctttctcctatttgtccagaccagcccctgaacctgtgccaagaccacaagacctcttttgacaaaaattccattcggtagcttaggaaggtctcagtgagcctctgacagaaacttgggcctcagcatgtgctagcaatggacgattgtacaaaagatttcattccaatctttgaggccagataaccccatatgcttaacattctcgattacatgtaaacattgcaaccttctctttctgtataggcctcccaaatagcttggccattcctgatccctgactcatcctttcacccttgtcttgcctagcaacaattttctccattcttctggccctgccattactcatgtgaatgtgggtattggaactaaacgacttatcagatatctttgcagatagtgaacctcttcagcctcaagatcccccatctctggtgtgtatcggagatgaaggatcttgaggctgaaggggttaactgaggactccctgtattctatcattgtccaaagctttctcatcactgaaaatctgaactgcaacatcacgttttctgatgacaacctcacaattatccaactctttcaatctcatttcccactgtctgttcttcaacctcatgcaaattttaattccgtggtacctctttttttcttcccagttagttaaaacttttaaatcttcgcttgtttttctagatctgatggtttatcagttcaaccactctcatctctttgatcttccaccatccttggcttaactcccaattctgaggaccagtcccaccagtttgtcatctctgcttctgtatccatgttgctaaggatttctgaggaaaactgcaaaattgttcaa

SEQ ID NO: 59207 - DNA, 1126 bp, Homo sapiens
caatgattgtatattttatttcttttaccatcttgcttgctaatacttcatcaacttatcaaatgattataaaccatttcccaaggcttagcaaaagaaagaatcctccagttctattaatatgtggttactgtgaaatctcttattagtttgactatttaaagaaaaaaattttcttagcagattctgatcaatataattcacttagcttcatgtcctaaagtaatgtgcatgtacaaggtctttatttttaaccagctttagatcatcagaaagctttatgacagtgatgtatttggggaataaagtagaaatttaaaatacttttgtcatcttaaattcaataactgtcaatttatactgttttttttttatcctatcaagctcaagaatcttgaatgtctcattattattattcaaaattataagtttcacagcttaaccttttgagactttgtgtgttctggcccttttcttacgtgcgtatctatgtgtcccattatagtatctaccaccatttacaagtttcttgaccaccatgagcttttcatccttctgtaccctgcgtcttcctccccttccttcctgcttcaaggtcccaccaacctcttcataaagcttcctccacttgaccgcaccacaaagggctgtgccacatgcgtgcattttctcttcccttcccccatgacatatacacgtttcttccctggtaactaaagtaatcttcatttcctggatagtccctttgctttgaaacatctgtgccgttttgtctccttcatctctccttggatttgcttgccacatctctgcctgaaaggattctaacttggaaaggaaaccaaacttggaagtttgagatccagacccgctccctcctagctatcagtgtgttccgtcctcccatctgcaaacttaggacactagtgtcattatccaagtcccttttagtctaagttgtctatgactttatgaaatgttctccttcaaaaagctttttctgattctttgtcatttcaaatcttccttttcattgtgtttgcataacccctttgtgtttgcataatacagaaagttcttagaaaccaaaataaaaatgtatttaattgaatcagcatcaattgag

SEQ ID NO: 59208 - DNA, 1060 bp, Homo sapiens
actaatgctagagaactgaacccttctgttttgttccttcagcactattttcttatccatattttgtaataaaatggaattaaatgtgaaaatatctattaggttttcaaatcaacaatatatgttgtatatacgttaagaattgctcattttaatacatattttactatatcacatgtggagattgctgttgtccatgttttttctaattaatttatactgttttccacaaatattagaaacttcattgtacagatcgtctgcataaaaaatccttaatgaaaaatagagttttggatacaatgatgcttatctgtattttatctcattaagcttggttattctgtttcttattctagttcatttattttggggaattgcaaggatttgctatattatataagggaacactttaaacacatttcaaaagaatcacatcaacagttaatatgttttaaaaaattatatatggagcaatcatgtgagatgtagcatgacatagtgaaaagatctagttatggcacttaactatgtgtgaccttggccaaaaaaatggtcgcatgtcttctcctgtgcctcattttcctcatctgtagaacaagatgattaatacttctcttacagagtggttgtgggaattaaatgagttgaggactatgaagctgctttataatgtactcatcatattataatggtgccttctgtgtattctaagcttcatggggacaaggaccctgtctgcttcttcattgctgtagtctttaggacttagcacagtgcctggcacatcataagcaatcagtaaatatttgttggtgtttttcctgcctctttgtgttgataaataaatgaggaattaactgacgtttttacaaagtttatatattgaccataaattggttctgttggtccataaacttcaacttagttccctttttaaatctaaatttttatgtaattactaatgtgcttgaaagtctttcaaactcacattttgcataagtttaaaaaatgttactttaagccaggcatgtgtctgtaatcttagctatttgggagg

SEQ ID NO: 59209 - DNA, 1115 bp, Homo sapiens
ttaagcctcatgaaccaacctctgcaaacttttcttctgcagtttcctcacctctgtcagcattcacagaattgaagagagttcagattttgctctggattagtttggcttaagggaatgttgtggctggtttgatcttctatccagaccactcagaccttgtccatatcagcattaggctgttttgctttcttatcattcctgtgttcactagagtagcacttttaatttacttcaagaacttttcctttgcattcacaacttggctgtatggcacaagaggcctagcttttgatgattgccagaatagtaagacagaatttaaaatggttccatggttgatcagatgggagattagtgggagtagggaacacaaaaggcatgggaaaagaagataggttgtattttggtcatactgacaccaacatgcctaaaggatagccctgtgaaaaaagctagcagacagttgaactgcggctgtgaaacaggaagccgtgagggctagactcatcgttgtagtcattcgtaaagagtaaatacttggagctattgtagtagatggtatcaccacggaatggtgagggagctgcaaatgcggctgaactctgagataacctcagtgacagggatgtggtgtagctgaatggtgaagaatatggactctggactcagaccatattcttggtctgagattcaaacccaactcgaccacaaggtctgtgtgacctaggatgagttaattaaatgtgttctagtgatctcatcggtaaaatggacgtaatggtgccaacctgagagagtcgacaagttgatgcacatacttaacctagtgcttgacatatagtcagtagtcaataaatgttatatttaagagggatacagagaaaaccgtggtttatgattatagttagaactttatttggagcttttaattttgtgtagatctcacacgtttaaatttatgagaatccagatataattggaatttcagaatcagcattacattctacagtttataaaatgctgggcttaccttatttgtgcttaagaatcccagccaatgctttgttcaaatttccgtccaaacttatttattaaaaaattttttgtcctcc

SEQ ID NO: 59210 - DNA, 1057 bp, Homo sapiens
attcttggagagaacatgcctttctaatctcatcgtgctgcttaaaacatttttgctttatcatacaaatagctttttaggagagtaattaatgaagcattttaagccagttgttctagttagaggaaaggcatatatgtactttgggatccatggatcattatgggccaacaaaatgcttgtagtgagagcatcttgacacatttttttgtacttccaggcgctgctagcaacaacaggtcttactcttgtctcatcatttttccccttcccttgaaaaagatgtccagctacacaagatccagtggtgcctgtatgtctagatgcctcctggcaggaggcctcctctctcaagctccctctaccccaaactagaaagactaaaaaccttcttctgagccaaatacacttccctacccccaaataaaaaaacagttgtaatacaaagagaagagggaataagggctatacactgtattttcacttggttccattttgctatgtgcatagtgttactattatcaatgtgtactttttattatctatggcaggactttaagaacaggctatttaacctacagtgatgttcatgccttatccctctagtttgtcagtagcactatgctaataaaacttgcctttgggattttaatttttcaagttatactttctagctatatatctcaaagccagagaagtggtttttttgtttgttttatgtggagaaaaaaggagggtggtggaaggaaggaaagatacaaaatatggaaggaaatgtggatatttaatgtttctatagagcagtgataagtttgcttagggtgagaaaatgtattttcaaatggctatgaatcacaaactaagtagaatatgagaaataattttatttatttaaatgaactactgtcacctaaaagactcctgtgctgagagcaatatttgaagagtaatagataaagacacttttatttgaaaaagataatagtgatttttaatttattacaaaaatgttttatgctttagcatactctttctgtttagaatttaggactatttc

SEQ ID NO: 59211 - DNA, 1145 bp, Homo sapiens
agtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtc

SEQ ID NO: 59212 - DNA, 1014 bp, Homo sapiens
atataaagcatccagcatagtacttgcctgagatttatgcacttaacaaatgttttttacctttatcagaaatgatattagaatttcataccacattgatgtgtcaaaaagaaatgtaaaaaagtatctaaggcataagtattaattattatttattcagataataagagctaaccttcaatggaagctttcgttctctgactcatgctatattgtctctcaggaaatgagctaatttgtaatatacaaatataaattaatagaaaataggaaataaaagaagaaaaaatataaaagaagaaaatcaaggtataaataaagaaaatataaataaaatgttacatttgtatgaagtataaataagatttgtttcttacatacaggtaaatagacctatatgtttgtttgtttattaatgttaaaattgtttctttatatggcctatttcctgaaaactgtcaaagcaattactgtattttagtgctcattatttccctgtgattgggagaatttttattctggtttctgttttatgagatacttaatttacttattgaaagcaggtgataattatttgaggcaatatgatgccattctgagtaacccaggaatggttttggtaaatgtgaatttaaatagactctcttctttcttctctattccttcaacccctgccaagcaaaagctatagccctggtaggttcctttgtaggaattacctaacattacctaacaggacatttagaacactcttcacagaatggttttacatacgcgtgtgtcagtgacgctcatactgttggtattcttagcatggtccacatggctctggtaccaccttcactgctcagaaatgtgggcaggtaacagaaaaccttggatgggattaaggatgcagcaggctttggtatccttaggaggcttcactgtatgtgtgtcattctctatacttactattctgtttttttgagacggagtctccctctgtcacccaggctggagtgcagtggtgcc

SEQ ID NO: 59213 - DNA, 1117 bp, Homo sapiens
atgttagaattaaatattaagtaataagaccatctagtggtaaaattttcaagttttagtgaatgagaaagtctgatacctgtttcactaaatatgaactttagagcttatcagatagctgtactataagaccattaaaactttatgtctagaaaatagtttagcctgaggtagcttctccttatagaaaatgaaggctctctggttatatcctaaagatcctgtctgcaaattgctcattcaaatgcatgatatttttctagattgtaataatcagagccacaaacaataactataaagaataaaaattgggaacacagtggagatttaatagcagaatagaatgttaatatttatatgcctaaaatttttccaatctattctgtgacatccagggcctattatgtgccaggaaatgagtaagactcaggtcctgcccataaaagaaaagcacgccattgtttgtctttgtatttagaacttttcagaagtgttggacattgacaacttgctttttgaaacaattaatcttaaataggcctggaatctgcatttcaaacaaaggtctttaagggattgttaggcaaatacagtttgagaattatgctatctactatgtcgcaattatacaataaaatggcatcttagaaaatttcatgcctaaatgtaactcagatgtgtaaatggtaaacatttgctagggaaggaacagataaaatcagccacatgtttatggtttttcaacaagtgtcacaaaaataatagagcaaagaagctgaaaagaaactgaagagatacttttttctaactctttgcattgttgtactgtttaacaacattattaaatctttttttttttttttttgaaacagggtctcactttttcgcccaggctggaatgcagtggcgtgatctcagctcactgtaacctccgcctcctgggttcaagctattttcttgcctcagcctcccaagtagctgggactataggcacatggcaccatgcccagctaatttttgtatttttagtagaaacggggtttcaccatgttggccaggctggtccggaactcctgacctcaagtgatctgctcgcctcggcctcccaaagtgctgg

SEQ ID NO: 59214 - DNA, 1037 bp, Homo sapiens
atccacagatggataattgtgttctttcttcctttggctgttgtaacactgctgtgaatgtgcatgcacatatatttatttgtggaccaggataaattataaaatgtctctcctgactccctttctgtgctcttctaataattttgtctgaattttaaatttaaaagttgattacaaatatgtgataaaaatcacagtgttaaatattcacaataacttattccatggaattttaagggatttttctttttaaaagtaaaattagattttcatagacaattacaaaaataaattcccctcttaaatcatcctgatttagttccttgacactagtggctagaattctgcataattcttaattcttaaagtgtcaaattattttcatgggccatgggaacctctactattgatttgatccaacagagaccctgctctccttacccaagaagtctttgctcattgaggaggaagatgttctggttatctgaggttgaaacttgagtacatttttacttggacaccttgatgtgattgatatactaatgcaatactgtttttcagttgttactttaaaataagattgtagaagttagatgtttaatctgccattatatttttcatttctgtgggaatatgaattctgaattcctactgatttggatattttttaaactaataaattagcactattgctattgaattatcattttgctctacattgtattactatagttttatgcctacatcttaccccacggcgcttctcttctttcacaatggtctctattttctgtcacaatcagcaagcttcccgtatctgatgttactaaatgtaaattttgacctctctgcaaatattcaataggtaggatatttatctgcatgaaagttgaccctgtatcccccatcctcaccattctgatttcagaattggacactgtgcatctttgcacagactgagcttttcaataataatgactatgatcataatatgctagtgaaaaaaatcagtcaaacttttcataggtttggtttgt

SEQ ID NO: 59215 - DNA, 1044 bp, Homo sapiens
ccttagcctcccaaagtgctggggttacaggcgtgagccaccgcgcctggcctgtatcgactattatttttaagccattattttaaaacgttctgtcctcacaagcccatttgtgggcctaattccaaatagagggattaatgtccacatgtatactatatctgtattttaatgattagatcttttaagcccttactagaaattatgtaatcatattactgttgtccttcaaagttgatttataggtagacatacattccagtatggtgccagtgtgagaactcttcttttggatttgccttcagaccattttacaagccattgaagataatgtttttgtgaatataactcattttttgatccaagatagactcattttacttttctggacatgtgtataaatgacatgtgactttctccaaaagtcagagcttccatcattagataacaattttccatgatttaggatataaaaagtatatagccagactctaaataaatgtaattatagcaaataataaaaattttacaaaaattaggttttcagcaactgtttagatcaaagaattgaaagtaggcaaaacaaaactaaaacaaaaaactttgctcctacaagagtaaaatgcaggtgctttgcgacagtttggaaaataaagcccatacactttaaccctttaggagagttgccactgttttaggccacaccactgacttgttacagctaacctaccctaaaaatattaaaaggacttcaacatatttaggcatggttaatgatgagcaaaggaaagaaaagaacttggtgaggactgtttcctagtgacttttttaatgagtagaaacagaaaattgcagctgtgatgagatgttgacttgtataaccctgacaaaatacaagagggaatggtaattttccaaaaaagaaaatgactaatttataagaaaagttttgaactacaagttataggaaagatatttgaaagggcctgacaccactaagtgccaaattttatctattggaatcaattaaattctgtgaagatg

SEQ ID NO: 59216 - DNA, 1030 bp, Homo sapiens
tgcttcatagctgagccacatcagttttatttagctctctgtatagtggatcagttttatttggctctctgtgtagtggtattagaaactaccatcttgacgttgttctgtcacctgaaggatgagcaaagcaaaaacaaactatatgtatatatctatatggggggagggagagaggacaggtttatgaaccagttgtactgtatggacttgatcaagtacagtacattgtgcatagtaaaaaaaaatcaatgtctgaaaaaatagaaaaataacattaatgaactattaatatatgagaagcagttaatacattttattctaatggaaattttaactaacatgacttcagagtaaacactcacaagtccagctgaacattttatttttaagaaaaagacaaattaactctttaatcaaacatttttttaaacttaggtcatgtcatataaatgtatgattatttctctgataatgtagagtttttccaatacttttctttcatgttcagtgataggaaagctgagtagattttaaaagggataatttttcacagtgaaaattacaatatattctttcatattatatgttctctttgccttgtgtttagatttttttgacaatttattattattatatttattgtggaaatggagcttgttgtcttccgtgccctatcccacacatttgattatgaaagagagatgttactatatcattcttctgtaacctaaaagcagtcaggttttatattatttcatattcagactgctgtcaagaaaccaattatagtacctgacagatcccactaaaatttaatttttgaaaagatgtttcaaaagaccaaacgcttcacttaattagaaaatgtttggaaacaacctagtctccctgtattgccttgttttcctaataaattgtctgtaagtgatttttctattaatctgtttaaaagcagaatttatttttgagctttagggaaatatgtctcatttcaacttgctcttcattttgataatggacatgcttt

SEQ ID NO: 59217 - DNA, 2117 bp, Homo sapiens
tagtcttgaactcctggactcaagccatcttcccacttcagcctcccgaggagctgagattatggcacacaccatctcatgtccagcttaatcatatttttaaatgaacatttcccactttgttcagaaatgtgatatgaaattacaaattcttcaaaacctcagtgtgctcattgtaatgagaaatggcagcaacaagattagttgagtttggcagccagaatgaaaaaatagttctgggtcagattctcagattaatagtcaaggaacacatttttgatatttctgatattgttaatggagtggttcagtccgtaaaccagaaaatcaagacttccaggaaatgaatggaggtgtcagttgccacataaggaccttgcaaagacatgagaacagaaagatggagcagccagtttttgagataacagcagacaaggatccagaactggaggaattaagtacaggcacctgggctcagtatggaagactaagtctggctctgaaccaaggataaattccatgagaactcttctcacttttctacttttcaccctaattctacaagataaataggacatttttcttagctggacaataagaacattggttctttaggtatgctctaatggatacaagtctagaaaagcgagcgttatcaacttcatcttacagtgcccaaggctgaacttgtcaactttgcaaataaattcccatcccagctttattgtttctgtcaccagcagttttcttcatgcccatgcacagaaacagtattacttagcacgctttcagatgtaaataacaaatgctgcctgagactaaacagggaagaaatttactggctcacataactgaaccccatgagggttgtttacttcagcatctcaacaatgtcgtcatcagctagctagcttctctccgtctctcagtcttgctcttcatagtggttgcagactgaggagtttaccctcactctcataggctgcctgccagtagcaggaaggggtacatgctactttgatcacatccaacaggaaagcgaaaacgttacttccggaagaccttccagaatttggaagaactttgccaaaagttcttaacatctctcatctcattggcctctcacaggttcaggagagggtcacctgcttatttctgaaccaatccctggcaaggcaagttagattatccttaaaccagtcttgctcaccttgaagctgtgtgtgatgttagttttcccctaagccacatgatctatgtcaggaaagagtggatgccagagatttttggagtcctttgaggaggaaagaacagggaaaggatattgaaagaaaaccaaggatgtctgctttatttgtaaattttgagtgttcccttcccttcaccttgtctgtctaatccttaggtctgttgcctttccccacgctgcccgccgtcctgagtcatgattgggctaccaacctggtttcaaccctcctgcagtttattttgtataacacatctaaactgatctttattttctttgttcaagaaactacaatgactgtcttttgcctgccaaatagatttttaaactaagttgttcatgtcagagttttctaattttgtcccagtttccatggtcagccttacgtcccattaccagttgtttgagtggtctctcccaatgcatcccccataaattatgctaattcctgcctgctcttttcccacagacataaatacacacatacattaaatgacaaagagatacattctaaatgatgtctgtatatttatcgtcagtacgttacagtttcattcattatgttgtgtgtgtgcctcctccccacagctaaactatacatgtcttattcaagtaccgcataatatactatcactgtgccctagagccacctagtactgagagggggaaagatttaccaattaggtgattaagaaaacatagctgaatataattatcaccaaactctgaaaatcagtatgatagtaatttttatcttgccgttaaaattttagccctcccctgtcacacacaaaacagcttttgaaatctgaagcgcgtaacttctaacatacagtgaagtgtatatgtaatttttgtacagaaggcacaa

SEQ ID NO: 59218 - DNA, 1245 bp, Homo sapiens
attaacagttaaatattttaccctttgcggtttgccagctttagattaggagcttttcttggcaccatttttaggaactattctaagtgcctaaattcatcttggcagcactgggttctttgtgtgttaccagtaagagagataaaaggcttagtataaaatcatttatcagcctacaggctgcatggcacatcttatgatactcaggctgtattagccaccgtatgatatgtgcttttaactctcagatttgagaatttgcttatctgaaatgtaagaattaatacctcatacgtaacctaacatctttttttgtttccttgtagacttttgtgaatgatgtaaggattccggaacagacttatatcaccttgaaacttgaagataagctgagatttggatatgatatccttaaatggttttatgtacttattaaatttattcaaatatgtttactctggtttaagttaacatttttaaaacacaattcacaatatagatatgccagaatttctatttattgggtgcattcctatactaaaatacatatatatttttagttattatgcctgttcctaaaagtaatcatggaaaagttggtggactcagctttttttttccctctctctctctatttatgtagtttcagcatcagtctcactgaagtgctattgcatatataatttgagcatcaaagaatgtaactggggagaggacaggggaatgtttaattttagtccagcctagggattgctttcaggtggaacatgatgcatgaatcagcctcctgggatgaatgtaagaatttaaacctacttttccttccatccctcccgttaactgttttatgcatcacagctatattgcctattaaattcaaacttttcaatatcctgtgtcttctaagacctacgctctctgattaatccacattatgcatttagtgtgtatttaaaattcttatgtttaaaattaggaatctaataattgaacaaggacatgactgtattaaactgcatggggcagcgtgaagaatctctagtgaagggaaggagcatgattgcagaagaagaaagacatttccattcatagtaggcaagaagctttgtaaaaaggatttatgtacatttaattaaaatacagctattccacataatgctgaaggttgttttttttttttttgagttttagtttttttgaattactacttttattgggactttggtaataaagaatgtattaagc

SEQ ID NO: 59219 - DNA, 1300 bp, Homo sapiens
agagcccatattttaaatgaagataattttgttctgaaacatgtcatattgtgtcccttttcctctaaatctttggactctttgaatagtttatgctcattttttgttttgaaagaagaaaatcctacaaggtaaatgttttttacaataagatatgtaaaacatggtaaaattataattcacatgatttctctataacagttttaaatttaaaaaaattaagttaatacattcagcgaagtcagctgatgtaaattcttaatagaacatgtgaatttagtagaaaagaatatctttaaaattttatgttttcctctttgggcagtgatgctaaaaagattttgttgtatagtggcaccgttttaatctcatttaatccacacttactttgatatttccctatatttactgtcctattaatattaggtatctagccaaaatgtgactggtatttattctagtattttcttatatttattaactgacaacattcctttcagtctcgtagtgtggataagcaacacgctgtcatcaactatgatgcgtctacggatgagcatttagtgaaggatttgggcagcctcaatggggtaagtcaatggtttattttttgtcttgtttgaacatttgtttaatattgtaagaataaaaatcagattacatttcctagctacattttctttttctttactttgtatgttattttcaaatgcttatcaggtacatagcactttggggaccatccaatagaatatgaaactagcccatattccaaagaaactataagcagatgaatccagaaggtggttgtcattgtctgtgatggctaaagaagacttctttaaggagttggaacctaagcttgacttcactatatggctgtaatttatatgagggaaaacggtaaaaagtcatggcagtgagaatgcaaaaaagtactctcagggacagagaagtaatggttaagtttagaaaataaagatggagctggggccgggcgcggtggctcacgcctgtcatcccagccctttgggaggccgaggcgggcggatcacgaggtcaggagatccagaccatcctggctaacacggtgaaccccctctctactaaacatgcaaaaaattagccgggtgtggtggcgggctcctgtagtcccagctactcggtagtctgaggcaggagaatggcgtgaacccgggaggcggagcttgttgtgagccgagacagcgccactgcactccagcctgggcgacagaacaagcaagactgcgtctcaaaaaaaagaaaagaaaagaaagat

SEQ ID NO: 59220 - DNA, 1035 bp, Homo sapiens
agatagatatatatacgtgtgtatatatatctagatatatatacgtgtatatatatagatagatagatagatatgtattgcccatgtaaacaaatgctctttggagttcattttttaaagagtataaaagggtcccaagaacagaatgtttcagaattgctgttctaggaaaacgtattaagacaataaagtacatgtgaggaaaaagaaattgaaattgcattctgtggtttacacctgatagacaaaagagcaatttatttggtcaacatagttcttaatcaggtatcatatatacttactgaattcattgtgtctttctcaaaccatttgtacctaagacatttattggtacagtattgctatttttctaatactaacatgatgctaacatgagcatttacttgaggattatagacctttataaactgtgctaaaaggctttcagaagtatgaaaactataaaagtttgctagttgagcacccacttactgccttagtctcttcctttttaactggactcttagtggattccgtgggcttacttcactgatgagaatttagtatatatgtcatttcctgggacctgtggacagttcatttaattaagtataaatgttgatgaacgcagttctattcttaggccttccagtgtttggtgaatagccactaaagctaaaaatatctgaacgtatatttttcttcatgtttctcttcaggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcaggtaattgtgtcaagcttctctatatgtgtttattcaaaacttgaaattagtgtaaaatctttttctactcctttagaaaacagtgctatttagatttgaactttctctccttttagctccagctatcattctaattaattttttgcccccttgaatcatctaaaaaaagt

SEQ ID NO: 59221 - DNA, 1055 bp, Homo sapiens
tgagtattaatgtgttttgtttgtatttttcagaaactatgtattcttttaagtcttattaaagtcaagatgaaatatgtaaaaagccattgtttttattttattttatccaactgtataattattgtatgtttatattgtacatattagagcatatgaataatgcttattaactctgggactttgctatattaagaaactgtttctgttatccgtatttggctgtcatgttttagtttactgtatgtaggctggatttattttcttttaacatgtcttaatattgggttttgtttcagttcccttgagtaaacgtgtaactgttgacctgtttattcatgttgtgttttaaaatcgtcccctgaaaatacagtatgcaaattatatactatatttagatcggagggcttttttctccagtaaaatttggattcacctttatagacttggccaggaagtatatattctgaaccagggaaagaaatgctaaaaaccaaattgacaaagtagacagatggaagaccaacaacatctgcattaagaagttgagtaaatgggagatttaataatccacataaatcaactatatcaaataagctgaggagggagtacgagttgattgttgtagctttacagaaaattatttacttgctttgatgaaacccattgttttttcatgtgtgtatagataacatatgatattcaagattttaccttaacataaagttctgcattttacaggattttggtttaatatatagagatatatttcttattgcagaatatttcattttactgtagtatagtttgcctctaattcaagtgtagtagaatatacagttgaatgggaaaatatttacaagtattattcttttgattcataagaaagaacttgagtgcaaactgacattattcttattttactgaagaagaaactaagggacatgggataaatagctagcctaaggtcatgcagaataaaaagtggtggaaccaggattcagactcacatctgtctatatgactccagggcttattcccttaatgaccaagcc

SEQ ID NO: 59222 - DNA, 1036 bp, Homo sapiens
tcaatagctgcagagtttttctttgtttcatgtttatttagaatgtaaaacttagatatttacattttagtccattaaatcatgaaaagaactctgatttagcaggaaagtcagtttttaaagttaatgatagctttaaatgtaaatgtaatgatagttccatgtaaatggaactgtgatgctgggccagtgttcacatccatctgacacccaagtgtctgagctttcaacttttctcagattgctagtgaaaacagctttatgtgacaaaaagataaagaataagaaagagacaaccgaagaggactataactaggattttttaatggctagattgaattgctgtcaaaggttagatgattaatttcacctcctgcccctggaaatttctaggttatcctcacttcaagacttgtagcagctccaaagctactcattcattgaaaaatagcttgtcaaatgctcactgtagatgaaacattggggtaggctcaagggatacaaagatgaaaaagtgtctctgtatttcagctctgtgctggtttagaatgataccatccctaccgtcaccatccatgtctggagtaatgacaacctcctgttgttctagtaacaccctaggtttatctctgtcatggcatctactaccattccctgcagtagtgagttccttgaggcaagatatttttgtttgttttatctttatgtgtccttgatcctcagagtgtctggattccgcaggcttctcaatagctgttgaaagaagggaggaatggaggaagacagttttgctgccttcaaagagctcatcaacttgaggtgtaatcatatcgttacagtatagaattattaatactaaaaatgatactttaaattgtagcataatgtttgaacaaaatattgtgggactacagagaaaagtatggctaactctgccctgggggaatgggaataaacttaccaaaaagcaaatctgttagttttgtactttctcatactctttgagatttcctaaatgctgaaattgataagcaca

SEQ ID NO: 59223 - DNA, 1075 bp, Homo sapiens
gtgagagataaaaaacatctgtctggtagtgtggttgattaaactggatatattgtccagtttagcagaaatgttttagccaaagccagtgacatagccaatgtgtgttgctgttaaagcccacttttatatcaaataaaggtggaaaaacaaaacagcaaaagcaaagttaaagaaaacctcataaaatctacttacatacaaacaggaattgcagaaagtatagaagtggaaaagaatcccaagcatgcattgttgaggtctgaaaaacaaatgacacatagcagagaacaagtcattttttaagtatatccataagtaataaatgatatagaaaatattaccctttgaaacacaatatttattgaatcgttgaataatacctaccaaattttgaacatttcctaggtgccaggaagtttatgtgtgtgtggtgtgtgtgtatttaatttctgcaacaaacttctaaattaaggtattatttttacacattgaaaaaatttgaagcatagagttagtgaataactttgcctctgcgttacacattcctaagtgatagggcctataattgaacctttgtctttttggctaaagccaaaattctttctactcatcttttttagtaagttaaagggtaccacttatttccttactctggttcataaaattttagaattcaagggaactttagaagtcagctcatacaatgtatcacccactactaatatctctgagatgttattgggtccaacttctccacaaacccttccctgggcataggaaagcctgtttagcttccaaaaagtgtaataggaagatctcacttaaattgagctagtagctgcttttactatataacttcttcccactggttgcaattcagtctttaggagtaagatgaagtaaggtttttctcaatatattagctagattttctcttgtctaaatgttaggacacctccaacttcatatggtttcctttgccatccctcacatctctcagctggattcaatcagttttgtcagtgctattctttgtgttctgatcttgtttccatatttaattctgcagtta

SEQ ID NO: 59224 - DNA, 1009 bp, Homo sapiens
aggctagacacttcctgttggaggccacaggccagcctgagccccaccaccaggggcagcggggctcaggacccaggacagggagggaaggaaaggggtggactttgctttggaaccattgcccgacccattctcttctgggtattaagtggacagagatgtttagagtttgacatgcaaaattaagttaagcttaactcatccaggctgagaaaacggaagcctttagttaaaccatctctaacccggacatgaggacagctctaaccctcagctgcccaagatctggacccacaggccactccaggaaaacagagagggtggctgagcactccggagccctcaggcggcaccgcatccaaaatacctgctcgaacctacagcagcctcgcccacatcatggctcagcagaagcctaactcacaactcaagctgattccatgacaagaaggcatcgcagaggctgaagcccactgacagcccctacctagaggtgaaggccaggcttagccagaaaaagcaggctctgggtttagatattcagcagagagcttgcaaacctggatccctgcctcctctctgaccactagtatttgcaactgaaagccaacattccctctaccaaatttcttttgtcatgttcatattaaaataactccaagtgtaatatttgaatctgaaaggccgctttagagatgagccagatgggccagtatcagatagcacaggaatgggcaaatcattgctgttgcttcaggcaaaagaagaaagaaagacctgctagtttttctgaggattttttgaggtttggggtttttttaatgcgttttgtgaaaattttgcaactcatttggcaatagccagatttttaaagccctggaagaagcttctaagcatcggtgatccatgttaagatctaagtgtgctgtaaagcaggcagatggggagttaaaaggcaaagcccacgttctcctgatctagtccagagcccaaaggaagctgccgtgtg

SEQ ID NO: 59225 - DNA, 2045 bp, Homo sapiens
tcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctg

SEQ ID NO: 59226 - DNA, 1077 bp, Homo sapiens
ttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgac

SEQ ID NO: 59227 - DNA, 1080 bp, Homo sapiens
aggtgagttaagccagatgctagatgttgaatgaaatttcataagaagctttattttgcagttgcacttaaagcatcacaaagaaaaaatataagcacttgaagacattcgatgatgaattctatacagactttggatgctgtggatttcactgacttgcagttttgatatatgtggttacatgaaatgaaaggttactgaagactgctccttcttaaaaacttctgttttcttcaataccatttttttcactgtttcattgagtcttgaaattttgatgtcttagagatgattctatagtattatttcttcatagactatgtatttatgaaaatcagatgatttttgaagtataattactctacagcttattgatgaacacaagtttatgggagctattgcctctgttcatctttcctatgttcagagtttaaaaaacatagactagagataatgttgcaaaaaatgaatgtgtaaaattaaaatagatgtttcctgcccacagatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgca

SEQ ID NO: 59228 - DNA, 1006 bp, Homo sapiens
ccttttctttttgattccttccctatatgtcttctcctctcattccttttttggaggcagatttatccatagtgctgatgtggactcagtgtccgggagaggggcgattggaggctaatgctgtgccagagatggtcacaggcagcagattctactgtcgagaggcaaacaaggggtcatgtgggccaagaggtcttaatcttgggaccatggtctggccacaaggggattgtgaacaccctgaaagtgaagatatgatgacgtgtgtgtgcttttctttctttagattcacaaaaagttaaggtgctccaggtcctgaagttgggtcagccatagccagaagcagggcttaccaacttgaccgatgtccaggctaagttgtgaaataccaatccattgaagtgagctactcatggtcagtcctgtggtgaggcagagtttccactcaatcttgtgccattgctagaattttagaatcactaagagtcacagacaatgttggaaagcctgtggagtcatgggcaagtagctcagcgctgagtagaaatcatgggcataggccttggcctctgtccccagcatagactgtggcattagaattgtccaaaatgctgggtaacaccagtgagttttcggatcggcccatgggcagttcctgccatacagcctttgctaggccctttcatttggatataatcctaactgtaatcagaccacatcattcctctgcttaaaaccttccggtgccatcccattgcactctaaatccaaacttgctcacactggtttgcacagcactgactgatctgggccctgtccacctctctgacctcttcctgttccatcttcccccactgtccctgggttccagccacacctcgaacatgccacacgtcaccatgcctcgggctctggggacagtatttatggtgtccaggcctggaatgctcttcttccctgatcttacttggatggctccttcttgtccttcagctctaagcttaca

SEQ ID NO: 59229 - DNA, 1004 bp, Homo sapiens
attaagttgtatttttattactaccctcttcagctagcactagaaagaggttgcccgaggaagagcccacatcctggcacactgctccccatcaatatggttttgcatgtatgtttgttattggggaaaaaaaccagcacagatttttcaatatccctctcccgtcctattcaatggttttcttttgttgtttttcgtgatccattagattttatacagaaccaccaattacccaccggttggtttagactgttgactgggaagccaaatatcatgtctcccttacccagcgactcagcattgtagacttttgttctgttcatttaactacgtgctctctgcttttttcctagaaaggaattttcctgaattgaaatcagttaataaaactctttttctttctttttacagcttgtacctccttttaaacctcaagtaacatctgagacagatactagatattttgatgaagaatttacagctcagactattacaataacaccacctgaaaaatgtaagtaaatttagaaggcaattgataaatttctaatataatttctcctaatgtaattgaagaaaacagtcttttaaaaactcatctgatattttcaagatcaaattccacagtgacttactccattctatttaagaatattgaatattgaattgaatttaagaatattgagttcccagtggtaatatcaaaagactgcaagaaatgcttttctgggtaggacaaattatatagagagaaattgtagatgaaattacagactagctcttccttactgttcaccaatagattgttttgacaccaactgaaaggattgtgaaatagagactcccctctttcctagacttcgttcattcccacataaccttcagaattttgccagttttggtctcctacttacttaatagttttaaaattcatgtagagtcactcctttttacttagctctctcttaaatagtattatctgtgaagacataatttagtttgct

SEQ ID NO: 59230 - DNA, 1050 bp, Homo sapiens
tgacacgcagcaactggattttttcaagttttgttggaatagactcttatggagaagagcctggaaaagggaatctcattaagagactactgcagtaatacagtgttaagtgacagagctcttactaaagcagaacataggcaacaaagggaaaggaagtgtgaattccatagaaattatcaagaaattgaggactcctattttagtctgataatactggggaaaatactgggagaaagtttaaggaagaggattatagctggtttttggtaattaatttcagatagaattgtctaatggctagaaatatagcacttctgggagttaaaatggaaataaatatgtctggaaattcagagtttaattagagctgtggaaatgattaaggaggagagggctaaggaaatggataggagagagggaagagaaaatttgaaagggaagtcaggagggagggaagcagtgagaatgtggaaggttgggattgagtgctggaaaatattcatggtcaataatggaagttggtttgaggacacatttttgcaaggtgtatcaagatcatttgtgaagcatcgtgccagagttgaagtggaactttcctgagttgtgactttctactttctggttgagatattcagcctgaagagttcggtgattgatggcagttacgcagaggttaatgattgtaagctactgctttacaagtgaagcaaggccagaggagtagaacagatgcaccagcggaagagagatgaaaggctgaaaataggtttctatttgatacttcccttatcacactcaaataatggcccacttttaaacttggggtcaaagaaagatgtgttccaaatacctgctagacattctgatggctaagccttacaattagtgtcttcttttggtcatgaggcattgtacttaggatataaaaacacaaacagctgtcaaaaccagtgttatttctggcataaaatgtatacagttaaagctttaaaagccttcaaattgggttaggaaatataactagatgttccttacaaaaaatctcac

SEQ ID NO: 59231 - DNA, 1054 bp, Homo sapiens
ctggatttgaactcctgggctcaagcaatcctcttgcctcaggcttttgagtagctgggattgcaagcatacatcactgcgctcatctttacctccttatcattaggaaatgttcttctgtatagatggcagcaatatttgttttgacatctacttcatctgatattaatataagtactccacctttcttttgcttttgtgtaatatatcttttcccatcattatacctttaacctatgccaattatatttaagtggatattcttttagacagcatatagtcaattcttgtttttctgttattcattagaaaatacgacttaatgtaatgggtagcccgttttcatttaatgtacttaatgacatacttgggtttaaatatacaatcttgctgtttgttttttttttctttgttcctttttttctctttgtctgccttcttttggatttgttgaatattttatggttccattttatcactgctattgtcttcttgtatgtctgttttattgtttggaggttgtttctagagtttgcagtacacatgtttaacttagtctaccttgagtcataaccaattctcatacaacagcatatttctgtttcctccatctattctttaggctattattttcttacagtttactttcacatatgttaataaacaccacaatacatggtaatggtaattagattttgctttagataattatattttaaagtggttgaaaatgctacacattaaccattattagcactctccattcctttacatagactatgcttctacctgccgtcattgttttcttgattataaggctcctttaactccacttccacctccctgggtttggaaaaattcatggaaaaatgtgtttgaaggaatacaggattgggaaatgaaggaaatgggacatttcagaatgggaaaacaatgtgagaaaaaaaagtagtaacaagagaagtgaatgaagatatgctgactggaggaactgggaatctgtggtggatagaatctggatgtaaacagcggacaggtggcctgtgaatacact

SEQ ID NO: 59232 - DNA, 1197 bp, Homo sapiens
aatatcttacttcaaagcatattttgttattatttttgaagtcttaaattgtatattagagagtcattgacactgaaatttttgacagtttcacacattgaagaagtgtgttaaagaatttctcctagcttctaaaatggaagtctgattgtattctcagactttgcatagtattcatagctgatattttagttttatatgtatttgataaatatagaataaatgctggctatgttcaaaaccaaagtattgctagaaaacttgaggagttacaaaaatggataactaaagctggattaaaacattttatttacaaaatgattatgattctccactccaactcccatctcaagtacaattcaaatgaaaacagtattgaaataaactacaacataagtgtaagaaaatgccatggagctttgatgtttctcatgcagactatgttgacgcatgcttgaaaatattaaatgcttttcagaaacgtgttttggtgcttttgcttctctggttccccaagcacaagcttagaatgccttttggataatccagcactgatcttgccttcaaaggagtttgcagtctcctgggaaagaaacctacacaactgaaatagaatgaaaaagagggcagggtctgaaatgctgagctctcactgaacacagaactaccagtctgaaaattccaaatgcaaacatcgaacagcactattatgatcaaacctaaaagtgccatctctggggtatagttcatttagagaattctataaggatctgggagttggagacccagctggtgggaattatttatcatcactaaagatattcaggtatcagttgactgttttccattttaattgtgtgtcaaaggatactaggtccttcccagtcatgtgtttcttagatctaataaccagaattcattagaattatataattataaatgatttctgacctacgatggcttgacaattttttgactttatgatggtgcgaaactgatgcgtatttagtatgctcctcaactaatgatggaattgcatccagataaaaccatcttaagttgaaatgtgggcttatctagacataacccatcattaagtttaggagcatctgtatttgttttctatgacgtatttggttttcttccaacccagtggtgttttggagttagcatataccagctctcaagaaccaactg

SEQ ID NO: 59233 - DNA, 1053 bp, Homo sapiens
gggatagtataatcagatttgtgtcatgaaaaggtaactctggcagctttgtcatggacagattagatgagtgaggatccaggggcaggcagagcagttaaaagtgtttatggggccaggcacagtggctcacacctgtaatccccgcactttgggaggccgaggcaagaaggtcacttgaggtcgggagttcaagaccaacctgggcacatagcaagattcatctctactaaaaaaaaataaaatgctgggtatggtggcacatgctgtagtcccagctacttgggaggctgaggtgggagaatcgctggagcccaggaggtcgagactgcagtgacccaaggtgacaccattgcactccagcctgggcaatagagtgagtccctgtcttttttttaaaaagaatatttatggaattgttcagataatagatggattccttcctgaagcagtagtacacaagtgatagaggttatgattaactagaaactatgaggaagtaggaggagttaggaatccctctgaggtttccagctagggtgattaacagacagggtatgcaaaccaaggaggcttgatggggctagatgttgataataactttgggtacactgagtctgaagtttctatataaaaccaagatggaaatgtcaagtgagcagctggaaataatagaatgaatgcttaaaagaaacacagtaactgactacatggattgggaaccataactatatctaggaggtagctagagccaaggcagtagtggcaagggtagtggataaggagaagagggcctaggacagaatcttagggaacctcagtttcagggggagaaagaaaagaaagctaacaaggaccttgaaaagcctttggaaacataagtaatgatagcattataatacacctcttcattttttctacgcagctattttaaatactactggaatttttctggtatttcttattgaattgctgttagttctatccaagggtcaactatcattttgcttttatttcttagtctccatcctttctgttcattctgttagcccc

SEQ ID NO: 59234 - DNA, 1180 bp, Homo sapiens
gtgcccagcagtgactttaaaataattgatactcactaaatgaatgctgaattgaaaagttggttcagagccaaagtagaaactgagaaggattagccagagagttaggaggcaaatcaggagagagtcatattaccaaagcccagaaatgtgtttcaagaaagagggcagtaggtgatgtcctaagcttcagatttggaagaagcagtgcagactgtaaatagattattggatttggcgattaagaggttgttggttatcttaacaagttccataaagtagtaagggtacacatcagatagcagactgagaagtaaattcttacccttaaatataatttttagctgatatatttatagaaattggctggcagacacattgaagatacatagtctaaataaagatctagaatcttgcatatattatatcgatttagggaggatccatattttttgtaaagttaaatgagtgggtaagtaggcttgacattcttttaagaaaatttagaaacctaatcactattttcatctcattagaagactactgcaactccacatagagatcacacgatcttttcatcaaagttagtgatattttgcatggcagaaattattttaacctggaaaacatggctccttctactttctatccttgttaggctggtaatacattgataatatatatctaactatatgaaatgaatgaattttttaaaatatccctgagtaattgtataaatgacttgatttttcacatactgtatttgattatttggaagacatacttaacatttctgtaatcagaatgccttttagaatagatcatgtgttatagttttaactgacaaccttttttaccttggtgttttataaaatgatgatgcagtcccaattcgtagcatatgagatttgataaaatacagtaatatagtaggaagcattaaagtttagagactgcaaaatattttagttttaatataattattgttgtgctacactttttggggctataggtgatattttctctctctctctgtttactatgccaatgggtcatgcataaagcttatcttataatatgctgttaagtgaaggtgggggtgggaatggggaagaatgaatttatagggaacctgttttatgttacttgaaataatgactttggtgtatgcagaacaaat

SEQ ID NO: 59235 - DNA, 1679 bp, Homo sapiens
gtaacattttttcttttttttatttcaagtccttgaaatattccttccagacaaaagaccgtttgtgttttgtgatggaatatgttaatgggggcgaggtgagtcaagaagtaaatccagtatttgcatggtagtattttcattattttaaaaacattacttaaaatacaagttacaatatagcagttctccatttcttgataggaatttatgtagctcttaatactattgaacaaatgggagcgaaattatttctgatgagatgtaatgattgtttttatataactacatttatatgttggaaagcataatcatattcttctttttcctgtgtttttaaatgtaaaaagttttaacagaagtatgatttttgaaatcatgttattaaattttgaaaaccagaaatacaagatttattgtttcacaaagtttcttttcaagtaggctgtgaacatggtcaaaagttattttacccattctaaactcagtggaacaatagtccatgggcacattatggctgagttttctcttctttatagtagagtactatgactatatatatatatatgtgtgtgtgtgtatgtatatatgagggtgtatatatatgtgtatatgtgtatatatatgtatgtatatatgtatatgtatatatatgggtgggtatatatgtgtgtgtgtgtgtgtgtgtgtgtatatatatatatatatataatttttttttttttttttttgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccatctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatcctttatggaatttttttcctgtagaattatctgatttgcaggaattcgtttgttgcaaaacttcattcattcagggcttgcatggtggctcagacttgtaatcccagcagttggggaggctgaggcgggtggatcacttgagctcaggagtttgagaccggcctgggcaacatagtggaagcttgtctctacaaaaaataaaaaaattacctggacatggtggcacacacccagctcctgtactcccagctactgaggagctgaggcgggaggatcacttgagcctgggaggtcaaggctgcagtgagccatggtcatgccactgcacttcagcctgggtgacagagcattacctggtctcaaataaaaaaaaaaaaatcaaaacccaaaacttaatt

SEQ ID NO: 59236 - DNA, 1055 bp, Homo sapiens
gatatttattgggaaatatatcctttcatccccctgaataaaatgtattacaaacatggagatattaaattacctcatgcagaaatattagttgataaattgttcccttcaaggaggaaagctcaatatttaattttctgtgtccctgataattttctgactgatttttgtatcattattgatatactttgattaagtatgagtgaatttatatgaacttatacaatcatctgaattaaatcattaatttgagtttttttgtattttggtggagagaatgctgagtggtaaaggaagcatgccactgtgttttaaaatccttttcaatctctgggcttaacctcttccaattttagagaaatagtgaaattattattatcagtgctcaaaacatatattgaaggtttgctttttttcttttgtaggatgaagtggcacacactctaactgaaagcagagtattaaagaacactagacatccctttttaacagtaagtgactagaggacagatgttataatcgtaacatttgaaatttaaggaattttatgttagaaattaaattgtgaaaaatactattcatttagatatctcattttctttgtggaaagaacgtaagtcaaatttcttataacttattagaatgtatggatttttacagtgtgtatgcattgataattcctcccattatgcatttattacttttttgagaattttttttctcccatgaatctcttgccattaaaaacaaaaacaaaccatagagttaatacattacctctggcattttaaggagactattgaggaaatggctgatttttaaaaatttcttaaatgtaaagattttatgtttgttttattggcttctgataaatatcttaatgatcagaagcatttcttcaaatatggaaggcagaaatgtttatcgaatatattttatagaaatgagacttctttgagggatagagtactttaagaaatatgggaatgctaaatacattagaggtgggataagccatgctacgtttttttcactagacaaagtataaactgatt

SEQ ID NO: 59237 - DNA, 1010 bp, Homo sapiens
tgatccttcttagaagaacgtgagtagactttcacaaacatgtcacccccaccccatcactttctctatgtcccacaccatcacaatacccaacttacactctaccaatagcattggttctcccttacagccccgttgacaatagtggataacctccactttttccttaatatcacttatcagaaagagtaattatttaagttggataatttacttgtttgtgttttccactagcctatgaactctgtgagcaatgggatcttattttttttattaagttaccttataccagcactgttcttaccaattagtgagtgcacatcagcagttttttttttaagtgaatggacttggttcagtatatcacaaaatagccacttgtataatgcttaattatgtatttcatattccctctgtgatgctcattaactgtagtatccccttctctggtttttcccattaacactgatcaccatgtaagtagaactaaagctccatgagagcagagaattttgtctatttgttcagtgtcctgtctctgatgtgcagacgaatacccagaagatacttgttgcatatgtgttgaagaagtcggtgggtgggtgggtgggtggatggatgaatgaactcttgcacacttgacatcttggaattctttcctatgatacacaattcagttcaatagacatttattaggtatctgctgtatgcttaccattatgttaggcacagtgtatatggaaatcagtaagttctggtgtcatttctgcttctgatttattttgttttacaatgtttgctattctaattaacttaggaactatagtacgatatgacattggctttcaaattgagcacttaaaactgactcctataaaacaaataagactgagatgatttcatgtttatgctttccttcactcgttgttaattatactttctgttcagacacaattgatcttaccttctttgaatggttgtgggatcttagcttctttgattaatctagt

SEQ ID NO: 59238 - DNA, 1235 bp, Homo sapiens
aggggactgtagagaacaagtggcacgtgtgactggcaaaatcctcaggattacctgacttaagaaagagaagtgaaactgaaaacaggcacattaattaaagatattcttcttagagctcccttccttgctgttctgaattgcataaagtactctctcaggaataacaactgctttctttgatttattttaactgaagtatacgaggttctcgacatttcttataaatatatcctatatctctctctttcttggattttatctttattttgctagagtaaattctcagatagctccttccaaagcactgcttttttaggcatatttggaaatgtttgtgtggaacatttttgattatcacattttctgggggtagcagcactactaaatccttgaaaacttgagtccttaaaaatgagtgaaaataatttttttcctcctttgcccttttacacaactgataatttcgctgaggaattctaggttcaaaatcattttctccaacatctgagaactgcttaaattattttcagcatccatggttgctaatgagacagccaatgccagtctgattctttttcatttaaatgtgcttataaattggtaaaatttggttttgagtggatattgcaaacacatatatatatgctaacaaataaattgcatcaaatacttcatattatattttttaatttgtatttttcagacaatgaatgattttgactatttgaaactactaggtaaaggcacttttgggaaagttattttggttcgagagaaggcaagtggaaaatactatgctatgaagattctgaagaaagaagtcattattgcaaaggtaactgatttattaaagttgattactaaatttttgtttgcagtgtgcatgtgtttgtgggctcatgaatttacatgctaatgtatgcaaattccattaaacaaccaaaatatggttgtagactactgctacagtaatttttgtgtattaatatttgtaatttttaaagttttcagacattcataatatttgtatattatatactaaagctattctcttaaggaaatagaaatgtttatgtttgcatgtttgggagaatgttttgtgatctatatcataattatactaggattgctttttaataatttctcctatcgttctgaatttcttattaagattgactagtgtagatgatttttactcataaattctaaagcttatataacattgaatggaa

SEQ ID NO: 59239 - DNA, 1049 bp, Homo sapiens
ggctgagacaggagaatcacttgaacccacgaggtggaggttgcagtgagctgagatcatgctattgaactccagcttgggcaacagagtgagaccgtttccaaaaaaaaaaaagtaggatatatatatgtacagacaaataaaatttaacttttcatgtaaatgattttaactcgagttttcaacaatttttttcttctctttttttctttaacatacttccaaaaaatgctactacagactttaggcatgtggtgaatgaaatgctcttaggattattttcactttggggtgatggtgagagtgtatgcttatctgtgttgagtgtgtttgatctctgaatagattttatttgtattgatttcatagtttataaaaggaaaatatttaaatcatttaccatcttctattaatgggaaattttactcatttttatagggaagaatggacagaagctatccaggctgtagcagacagactgcagaggcaagaagaggagagaatgaattgtagtccaacttcacaaattgataatataggagaggaagagatggatgcctctacaacccatcataaaagaaaggtagaaaataataacttattcccagcacagcattcatttgtctggaagaaacatattaaaagctaccatttgcagaaagatgtcagccagttttcttacgatatgtaaatatattggtgggtcttattcacatgaatctgaaatacctgttgttgtttaaaaccaaataggtgaacattgtttcagtgatccagcactttagcactgaatgctgatagggctcatgtgtgactgatgtgccatcacactactttataatttgcattttttccttattatttttaatacaattttagaaactttgtaataaaatgttttccctgatgatttgttcttttccatttcgcatttcgtattctcccgaaaagcacgagcagtaatggctcggatgtacttcctgattggtgccctcagtcatagtaaagtcagcaggaaagtgaacaatcttggaaacaataactcttat

SEQ ID NO: 59240 - DNA, 1017 bp, Homo sapiens
ttcagtacatgatataagggtggactctatttttttctcaatggcgagcccatcatctcatctccatttattagataatccatttttttctcactgattgtggataacacatatacatatttgcgcttttaggatttagtctttttttcccctttgacctttctgtactctagcattaacaccacatggccttaattagagaaactataaaatttttaactgttaatatagcaacatatcccttattttttttaacaaaaatgttcttagctacattagtgcattcttttaaaaaattatggtaaaaattacataatgtgaaatcctctttcatttttaagggtataatagagtattgttaactatgtgcatattattgtacagcagatctctagaacgttttcatctggcatgactgaacctctgttcccattgaacagtagctctccattcccatacccccagcccctggaaaccaccgttctactttctgcttctgtgaattcgactactttagacacatcacataagtggaatcatacagtgtttgtcctgttactgtcttacttcccttagtataatgtcttcaaagttaatccatgttacagcatattagaggattttcttcttttttaaggctgaataatattccattgtatgtatataacacaattgccttctttcttttttttttgagacaaggtcttgctctgtcagccaggctgtagtgcagtggtgtgatcatggcttactgcagcctggaactcaggcccaagggatcctcccagcttagcctccccagtagctgggactacagccacacacgcaactaagttaatttttttttttttttttttttgtagagacaaggtttctctgtgttgccagggcttgtctggaactcctggcctcaagcaatactcctccctcggctggaattacaggcatgagccacactgccggccaatacattttctttattcattcatctgctgatggatatttagattgtttcca

SEQ ID NO: 59241 - DNA, 1022 bp, Homo sapiens
tctcttgggcggacacgttgacttttggggtttcagttgcaaccttgtgtgcagcttactcccacacttaaatctctaggctaggcctctctcctgagcattaggttactctgttcaattggctgctggacatctctacctagatattttttgaccaggtacgtcctaagataaactcaagataattttgtctatttcttcctttgtactcagtatctgagttctgtctctgcctgatcaaaaacatggatcctttccatgccttttttttctccttcacatctttaccccactcccaatccatttctagtcctgctgattctgcatatttcttgaacctatgatccttttctataatcaccccagaatgaggcctcatcatatctgctgtagattcttaactagcttctctgtttctagtttgtaccactcatactctttcttcacgcgggtatcaaagtggtctttctaaaattatatcataactatgccattcccctgtgaaagccctgccttggatcatcattgcctactggataaagttcagctttcttaatacatcatagatctcttcaatctggcctctactttcaactcttgcaggatctctcttctgctctacaattatgtatcagcaatactgaactgtttataattccctgtacaacctatgctgcttttccactctgaggctttgtttatgctgttcccttcgattggaatgtcctttggtcctctatttgcctggatacttttctaagacttaattcagattttaattcccatccctattccttgctaaattagtcctctctgcccttcttaaatctattatcttctgctgttaacacattgtttcttggttatcttgttcctgtgcatgtctcattcactgatcagtaagttattttaggggaaagagcttagtcttatttatcttatatctcctagtgcttgtattttatgacttaactttttaagtgaacatctgaaacatctagtcgagatttctctttttttag

SEQ ID NO: 59242 - DNA, 1118 bp, Homo sapiens
atatatatatatagtggaagaggttgggttggaagtcttaaccagttgtgactgcagtgcttgctgaaggtttatcttgacgatacatttactatttggatgtatattggtgggtgtccattgaacaatctctttgggatacttggtacatcataaatgcttcttttttgacaagactttccattttaaccaggttgtgttttaaattggttaaaacctatgggccataaacataaaagtatgatgcaatttgggtttgatgcatcatgtgtaaacttagatgcaaattctgtgtttaaaataaaagattgacttttagcagtccgtcttaaaaggattggtggcagggagtgtactttgttctgggtacttagcctcataaaagctaggactttctgtccatattttagaacaacctgacaacacgtgccttatctgaactcacactgcctcaacttctgagctagagatgaaagtgttcagttccttttcgaacagctaggcacctgaaatctggtataatactggaattaagctctattaagttgtctttttttttttttttggtccagcctctgtaacaaattaataatgaatgcattctaagcatcttctcagaaagttaattcatattataggtgaaaaatgacaagaaaatagatttagtagtctttattggaagtttgagatctacttctggcttagtatcacagtataattgttgattaaccaaatcaatttaaaattatttaaaaagtttgtgagaaataatacttttttaaggaagaagggaaattctttaaaatttttcttctatgtgagtgagtacatcactatcttggtatactgtattacgtttgaaggatgcataatacatttatttttaaatagctttttggcaaccagaagtcctgctatagatcatagaaaatattttaaaagtttaaaaatctgcttaataaaaaagatacaagatttatataatgatgtttttgtgtttttcatctgaggatgtacatagagggaaattatgcttagaaatgaaaatttgatttcttttaattttacatttcttgaataagtgtattcagtactattttaaaagaagaagaaatggt

SEQ ID NO: 59243 - DNA, 1066 bp, Homo sapiens
attgcccacctctgtggtagtttcttgcgttatggactcactgcttccatatttggtattcattaaggttatttactgcagtgtatatgccatgtatgatattatatttagataatataaggtggtaaaatgggaaatatttacaataaggaagttttaaagtttctgatgaaattatatttttaaattggtctatatttataatagtttaaaattctatgactactttttgaaaatggtgcaagaatgactttgtgttaaatccggtgtgtggaactggaaactctgctctaatgcagtaaacagatttttaaaaagaaagctctgctttcacagcctacaagggtgcagatgtaagcaaaataataacttagctcacacttaacccagcaggaggctgcgtacagattgagtaattctccacaacatacctactgctatgtaaactaaagtcaccgtttattcttcattaaattgccaggatgctttctgttggctagtccgtgtggatgctttgttctctgtgtctccacccaatgcccctgtgccttccttactcaccttgcttttctcttagagtaaaactgggtactgtaactctattaagatgttattgtgtttaagagaataatttaaaagcatcactttggttaaaaatgtaatgtttcctaaaaacaagtggaacaaggatttgattagtcaatttaccgaatatcatgaaacaaataccagaatacttaagggtagatgataattatgcagttttctggaaaacaaaagaaaattgtaaagcagataaaagtactaacaaaccaaccatactgagatcttagagaagttgccattctaacatcttgtggttggtattcaatgcataggtatttttctcatcatctcatcagcttcaaagcaaaacatggaccccagctttctttaggaagccgatatgaaaactatacttcataatattgcttctcggacttttggctaagatgaagtgaaaactgtacttaatgtaaaaatgacaagttcatgcattatgcattagaatgagagtttcttgact

SEQ ID NO: 59244 - DNA, 1541 bp, Homo sapiens
tattaatgatatgttacttctgattctttcagagccatttgctaaatcttagtagtacaggcaagtatacatattaaggtgattgaaatattaaaggcagaatgtctttgaagttacaaagaccagatttaaatatcacttaacttagatgagtgaatttactcatagtcacttaaactatttaaatgtgaatttcttcatcttttgaaagaaggaaacaatacttgctattcaaggatcttgtgaaaacaaaatgagataatatatttagaatgtcttgaatgaattcagtagtagctgttagtatttttattaggtgttatgtgcaagtctagagctctgtagctattacaattggagtatttatataatgctctgactatcatagaataagaataccaagctgtagaggctgtttgagagaatggtcacagatagaaggttgtttcttggaaccttatgtttatttagggatatatgattgttttataaatgtggagggaaataaattatttaaagaaaatataaagaaaacagttggataaaagtatttcggatgtatggtattagtggttatttagtgatgatgatttcaaattttgttcttttgtttgtttgtttttgagatggagtctcactccgtcacccaggctggagtgcaatggcatggtctgagctccctgcaacctccacctcctgggttcaagggtttcaagcgattctcctgcctcagcctcccgagtagctgggactacaggcacgtgccaccacacctggctaatttttgtatttttagtagagacggggtttcactttgttggccaggcttgtctgtaactcctgaccttgtgaaccacccgccttggcctcccaaagtgctgggattacaggcgtgagccactgtgcctggccagctgatttcacattttgttctacaaaattatttttcatacttaaaaaagtaacctcagtttattttggagctgaacttttctctgctacggccagtacttaagctgtatttgggttattatctttaaaatgagactttggaacacctagctaaaaataatatttcttctcctcatggaggtttaaagcattatttgattgtcacaactctttattttgcagatgaagaaactaattaagctcacatagggatgaaagtgctgagataagcagaagtgttttcttagagaagtaaagaggatatggctttggtcgacatgaggaagtcagtaaacctaaaagtatgattaattcccatacagatgtaggtggtggttctttacatttttcttttcaaattgttttcatccggcattccacgctagtaaatattactgaataattttggatgatgagtcaagggttgttgtacctgggagagccacctaatttagtatttaagagtctttcataggacggggtatagtgactaagaacttctattttggtttaaaagaataaattggttacactagaaaaataacgctcacttttgaatggagtgctagtagcttcatataaggatattt

SEQ ID NO: 59245 - DNA, 1541 bp, Homo sapiens
agtatgtcagttttagaacatagtttatattgagtaaacacagaatattttacctaaaagggtcacacagatgtcattacagtgaatttacttctgattaaactaatcttgttccctatatattttgatatatattgtgccatgataaccagtgtactattagtgttattaaagtctttcttcaaatagtagatttttatagaattttgaagtagacaaaataagtcaatttatgtttagatttaaaaaaaatgtgaaagcttttctatattctcctccccgtgccagataggtgcttggcacagagtacttaataactatttaataaatgacagaatttcttttcctaaaatttttaggacatatgcaaggaaatttctcttgcatctaggtttactgatgtatatgaggaagagttacatctgcttcagtgaaatacaaaattaaaccaggtgatctttctgaaaaattattcttatggtgacatatcagaaatcttatcaacagctatagtttattctgttggaattttcaaaatacactgtgccttaacttagaaacactccaatgaacttgtattcattagtgttttgttgagttaaagaaaaaatatctgtacaaagtggacacattgtttaattttgttttgcattttactagattgcagtgcaaggccaataaattaaacctaggcagttctcttgctaattacacacaacttatcttgagtatcagatattcaaatccattttatgaatatggtagagagaataacaactgtaaaacaaagcagtgtgcatgtaagtgactgttagcgtgcatttcagaaaggataaatgctcaccatatggtacaattactgtgtccaagttttcaaattagcttctctcatcctccttattactgtctttaaaaagagaggaaaaaacccaacatgatttatctactctgcagcagaactcttgacgcaaaacagcagcccagttctgtccagtttttttttcccttagcataatagaggctgtcggacttttttatactaattactgtgtgagcctcagatgaacccccttcaattcacagggctttgttaagggaggagctgtcaatgtgtctgcccgtttgcagctgtgctgtggctttagcttgcttaacattatgctgctttttagacttgacagaagggattttttttttttttttttttttttttttattaaggcaaagcagccttgtagcgaaatggtttaagcagctgcattgtagggaagcacaaagaagttattattgtgtctgtttaggggggtaggatggagggggagatattcggctgctgttgatgccgattgttgacttgccatctgccagatagggagaagaaaaaaatgacagctccagcagggtgttcaagaggttgtttggagagacgcataaacatgtgcagatgtcgaactgaataatggctagaacttgagacggtttatgatgctgctgatgtttgtgcatatacagaatgaatgtatgtgtggatttggttaacc

SEQ ID NO: 59246 - DNA, 1013 bp, Homo sapiens
caatctagactgttttttgcagctgtcttggagttaggtgtggccatacgactgagttctggccactcacatgtgagcagaattaacgcatgcctcctctaggcttgggtcatgaacatctgtgttcagtgttctttctctcttcccttctgatggcagtcatgaaaccaaggagatggaagagcctctaaaagggaggattctaggtccttcagtcactgccattgaaaggaaacattgttttgaccttacatgagccagaaacaaaactttcattgtagtaaagcactaagttgtcatgatttacctctctcagcagccagcattaccttcactgatacactcaacagtgatttgagtatgtaatttagtttactcaaaatatacttctcatttcttagcaattggaattggtagtcaggaaaactaaagttgaactgaggagtgagaaattggggtgtgactccagttggaggaagacttggtgtggaactcgatgagatgaataaaagatagaacaatttggaatgttttgttagggaattgatacaaaaaacttaaagttagcagagagttatgtgaataaattagagtaattttgggagttgtaggagtaggggggcattatgaaataagaaaagtctctgagagttgggataggatttaaacactatcggtttttttaaaaaggaattttgccacattccacatgcagcttgcaaatgtttttgcaatgactgtcttgacatatgtgatactcagaaaaaggtggaatgtttaaatgaatagaactgcataccttatatatcttgtttgctgggagttagattcattacttgaataatttccctaatgagtcattcccttaggggaattatccctaagggaattatccccttagggaatgacttatcccatgaaaataattggattatggcttgttttgtgcatatatgaaatccagtttgttggacttctacaacacctaaatataggtgaaatttaccttgtgt

SEQ ID NO: 59247 - DNA, 1394 bp, Homo sapiens
aaatgaagtttcttgagagagacagctttaacttgaattttgcagcagcatctaaaacgaagccaatgaaaacacctttttttccccagacagatattactctgtctctcaggctggagtgcactggtgcattatggctcactgtatcctccacttcctgtgctcaagtgatcttccacctcagactcccaagtagctggaactgctggcaggttccactatgcttggctaatttttttttgtattttttgtagagacaggatctctacccaagtctcaaactcatatgatgtcctcaagccctcccaccttggcctcccaaagtgctgagattacatgcatgaatcacagtgcttggcgtcagtggaaacactttactcttgattgtgccattttccataggggttggtggctggattgtactttctagttgtgaaagtaatggtgaggtaatggctttgagtctagggatcagatccttcaatcagtagtaatataagtgagaagtattaatatgacatagtgaattatctataatttctagagaacatttaacttgcattcttagatctggagatggaggaccggttgattcagactacattggcttcaaagtgataaattctatattcacctctactaggacatatagaaaaagaaaatagctttgaaagtatggctctttctttcttctttttctgaatagtgacaggcatctatgaatagtgatgaattcaggaaaactcctaggctagacgttatcttgacagttggtggacagatgctcctgatttgagtgtgagactgaggtattcagaaagcacttcaaaacactctcctatgccagctaacattattttcgttatattgtgattgagtttttagttgctttgtaataatccctcagataaagggcctggtgtgagctgggaaaaatgtttatgatttattttgagcataacagcatatagtcatttttataaattgtttttcagaccttattattacttgtaaactaatgtattaaaacacatattaacatattaacaatttcacattgaacattttaaatgaaaataataaatgttaatgtttaaatgaaaagtggccttgataattttgaaaatgggtgcccagacttactgcatttcttgagaaagattaattgcttcctagacagggttcttacggtgatagttgtttttacattgctcatgtctaatataatatttgaggtataatttgccatggtatttctttttctgagttagttgatgttttattgaagacatgaatcattatgtgattctctccatttaggaaaaaattttccatctttttcagtggggattgggcaggtcattctcatccagggttctctagtttagaatttg

SEQ ID NO: 59248 - DNA, 1030 bp, Homo sapiens
ttgcttgagtcaggaggtcaaggctgtgttgagctgagattgtaccatcgcactccagcctgggcaacagagcaagaccctgtctcaatcaatcaatcaatcaatcaactaacttacttttggtattgtatgctgatttatgaaggttgaacctaggattaaatgttgtcttttgtctgccctttatttttcttcccttaacagatgccatgttgagctgccttgtcctgattttgacccacaatgtgtattcagcctcagcacttattatgtaggttaggctccttttaaatgttaatgtttcacatttatgcttgtgtgaattgctcattttctgtcataacctgggggtatggaaggaatctgttgaagaccaaggaggtgggctttaccacaatactgacatctcttctcagctcaggcagggagccttggctaggccacctattgccactgcctaagtagaaggtgattggcagaatcttatctgctttgctttgacttttcattgccagagtttgttgaaggatgccagatgtttgggaaaacaagtttctttttgctttctatccctattcttgccaaattcttacctgttttttcatgaggatgccctggcttgcaagaaaaagcaagaaaaataaaaacataagtttgattcttaatttgagcattctgacccattttcagctttatatatccttggtccatttttcttcctgttattttgacaactctcatggctgtgggactgagtgcttgttcatagataaatgttaactttcttttgggttgaaaaagagaatattggttgctaagttgagcaaccacagactgagattttcagaaaattgacaacttcttttgagaatttacctgttgtaagttatagaaactgaacttaaatattaccaaacaaccatattaaatatttgccatattttagattgttccctgcattaattgagttcactttataggtgtaaaatatttttatatttagtaagcagatcaaataatattaacccca

SEQ ID NO: 59249 - DNA, 1029 bp, Homo sapiens
ttacctcttctgggatgtctggcatatgactcttgccttagagtccatagactgcaaatgagtttgtgcttttaatgacacgtactttaaaactcattgatcttagttttattaagtctttagatttttgaaaattttctttcaagtggttattctttgaaatcgtgaagaactgacagcatatgaccagacagtttttctacaaaagcattgggattgcctgtcctgtcctatctgttcccataaagttttaggtgaaatacaaaggtttatgatctaaattcacaattgctagtatgatgcattagcacaccataagttcacagtactctttgcactatattcctgaatgattaaaacttacagctggcatagtatcaagtgctggctgcccaagtgtctccctcacaacctatagatagagtttattgcctgtcacagaaagggagtacaccacctggttagaactttggcggtttcttggagggaagaaagcaaggatagtatgtactgagaatcaaagtttggttgaggttgagtgaatactgggtgtgtgtgtgtgtttgattaaaattggatgatgaccattatgcaacagcaagggattcaaaaaatcttacatactgttggggctttctattgaatcgttgatgcgtgtttcaggagtttgctgtgatgaacaatcaaaccgtttgccagggtgaggctctccctgaatagtcaagtcatgttaacgtacactgtgagttgtttagggagttgatagttttagtcttcaagttgtatgtggtttctgttaaactattaatgtcataggactacaacatactacttcaagctcttaaaatggctttcccttatttttgagagatgtagctgagtgctgcttatagtcaggtcaattcttataaaacaccaacatccctctatgcctaaatatcaaatcagtgttataattatttttttaaactaagattatatcaaattttttagtttgatacttacaaaatagttatgatgctttttttt

SEQ ID NO: 59250 - DNA, 1171 bp, Homo sapiens
tgaagtccacagtagtctacagtaatatactagaccttcatattcactcaccagtgattcacccagagtcacttctagtcctacaagccccattcgtggtaagtgccctatagaggtgtgccacttttttttttaccctgtgtactgtatttttactgtaccttctctatgtttagatttgtctagatacacagataccattgtgttagaactgcgtattcagtacagtaacatgttcagatttgtagcctaaaaactaggtgtttctatgatgttcactcagtgaggaaattgcctaatgatgcatttctcagaatgtatccccatcattaagcaatgcatgactgtaatggagtaatgtgacctggtattctttttcctttttatagttcacactgtatatttttaaacaatacttcagtgtttcagtttatttgtgaactttgatttgtgcactcatttacacattcatacatacattgattcactccttcataaatactttattgatgaaatattacttactggaagtgccagtgaggtacaggagatacagcagtacacagtgctgaaatagtcacagccctcatggacttgacagtgtgtttatcattggattggatttaagagaattagctaatttttttctgttgagagttcatgccatatttgacttttggattttctgagatttatattaatacatttgaaaattttggttttagaattaggctaatggttacagttgtacctcagtttattgtgctttgtttaattgcactttgcacatattgcattttgtacaaattgaaggtttgtggcaactctgttgagcaagtctatctgtgtcattttttccaacagcatatgctcacttgattagcatttttagcaataatgtttttaattaagatacgtactttttaaaagacataatgctattgcacatttaatagactatagtgtagtgtaaatataacttttatatgagctgggaaaccagaatttcatataacttgttttattgccatatttattgtagaggtctgtaactgaacccaaaaggtctctgagatataacttgtatatagattttgatttggtcactacatatgtttatgattgttagcttatacttattggcattctgaaattttccttttttcactta

SEQ ID NO: 59251 - DNA, 1261 bp, Homo sapiens
gtaaacaagcaaaaacaatgcatgttattttttattgacaaactaaaataatgtagttaaaacaatattcttctaccattggattttagcatttttaatgtttgctttttagtatatactacctaattgcttctttagagttacatagttttgcatttcttagattgtaactgaacactaaattttacagtgtgtaatggtttaccatctttatttccgtgtcattatctgttcatcctcaacgagtactaagtgggaagtgggactggagacatttatgtatacttttgagcacataaattctctaaacattttcaaatttgataatataaaatttatttacattttctttaagatgaagcttattccttcttaaaagaacaagtactttatttacatgtgaaggtttactagacacctccctaaagttgaagccctaacagtatctgatgaatgttaaacgtttaatactttcccccattgtcctcctaagaaataagatgcatttctagcttcattttccagtctcttaagcttatgaaagtagtcgagacagtttgttgaccccaaagagaccttttagtctctggcttgttagacaacagggtctgtagtcttcattggcattcagatcacaggcagccactgggctcagtgcaaagccaagcacagctttaggatttagacaaagccaccctggcaaaggaacccagttgtcagggtagctggctgtattgtaaagaactgttgcataatggagagaccaagtagaactattaggatgcaaatgtgaaaaaaatggtggagctaacctgcaaaaacaaacatttcttttttggtgaagagtctagtcattgttgctttcttctgttttaacttctctgggccagggatgtagtcggtgcaatttgagtatattagttatcttcagtcataatgccatcctatattactttaaaatgaacagttaatttgtaggaagagaccacagtacttcaatgttttggaatcttttcataatttacaagtgcatcctactttagtctagatcaattttatatgtgatttttattctagattagatgggaaatcctttttgctcctgattttatttcatctgatttataacaaaatattgttctaatcattgccatccaatgacttctccctgtggattctcatagttgtcctatttattgtagaatttttggctcaagaggaaagctactgaaatccttaaaacaagaattgctttatttta

SEQ ID NO: 59252 - DNA, 1065 bp, Homo sapiens
ttggttagtgatagtaaaaccatgtaatgagctcccaggaagacccttctcttccggccacatgtgttgacatgaggacatgcctttggcctattttgggcagctaagattactctgtggattgattcatattttttgagtgcctacaaaatatgaggcattttgataaatgctggggatacaataatgagcaatagtgatccagttcttaccctcacaagagcttgtgctgtgtaacagaaagggctctaaaaagaaaaagtgatttctaatttgaaacctgagggactagcagcacatgccaaaggggacaaagttcagcatgttccgggatttggggaaagcattgtttatctggggaacagagtgtaaggggaaaatggagatagatagctgaggctggaaaaggaggagggagcctaggttgcaaaacctgtgtaagcacttgggttttgtcagatcagcaggacgtggttgaggggctttaaagccataagatgatgtgaatgatctctgtttttgaatatgttcagtctaggttagaagaggcaaaaattgaagacctacatttgtactgttcaacaaagtagccatgggccaaagtggctgttgagcacttgaaaggtaactagtgtgatgaggagtgagttttacatttttgttaattttgatttaaaaatttaacttaaaattttaaacaatatgttttcctttaactttagtattttgattggactacatttcacataagttattgaaaatttagagtgcgaattgacctatattataggtgtaaaattcacactggattttgagttcaagatataaaaaacaagaatgtaaaatatctcaattttttctatggttatatgttgaaatgatcatattttggatatacttggttaaatatattattcagttaaattttactctttctttttgctcttttatgtatggcttttagaaaatttaaaattacatgtatgtgtcacattatgtgtcttattggactactccggccagattccagttcagaggctctcataggaatctagatgagagatc

SEQ ID NO: 59253 - DNA, 1679 bp, Homo sapiens
gacaaacgtttgttttatcattctaccaaatgagaagaaaactttcacaaaaagaaatgtttaaggtttctgattatcagagttttatttatttattgagatggagtctcgctctgtcgcccaggctggagtgcagtggtgccgtctcgactcactgcaacctccacctcctgggttcaagtgattatcctgcctcagcctcccaagtagctggaattacagacacccagcaccatgcccggctaatttttgtatttttagtagcgacggggtttcgccatattggccaggctggtcttgaactcctgaccttaggtgatcgcctgcctcagcttcccaaagtgctgggattacaggtgtgaaccaccatgcctgacctctgagtatatttattatttacataaaatccgattctttttataacattaaaatgattttaactagttttgcttttttaaaaaaattttcaatttagaaaggtggtaactatcagagaggcatatgacacagacatagtggccccttggtatccacaggggattggttctaggtcccttgtggataccaaattccaaggatgctcaagtcccttatatacaatggtgtaacatttgcatatattgttctattgttattttttactgttttttttttttttttttaattttctatctgtagttgtttgaatctgtggatgagaaactcatgggttcagaatggcctatcacaaactgaggattatggaaaaatactgtagtttacaggtatttttttgaatactgttaatacacagattactcatagtctaattggaataaaaatattgagaaaaataaagtccttttcatgtttaatttctaattctttgcacaaaagtaattttttggaaaagctgtttcttggtttcattttagaattcccagcaaccaaaagtaagcctgagtttgtaccaaggtaggaagtattttatgttttatcatgtctgctagtcttgttctattaaattacttaagcaactttttattataggaaatttggaaatgtgagatgtttagcgcaaggaaatgatcttaaatggaacaaagctggttaagaaattgaaatgaataaaaagcatgttatgaaaatatgcaacactctcattgacctaattaaaatagcttatataagattattgttggactatgtcttataaacttacaagggaaatcttgattccctctctttaactccttatagttattgccaagattaatattcttacatgtatatttttacaaatatgtatgatagaatggtcactgtaaaaaagttctatttttaaaaacattggcatgagaaaaaggtgaatgcttcttaataaagtattggaataattatttattagtgttactggaaatgggtgattcagtgtcactttttgggtaatgtggatttgttttgagagagaaacagagaaacaaggaaacaaaaatcaacaaagactaacaaaatttctgcccagaatacaggtacgtgcttgcatgaaacaaaggtcctatcatgaaaatactaaaagtctttgaagaactaggctggagtttatactgttagtgttctttattgacgatatatggaacatacagttatatatgtgatgaagttaacattaatgatataaatttcccagatgtagggct

SEQ ID NO: 59254 - DNA, 1041 bp, Homo sapiens
tggctgtatgtctttgggtgtgcatacatacacatttctgttggctatgtacctagaagtggggctgctggatcatagaacgtgcatatgttcaacttttgtagatgctgctagatgctttccttaagtgtttattctttatattccagcagcagtttgtaagtttcatttgttctatatcttcaccaacacttggtgatattgttggtagagatgggcctcttcctatggttgctgaggctggtcttaaactcctgggtgtaagcaatccttccaaagtgctgggattacaggcatgacaggtgtagcatcaaccttggccagtaatgtggttttaatttgtattcccctgataactaatgaagtagaactctttttcatatatttactattcatttggagtactaaaaaaattttatgacacttgcattttaaaatattaaactttcctatgttaagaagggctgttgtaaattagttattttctaaaacatttggcataatcattcagtctatctctgtatttgataagttgtgaaattctttgaaaatatttttttccttaataaaactatgtatttcaaaccatggaattgatttcaaatgctaccttctgagtgttattaagactatttattcatagtatttttgaaaacaagactagaaaaaatgaagtgttttaaacaaacagtggtttttccttccagggaagtcttctccaggaaatttctttgccaggatggtcaagtcccttatatacaaagtttttcttccagggtaaaattattaggcattgtagagggtataattaaaagttgatctgcctaattttaggtttaccggccaattacaaccttatcattgaacacagagtttggaagattcttgagcagtattttagagctgtttttgagatggagaccaacttttctatgtgctcctacattttcgagccttccgtgcacttcctttggatctatgtgactaatttctggccagtgaattgggagtgaaaatagtatgtgtcactttggcctgagt

SEQ ID NO: 59255 - DNA, 1047 bp, Homo sapiens
tctataataaaaaaagcatgaaaatatgatgcagaaatctccgttaatgaaattcctcttgaaattatcctctaattcccttttaattctcaaattcactttgccgtataactttcaaaatgaaacttctgacatttttgtttgttcttggaaaaagtgttcatttctttgcagttttacggtgaaaataatatcctatatttctttttaggaatatattcctttgttgtgctaggaacagtaagtttatttagataatagccatctacactctctatctctaatccccaaaggccttaacctccattaggaataaatgtagatttttgtttgcttgaaatagcttcctgggcatgtaaaaacccctttgacatcattatttaggggctcccatcctcccaatggaatcacagcctaatacaaaaactttgcagctggtgagctcccaaagccccttttgatgattgttgttaaactcagcatggcagcttgcagttgttcctttcctgtactgccccccaccccccatgttcatgttcttcatgacaataagaattctccagaggtaaaacacagggctgaaaatttctgatgtctccttcatcctctgtttcttctcattcatttccattctaagcatatttataaagtttagtggagattatcaagggaaagattcgttctctctctgtctctaataaactaatttctttaaaaacaaacaattgaatatgaaagcattgaatatgcagaggttatgagacccctcatcttttctgtagagtatgttagtttcaggtacattagaaatcagaggtcctggctgtgacttagttcaaacttggaagtttcttatgtcatactgtgttctttattgataaagtgaggggacaaataacccaagcaagtggtaattaaatgattcattaactcagtgacacactaattgaccagaaattttctctaaagtttttgttctaactttaactggctgtatcaagtataggcttatgttggtattatttaggggaaaaaacatttatcact

SEQ ID NO: 59256 - DNA, 1839 bp, Homo sapiens
tcagtaccaacagctaaaacaaaagtcagttttttttcttttaaaaaacattatttctttttaatgaacagttattgaagtattggccttaattggctaggtgtggtggctcatacctgtaatcccagcactttgggaggccgaggcgggcagatcaccggaggtcaggagtttgaggtcagcctggccaacacagtgaaactccgtctctactaaaaataccaaaattagccaggtgtgatggcaggcacctgtagtcccagctactcgagaagctgaagcaggagaatcacttgaacccaggaggcagagtttgcagtgaactgagattgtgccactgcactccagcctgggcgacaaagggagactctgtctcaaaaaaaaaaaaaaaagattagccttaatcaacaagcatttactaataacttaccggtaaagagtagtatattcagatttaaaacattttgaagaaatgcccagaagtggaggacaaaggcattgagcttgctgtccttgtaaaataccgtgtgtgcgtgcgtgcgtgtgtgtgtgtgtgtgtgtgtgtgtatacgtgcatgcatgtgagaggggagagaaggtgggagaaggaggcatacagtagttgcaagttaacataatagagaatttttaaaaccttaggacacatctaaagatgatacaaaatgtatgttaatgcaagataaaatttggtttattagggacagtgaattatgatttgaaataattggggcaaatttaaccaagtagggttaaagcattactttgaaggaaaggagggtattaagcagtacataattttgagctaaattcataggcaaatcaatttctatttagaaactgaagcactttctttataaaagcatgacttcgcctctttatttgctcaagtatatatgaggccatattgcatttagcctatatgagaaggagaagaaagcagagaaggagttatgagggagattggaagagaataaaaagatcacttcactttagatgccaagcaagagcaattattacagcattatttcaggattcaaggacaacaaggcctgtaaagaggccactgataacctcattggtgactttgtggagatcagtagtagtgatggtaaatagcaaattggcaggagttgaagagtgaatggatactgaagaaatggagacagtaatcatagatttttcttctgagttattttttgataaaaggaaagaaaatagattacagcaagccaaagaaagatgatttttggatgggatgttttgagcatattcataggttgaaggaatggagtcaaaatacagagggaaattcagaaagatccaagagagagattcatcatttgacataatcaaatcttagatgacagtaaagatgggacacaagaaagaggggttagttcttgaaaactagaatgtatatgacttcctttgttataagtaaagggggtattctgaatgtttgaagtagagagctgggaagttgaagttattcacgtttaatggtttccctgctttctaggaagtagggatattataaaatgagaaagatggggttgggggagaggggtttgaagagggataaagaagatgtggcatgattcctttagaaaacaatcatgatcaagtcaactagagatgaatgaaataatttcccaggtttgcatgaattatgatagatttatttggtttagtttcgtgatttagtatagcagtactcagaagagttccacataaaatggattatatcatatacctaggatggagactgataagatgtgtataatgaaagaaaaagtggattagaaaaatatagaatga

SEQ ID NO: 59257 - DNA, 1493 bp, Homo sapiens
atttaatggtactaactagtactgttaaactaactagtactgttaatagacctttatgacagcatcctcagagttaactatttatataattgttctctggagcaaagcattcagagttcccagaagctacagtgaatttcacaccacttataaaccaagggactacctgcaaagtgtttctgttattttaaaatctaaagtctatttgaatttgaaaaaataaaatgaaaagttgaaaataccaaatctaagacttgtgtgtaattgaaatgaggttgttttagaaaattaaatttggcaagtgattaatgcttaataaggagtaattgttttatctattttagggaaaaattaatttaacaaacctattattatgtgaaatttaggtaatgaacatgggcagtacataatttccgtaacatttatagcatcgaccacaaaaaggctgaattagtgtcatcaaatacaaagaatgttcatttcagaatcaaagctgttcggaaagcagtgctcatggttactataattaattcaacatttcaggactatttaaaattgttatgtcatatcactttagtagatatacctttcagatgcatatatgcctgattttggataagtgtattttttgtacttttcagtttaaaaatttttttcttagttaaaaatgttctctcatttaatgatttttggttttgtatcaaaagcaaagaaactttcagttatctcttaaataataaaacagaggtcgcccaacctgcactgttttggaccctgtatacagcattaacccagctcaacagctggctgtgattggctagccaatcagagtaccaattctgtagtgtcctccacctttccctgaagctagtagagttttggttgagtggggtataaatgtgaatagcagattagctaattaaaatggtcctagatagttgtaggctccagtgctgaagttcctggaggataatccaacctccctaaactctcttgataccgaagaactcacctggaatagctacagcctacttttctgtccccctccccaccttccctgcaagctctcttcccctgtgggctgggtcctgtttcagctcttccatgcatgtctcaggaactgttcctgtagacaaaggtccattcagcactagaatgctttttccaggctgcatttctaaatctgagtccctgtgtatcttccagatcaaagtgcccctctccccacaacaatggactagatttgccagggcctcatagcagaatatcctgtctgactctctcttcactagactaaggagaaaaaataacaaaacaaaaatgaagaatttattttaaaagatgaatatagcattcccccctcccctaaaaagaaatgagcaactattacttacacaaaatgtagatacaactgtattccttgtaggattacttattaaagctttcttgatacgtaaatctaaatccaagcgtttggcatgaatgtctgcttc

SEQ ID NO: 59258 - DNA, 1744 bp, Homo sapiens
tcagcatttttgaacccgatcattcttcctcgtcatagcaggctgtcctgtgcgctataagatgattagcagcatccctggcttctgcccgtgaggtcagctgtctccagccttcttggcaccgggggctgctttcatggaacacagtttttctgtgaacctgggtggtgtgtgggaggggggacggttttgggatgaaactgttgcacttcagaccatcaggtattagttagattctcaaaggaccatgcaacctagatccctcgcatgcacagttcacaatagggttcgcactcctgtgagaatctgttgccacagctgatctgataggaggtggagctcaggtggtaatgctcgctcacctgctgctcacctcttgctgcgtggcctggttcctaacagccaccatccgcggcccaggggtggggaccctgcacttggtaacagcacctcctatctctccatccctcagcacattggcagtaaccaagaatgtctctatgtgttgccaaatgtccagtgagggtggggagcacatcactactcctggttttgagtaccactgctcacagtaaaatcaaatgcagatacaggcattctacagctaatcattcagtgtaattatcaactgtggtaaatgctaattatggaaagtacagagggccatgagactgtaaccaagaaaataatgactccataataaatttggagttcagtcaaacaaatcaaagtttcccttgagtgtatagtaggtatttgatgtcagaaaagaaacttaagacatggtcttttactttaaggataagctggctgtgtatcttccaaaccagtaccctgttgagagtgaaagcgtgctctataataaggaaactgggaaaataaatagagatgaggcaaattgtacataatctacttccaggctttcattatctacccagagaataagaccagtatatgaaacacacagagaataattcaagacagtatatacattaagcgctaacctatgtcacattattagaagagagggttcattgttacttctccatctttgctttatagaaggcttcatgggaaaagatgggattctagcccttcaatttagttctggaggtttgccataaaatatctcaatgttcctattcagttattttacactctactacctaagcccctaacctgttcaagagttgtgtttgacatagcagacaatagagaacaactggagagtcttgatgaggaatatattatgatgaaatggttacaactcctagaagaaacattcatttctctaccaaccttgatcagcattgaggtacaaaagaacagtattatacaactatcagatgtacatactgaaaggacatttctttcttaaaccaaattctagaagttttttattgaaaacagatttcctagggtcatttgtgtgtatatatatctaaggggacattgttggcttgtttctctttcaatttttaggtcaattttgaagatactagattttgagaaactatgtttaggggaaaggggaagaaactgtaggaaagtgaaaaatcgtacgcttttaggttagtgctaatctgcttacgtaggaactttctgcatccaaataccttgctttatattccctagctttctttttaaaatgttgcttttactttaattttttacactgcttaagaccccatagattatacatttatttaagttcatagtcatggaacttaattacttttaaaaa

SEQ ID NO: 59259 - DNA, 1963 bp, Homo sapiens
tgctggttattattcatgttagttatgttacataaaggggccacagatactgacccattgctctaggtgaaatacagggctgggttcttgcaagtctctggtcacgtcttcatcagctgatcaattacataacctggttttatgtgtgtttctgtttgaggacatcttatttaatattatttattaattaacattgaactcatggccatgaacactataactcatgcctgaatgaagcttatttaaacaaacatttattctccataaggcatatcatagccttcttttgctgagaaacactaggtgagacttcaacactatacatgagggccattaaactgaaatcaccaacaggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgaagccttgggttgggcatggtggctcccatggtaatcccagcactttgggaggctgaagctggaggatcacttgagactaggagttcaagactagcctgggcaacatagcaatatcctgtctccatgacaaaaaaaaaaaaaaaaaaaaaagccagatatagaggtacatgcctgtagtcccagctatttgagaggctgagataggaggatgcttgagcccaggaggttgaggctgcagtgggcaaaggccacaccaccgtactcctgtctgggcgacagagtgagaccctgtctctaaaaagacaaaatgaagccttgagtaaagttatcttcatttaatatctgctggatgccttggatagcaatctaggagtagcctaacccaagtttaaagcctaaagtttcctggtccactcaggtgacatgaatctagggtgcagatctgtgcaagatttagtttattttttggttccccattgacattaacgatcagccatttgtgatttcagcttaatgtggcaattgacttatcagagtcctaattttgtcttacattttaaattgttctcagtggagtattcatctgaattattcaatctgatatttacagaagcagaaccttccttttatccttcttaattttaatttctcctgccttgtgattttcgtattaccatctcctctttttccttcttctttcctaggtttgtgaagcatttactacagttgttataagattaaataactgttctcatttaagtacatttcttaaacttacactaagatgtgaccttcagattgctttaataatgtaagaaataagttcattttaaaaagaaatctggatgttggaacaagaccttgaatttttattttttttttctttttaattcataatattattcattacccatcatgttattttgggaaggtatagcataaaatatgatttagtaatttagctttcacctaagtttttattgtactttatgatataggactggctgtcatgaaaaagttaaatttgatggacattctctcatcaaatttgtccttgtattattttattttatttttaatttaatttaatttaatttaattttattttttggtgagacagggttttactctgttgctcaggctggagtgcagtgcagtggtccgatcatagctcactgcagcctcgacctcctgggctcaagctctcctcccacctcagtttcctgagtatctgggactactggtgcacaccaccacgcccagctaatttttgtagttttttatagagacgaggttttggcattttgc

SEQ ID NO: 59260 - DNA, 1060 bp, Homo sapiens
ctttgctcactgcaacctctgcctcctcggttcaagtgattctcctgcctcagcctcctgagtaggtgggattacaggcgcatgcctctacacccagctcatttttgtatttttagtagagatggagtttcaccatgttggtcaggttagtatcgaactcctgacctgtgatctgcccacctctgcctcccaaagtgctgggattacaggcgtgagccaccacgcccggcctatatctcagttttttaaaagttgtggcacctaactaaaatgaactgtttttgatagggatagagaagggttctgtaggagtatacagaatgacattttgacctactgtgtgaagttgacagcaaactcctgaaataagtaatatttcaacagagacctgaaaaatgaattggagttactcatgtgaaaaaactgttagcaatggaaatgaggaaacatgtaagaatatatcagttaaaattaacagctgaaagccaattttagctgtaacaggtataagctcctacttgtgtcactatgtaagattttgtcaaagactttttgccttaagtaatgtaattatccatggagaaccatagcaatataatatttgttataaaatatatatattatatatatgtatgtatatctcctagcttctggggaaaacagggcatttattttttattttttgattctaaatatttttaaattatagtttatggcattttataattttaaatattcttgaagccagaactaaattctagagtttgtttatgctttatttttttccccctctctatatattttataaggcaattttctaagctttgatcctatggaaattttaccgttttcattacttttgacagtttgagattagtttcagaaccctgtaagcaaatagtaaatataattagggaaaattaaaatatttctgtttcctggtaggcaataagacattaagaaaaaaattcagacttataccaaagtagaggcaagtataatcagcacccatgtaatcatcaccagcttcaaaaattttcaactcatgaccaatcttatt

SEQ ID NO: 59261 - DNA, 1041 bp, Homo sapiens
tagtctgttcaagctgccataacaaaatttcatagtctaggtgttttctcacagttctggaggctggatgtttgagataaggtgccagcatgatggggttctggtgagggctctctttctggcttcttgctgtgcctcacataatggagagtgagcaagctcttttgggtctcttctgataagggcactactcttatgagggtgagggccccaccctcctgaacttcatctaactctaatcttttcccaaaggcctcatttcaaatatcacactagggggttagcgtttcaacatacggattttgttacagtctttagtggagacaagcaggattaattaatttatggaaagcatgcagcagtgtgcctctaacataaaaaatgtcttatttaacctgtcatcatcatcatcattttgacttggcctaaaatttcgcatatgggctagtggagaaaaattagaactaatttggtgattttgctcttcattgatggaaagtatgtgataacattcattaagaagggcaatgtaggaagaaagagacagttgtaggcatgctgtggagagatgcttccttcactgtatcagtagagaagaagatggttgtcaacctcaggtttatggatgaatcctcagtatgctgtaaatagaagaaaagagatgctttagtgttctttatatctatgtggcctttaaaatgcagtcctttaatttgtttttattcaaatctttattttttattttcttttctctgatttaattgatagatcgggtttttcagtgagcctgggaaagcagaagtaccatttttatgtctataaataatactaaatttattttgctggattttgtaaagttctgtattaaacattatggatcttaaatatattttggtattttaaaattagagtataatcagtttctgttctctagcctttggatttagactttttcttctctaagttaatgagtccaggactgattttgttagcctttctggagctgttaagaattcctattctttcgtttttggtagtcat

SEQ ID NO: 59262 - DNA, 1682 bp, Homo sapiens
tgaggctggattttcttcatatatgccaagacaacatacagcatcagagtagggaaaagcccaaatgtccattaataggaaattggctaagtaaatcatggtacagcaatacaatggaatattacatagtcgaaaaagaatggtaggatgaggtccattcagtgacaagaaaaaaaaaagaatcggaagaatagtatttatatggaaaatcatggaaaaacctcaatttatgtaaaggagaggagataagatgttatagttgtatttgcttatattgtcataaactctggaatgaaaaacaactaatattttatccagaaagcagggttaaacaggcagatggatgggtgtgatgagactttttactgtatacctttttaacgtttgatttttgacatacacatgtacaatctgtttaattcagttttaaaaaatgatttccagtataacttaaacctagttttgacacagcacacacttatactttgtacctctaaaccattggcctacagcacagtattcttaacacagtatggaaagccttttgtctgtctctataggatgatactctgcaacttccagcttcatcctttacattctagtgacactgaatttctggtagtagttctccacatgtggtactgttttatatttgtgtatgctttacctgtatcttcttcatatcttttaagaatcagtttgtgtcatcttctctgggaagctggcctcaacctttgcaaggcttagttgagtgattcagtcataatactctgtataattgtctattattgctcttatattgcattgtaatcattagcttttttattgtacttagacacagataaccaaagatttgctttagtgtatttttttcactgtattcccagtagaaaagcattaatgtatgttatttgatgtctttttctgcagggtagttgccctgcctcaaacagcttatagtctttaatggagacatgcaggaatgcaactaacataagagagagtgtactaagtgaggtaataggcaaggtcatacttttaaaggaagccagtctttgaaatgaatcttaaagatggtcccagagtccagatggaaacattctaacagggcctatttaggagccccagataatgtaggggtagcttcagtataaaggatacatgcctcaaggtgagtcagggagaaaaggaaaaacagggacagattgtgagaggtctaacattccagtctaaggaatttgaatttgaatattatcttgtgggtgaagtaggattctttaatgcttttgaacgaggaatcagtatctgtactttcaggatgattttatgctttgtgtaatgtcttccaaaaaagatgagagatggggcacctgttaatatattttatattataaagtacagtgttgaatatgggatcaaaaaaggaacagccagccacatttccaaatcccatgtttttgaccagatagtcccttcaacctagaattatgtctcattcaagcagtgtgattctattcatctcaagttgtcataagaaagacaacttatatgttacttccactagtgatccctgataaattccttccaaatgttattaataactgtatcctgttttgactgcattgtatttatttctgttacaatttttctcataccctacctgttttacagtgcaggggtcc

SEQ ID NO: 59263 - DNA, 1010 bp, Homo sapiens
ttggggctgcacagctaggaacaacaataccaccattcctaaaatagctgtagaacaacacttaaataactgactatcctgcttttaaagactgctattctttttttacaaacttgtaggttgagaaatttttacttctattttcaattagaagtctttgggaaaattatgggatgactggatttgtgtatatctataatccagagataaggaaaaagaggaaacacagattttcaggagatggaagcataactttgttctgctttgtgcttgaatacctctttttgatcagggttagaggataaccttaggtcagtgcatttcccttgtgtttttgttaacaaaacatagttcagatcccttgattaaaaccctccactggtttcttgtctcatgaagaagaaaaaatcctaactgttcttgatgatctttaaggctcagaatgatctggacagaggtatttaccttgaagctcataaagcataggcctttctcacttgcagagtatctttctgaagctggactaaattggttaaggccactgtacttttccactttgtcttctttcctgtcacacaccctatcctttcaggctgtgttgggatggacaaaagcagttctggagtcctaaggagaagatgagtgggatatgtttctgtgacctgcagtcattttaaagtttagctgttgctagctgactccatgtaagaataccttccaggaatttgatggctgtgcactctggcagtgcagctggcatggttatagggtgcttggccgaaggtttgcatagcaatatgaacgcatcctacgacacatctagccaacactggaagactgtgggtaatggacgagaaaccaagattgactttttgcaagtttttaaaaataatcttcttgtaactcacatgtgaaagaaacatgagaggttttcacaaattcagtaatttgagacatttacatagcatcaccaatagttgtgaagctgaaactttagttctaaactataa

SEQ ID NO: 59264 - DNA, 1071 bp, Homo sapiens
ttactcactttattgtggtggtctggaacagaacgtgcaatgtctcgaggtatgcctgtatacaggataatgtgtgtaggttatatgcaaatactataccatttgatataagagacttgaatatctgtggattttagtatccttagtgggtcccggaatcagtcccccccacgaatacccagggatagctgcactcacacataatgaatttatagtggaaattctatgaaatgtatatagagttgttataatatacctaggatgatcattggtatttcggaatagcttttagaatatgaccaagatacatgacatctactattatataaacctgtgtttgtttcagcatgtttttttcctatgttttgttccatgttagatgtcatgagtttgcaaagtataataagctatattccctgccttcaagtagcttaccatccatgtaccatttcccaaagtgtacatcattagcaggtaggtattcctcaaaaatagattattgtctctgattaagtttcagagatacctggattaatcaaaattgaaagtttttttttagaatagggttctcaaatgcatacattagggaattccagaaagcgactgtatgttgcaaggttttccaagctttgtcgacacactattttttttctcatgaaacttctgtggtgggatctgaggggaatggaggtggggaagagagtggcagtggtgtttttaggaagaagattaatgtaggagaggagtgggaggaacacctaggacagtagctgtgtacctggcctaggttcctcagtccagatggtagcaagtctgaagacagggagagacttcttccagaagatgaaattcatagaaacctgaggcaaattggtatactcaaaggagctttgtcagactggagagtctggggtgaattgggataaatatatagtagataagtatgtagaaaactaaagaaatgagaaacaaattattaattgcaagggaaacaaaatgttatgcaggaaaagaaaagtaattattgtttactgcttggttcagctctgaataccctatgtagttataatg

SEQ ID NO: 59265 - DNA, 1025 bp, Homo sapiens
caacaaaaactttctaatttttactagttttgttttttaaaaagtttgtttccttttaagtgcataacactttaaaatgagctcagctgtattagcagataaacatgttgattcatttggtccagagctactgaatgaagcttgcaggagcacagtttgttctttatgccgcccaggggcagaatgtttctcttcctctcctccttattgagagaaggggactggaataagtgactcctcttatttaggtttgcctgaattgttgacgagggaagggggcaagatttcttcaccatttatccttcgtctcatttaaattctgttcattaacataaagtatatgcactcatactgtgatatacatgttgaattattagtgtcatatatttacagtttttacaaaaccattttacttaatgctctggtttgagtaatctgttgtttaaaggtataatgaatcagagttgtttttaggcgtattgcgtttttgaggatggacttaattttggaagcaaagagaagtatgttctatccagtggagtggagttgagataataggtatgcagttcgcctctcatacccattgtgggttctgcatctgtggttctatcaactgtgtgtcaaaaatacttgagaaaaaaaaaaaagaatggttacgttcatactgaacatgcatagactttttccccttattttcccctaaacaatacagtgtgactatttatatagtatctacattgtattaggtgttttaaataatctagagatgatttaaagtacaggcctagcttgttttattgcactttgctaatactgcatttcttacaaattgaagatttgtggcaaccttgagtcgagccagtctatcagtgccatttttccaagagcatgtgcttatgttgtgcctctgtgtcacattttgggtaattcttgcagtatttcaactttttcgttattattataccggttatggtgacctatgatcagtgatctttgatgttactgttgtaattgttttggggcac

SEQ ID NO: 59266 - DNA, 1016 bp, Homo sapiens
catgtgggattataggtgtgagctactgtgcccagctgttgttttcagttttactcttctgtggtatgtggtaagagggagcatttgttttctagagcctgcagcatgtgtgggtcagttgaaaatgtataaaaattttgagttacgcacggtggcttgtgcctgtaatcccaatactttgggaggctgaggagggaggactgcttgtgccaggagtttaagactagcctgggcaacatagtgagaccctgtccctaaaaatatgtaaaaaaaattttaaaataaaaattttgaaatgcaatttgtgtcttaaaattctgccttatttatttgcaacgtgtgtttcttgtcatgtatttgctgctgtatgctggtagaaaaagcatagagagtggactcaggcagtccatgctctagcctcctgttctactctgaactagatgtgtgacattgtaagtgctgctgcttcacttcgggtgttactcctgatttgcacagtgaaaagtgttttattacaagatgatttctagaagtttgtttctgttctgacattagatgacctgtgatatgtgaagcttaagacatcttttttcattactgggtttatacggggtgttgaggcttgtgatacatttactgttataaattcattttaatgtgtttggaggacttgagatgattggagattattagattgatagctgatgtttggctttattattggaaaatagttctagctacgaaacctgtttttgagtgaaagtatgctaggaatggccattgcttttcttcctacagagataagtgatctcttggtgttgtacacatgaagctctcacctttatttttaaagtcatggattttaccttggctcctataaactcttctcccctcccccatgtagctgtaagcattcctactcctaggatgatttggaatgtgtgtgtttcaaatcatgtttagtgattgtaaggctaatctcagcttaattatcactgccaaaggaatcctctgac

SEQ ID NO: 59267 - DNA, 1702 bp, Homo sapiens
cctatgtgcccttgtggatgggtgagtcccttcactaccaactccctggcctcaggagaacaaggtttattctttgcaaaattaatgaagagctgtctggactttgaaaccaggggccgtggattgttgcttggtttaaaacaaggagatcggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaccaaaaaaaaaaaacaaaaaaaaaaaacaaggagatcaagggaaacctacgcctgaactatagaagtgttagctctcttcctctgctctccttccagaactgcacagtcaagcctgtcctatccttctcctgtggaagactgaagataacagcatcttcagatactgataggctttctgctgagagtaccttaagtgaattctaccagtcgttaagccctgttttcccacacagatctttcagttagttcttttcaggggcttattcttaaatatgagcaaacaatctaacaccattggtcatctgggggaagactccaacattaaaaaaaaaaaaaagtagacatagagaggtggagagggagtgatacttggaacactgggagaaaacagataccataagggatcaaaagaaaactttaaaaatctccagtattatcagagaagacatgtatttccttccccacttaaatgatagtgaacacatataaaagcagaaatccatgagggtaaagagaacgagatgagagatgacagcaggcaaacaacgtcaactaaatattggaagctgagaacctggtgcgtgagtggtaacagaatttagcagagctgagaaagcagaaagtcctatggtgtgggtagttgtgcaaaaactggtattcttttaattaatgatgtgctttgctctatttggactgctgggttcttatttttgagcagtatgctctctcccagttgaagctgttaatgggctgtccaccaatggagaaatcagaatgattaaaatgtagttcttgtatttttatggttctcttaagcagtcatgcattatactcttcttcttgtgtctgagccaacatttcataggagtagataacacccatttctggtggcactgacagcagggttgaaaagaatgttataaaagaaaatatgaataacatttaacttaagaatatgttccaaattttgtttgtaaagtagttgtttaaaacttggtagttctttttgatataatgttataaatggcagttatcctagaccaaactttaaaatatgtttcattagcaattaaatgggcatttgtaagttcccagggaaacctaatcacattgtatagtattttttaatgaagaaacactagctgggtacagtggcttatgcctgtaatcccagcactttgggaggccaaggtagatgaatagcttgagtccagaagtttgagaccagcctgggcaacatggtgaaacctcatctc

SEQ ID NO: 59268 - DNA, 1052 bp, Homo sapiens
tctgggttgagacctagaagacagttaattcatttagccaccaaatgtgtattgagtgtcttcctattatatatttattaccatattgtgtaggtagtgttagaagacatcccaggtgcctactctgtaactggcggagagataataaacaaacaggataattttatatagtgctaagttctgtgaagaaagtataccatgatatgtgccagataattacctggcaggggaaaggagagagagagctttgcatagagtgatcttgggaggtgtcttttgaagagataactcttattttttatcttgcttttttttttaaaaaagtattttttaggttgtagtaaaatatatataacataaaatttaccattttaaccatttgtaagtgcacgtttcagcgacatcaagtacatgcacattgttttgcaaccattcaccaccatctgcctccagaacttttttcatgttgtgaaactgaaactctgcagccattaaacagtaattttttattttctctctcctctcagcccctaacaacaaccattctttctgccttcttaaatttgactgctttagtgcctcatgtaagtggatcgtacagtatttgtgtgactggcttatttcacttagcgtagtgttttccaggttcatccatgctgtggcacatgtccgcatctccttccttcttaaggctaaataacactccataatatggatgtaccacattttgtctgtccacctttgaactgagatctgaaaaatgagaaggggccatgcaagaactagaagaagaacgttacaagcagaggaaagaacatgtgcaaaggccctgagatagcaataaactggttggtggtctaggccagtgttgtcagaatatattaatagtagagaaaagtgcctggaaagaatggtattaaatgggatcagagatagacatacattggccgtattattttaggctttgaaagaccttggcttttaagtggagtgagaagctgcttattaggaagttttaagtgggggagtgacttaatctgatttccatgtaa

SEQ ID NO: 59269 - DNA, 1737 bp, Homo sapiens
gagtactacaagttatgaggtgtatgaaactaatagtttaaaccgagtttgaatcacttatctagaaagatagctttttcttaagctcatatgtagaatttcaacctagaagtgactttaaaagttatctagtcttttttttttttttttttttttttttttttttttttttttttttagttttagggatgagtctttttatgttgctcaggctgatctccaactcctggccttcaggagtcctcatgcctcggcctcccaaaatgttgggattacaggcaggagccactgttggtggcctctctagtcttatatccattcatctgacagatttcaaaactgaggccatatttcaagttaggtatagagccaggattagtacctgagatttcttttttgctgatcttagatacttcagattttgtttctttcttgacgtttaggaatagattgaatttcttcaaaaaatattttgtatcttgttgggggggaggggctcagaagttttgggtggaaagatttaaaatcctctgagtatggaaaagggggagtatcttccaccttgtggaatcctcacactgtgtgagtaatattattcactgctctacttcccagtggagaatgcagagaagctgtacctcttgaacttgtgttttctctctttgagtaactgtttccatagtttctataccctttgacatagagaaactttctttagtttgtgttcgcattttataatcaatcacattaccttttgatgtgtgatagccctgcacctaccactaattttctgtgtttttggttatgctagtttttcggcttggcatgttttttcccctctgtctttttaagtgaaaaatctcctgtgtccttcaaagccaaattatttacccagatcatggtcttacaaaattagaatgatttcttttgtctgtataatattgcaacaatttcctgtcttgacctccttatgactttctattgccttgttattacatagatctgttatttctcctttccattgtaacctccttgacagcactgtgtctaatacaactttatattttgtacagtttgtaattttccttctgaaatacagttcaccattattttgagcacggtagtctcttaatcagtatgtgatacaaaaatggggaagaaaataatgattctagaagttcagataacagtatgtcacagatattagggcaaggaactagaactgggacagctgaggcaaggtaggaaacacagactagatcacagttatgaaagcagcctaatgttcaggagagagtttcggtaagggcagcactggaattctagaaccatgttgtatatctgtcaaatttttgtgtagcaaaacagaactgacagggtaggaattggtagatttgactgaatggttattcctgacaaagatagtgggttgtaccctgattgtcccagaatggactagtaaataaggtatctaaattaggtaagtagaataaaagattgggaatattgtagtttttatggtttggaagattaatgcgtattttaagggtaatttttgctttactcttagaacggtaaagtacctctgatttcatgaaacctaactttctaagcctataagaagaatcttttctactgtgtttctaatggatcacttatcttagatattgtgggcaactaaagttgcactgtatctgtttcattatttaacagctctgagcactggtggtctttgtt

SEQ ID NO: 59270 - DNA, 1028 bp, Homo sapiens
ctcaaagacgagcctgtaggtatgttctaggtgactctaaatctctaaattggatttcagcacttctcttaattttttcccttatagctagtggtaatatttgctatgaaggtacttagtgtattaataaagtaggaaatttagccagtttaaaaggtctaaattatagaattaaataaattgcaatagtattaattaagggcttattataatttattaactttcatttgcttaataaaatttcataaaaacctaagtagtcttttataaatgtggaaagctagttccttgataataagttaaaatataatgtataactagtcaattcataatgttactgttttgagattgtcataaatctaagaggtgatttttatcattaaaagcattttgatgaaaatgttccatgctcgtgttactttattctactttttgtattagtatctaacaaactgaactttcatgttgtattctctatgtgtaaccagttttggctttcaaataactttttcccttagttttctttgtactgactttgtcctttgaataatatttttcttatattccatgaaatggtttatttagatgaactacagtgtcggtatttggtaatgccaggataaagattttgtgtctatgagttgtctcacaagatagcttaattctgctgagcaaaatatactttagcaacataaagattgtgaacttggttatgctgtaagatgtgattcttgttatctagtcaaatttaacaagttgttacagaaaacaatttacatttttgagtgtttatctaagtccaggggtcttttcttctcctttattttgtgcatgcatgtgtttttttttgttcattttttattcacaaaatgactttagaaataagttataaaatgattaggagaaagaaaatgacagtatgatttcctgtttactacccagcagcaagctttttccatagagagtaaagagctgtggtagtgactgtgtaaaccacatggtacattagagaagctcactttgactgt

SEQ ID NO: 59271 - DNA, 1012 bp, Homo sapiens
gttggacatttgggctgcttctagcttttggttagtacgaataaagagtctggacattagagtgcatgtctttgtgtaatgtgttttcatttgtcttgggtaataacttaggaatgatattgctgggtcatatggtaagtgtgtgtttaactttataagaagtatatgtttaacaaactgcccagctgttttccgatgtgcctgaccatttgtattgtcaagtgtaatttctttcaatgtcattctcctgttataaattacgaaagcattttcagatttcagtgctttataaaggcttttttgatttactttttaaacgtatttatattattctactttttttggagggggatggcaaatcacttgaacctttttgagttttactttactaatctctaaaatctgctttcacaagatggttttgagggttaaatgagatgatggttgtggatttattttgacagttctaacacaatgtaagctgttgctatctccacatatttatcaaaggtttaggatgattctttagtctgtttaattaattatatctttgaaataccataatagaaagtatttagtccatggactatagaaaaaaaaatgaataagaatttgccatcatttttctaataatgtgtatgtgtttattttgagatgtgtatgtgtatgtgtttctaataatgtgtatgtgcttattttgagatgaatagttgcataaacataaaaatttgaataacacacaaaggtataaaatgaaaaataaaaatctccctatcttttctacctcctttgtcagagataatcattttagaactttttttcctatttttaattgtctcatcattatgccagttttttatataatatactaaactttaaccttcagtaacctaatatctccccattgtgaaaaatagaaggatttaacttttaatactgatcctaccttcttccttttattttttggttgcctttatgattaaacttatagctgtttaacagttaactttag

SEQ ID NO: 59272 - DNA, 1019 bp, Homo sapiens
gcagagtaagaatacgtaaatgatgagttcttggtacgttgtattttatatcacttaaagtattcacgactggttgtggtggctcacttctgtaatcccagcactttgggaggctgaggcgggtggatcatgaggtcaggagtttgagaccagcctggccaatatggtgaaaccccgtttctactaaaaatacaaaaattagcagggcgtggtggcgcacacctgtagtcccagctgcttgggaggctgaggcagaagaatcgcttgaacctgggaggtggaggttgcagtgagcagagatcgcgccactgtactccagcctggcgacagagtgagattccgtttcaaaaaaaaaaaaaacaaaaaatttacaattgcttctgaaattacagggatttagggcaattaactttcattctcttccctcttcacctcaaatacacatcaccaaacaaattttctctattatttgggtaggcgtgactggttttcttaagacttttttgttgcaacctcttaggttaaaagtttcactatcatttgaaattggtcacaagactagggaagtgctttcattatagaactatttaataaataagttccccagtttgaagagccagacttttatgtgaggtcaggccagttgaagacatttacaaagaattagttgtttgttattgctctgtgagttgcaagaatggaaaaaaaattctttcttcaatacttccttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggtaagtgctccgcaaaccaaaaataatacggttggtaagagtgctagcagtgagtggtgtcttagaagttgatcttttttctgatactgttaaactgtgtcatgctatgtctagtaagagagaaatg

SEQ ID NO: 59273 - DNA, 1053 bp, Homo sapiens
ttataattagggagattcccaagacagattttaggaggattttacatgtatattggaatctatattagaaagcttctgactgtatttgggggactaggggatgggaggggaaggaggacagtatttttccaataatggagcttagcccaaattttgtcttagttgaaatgctgtttgaatgttttatcttccaattatcaaacttttgaggacatgaactatgtatgtataatcatgtctttcacttatgatgccatctatatatgaagtagatactccgtagattttaacttgcagaatcataaatattagctctggaagagctataaagctattcagagttcatctaatgctatactttcatttttatggctccggaaactgaggcacagataattaaagtgaccttatacagcatcactctgggtggggcagggactcaagtttcttggtctttctggtgctcttcctaatacaccattgtgatgaaccttgttagaggattccatacctattgggtagctcagtttaatctgggggtaaattctgtcaagctgattcttggtatttaatggaccatatatcaattgcattttatatgtatgtatggatttttaaaaatttatgatgaggctcccaagacagattttaaaatgattttacatgcatattacaaaaatatggccaactgtgcaaccaaattctttttcttttcttttctttttttttttttttgagacaggttctcactgtagcacccaggcacggtcaccactcagcatagcctagacttcctgggctcaggtgatcctcccacctcagcctcctgagtagctgggactacaggtgcctgccaccactcccagctaatttttgtattttttgtggagatgggttttgccatgttgcccaggctggccttgaactcctggacataagtgatcctcctgccctggcctcccaaagtgctgggattacaaactaatatccctttttgacactctacagcaacagactcatggtgattttgaggagtctcagccttacctatag

SEQ ID NO: 59274 - DNA, 1107 bp, Homo sapiens
aaattaatttcatagctgtaaaatattttaaataagattatatttaacaaatactggagtgtgaactgtgtgctggtttaattaaaaacttttaatatttacatttcattcagaaaatcactgtcagaaggaatctgttttcagaatcactgcaaatctaaataaacgtgttgattaaacttactagggaacaaatggacttagcatagagacttgtggaaagtaaggacttattttttaagctgtagcttttgatgtaaacatcagaaattttctcataaaaattcagtggaaatttccagctatctgggtttctttaaaatgaggaacctgttttacaaattgattttgtagaagtttagcctttacttaaactttgtgtattttcgtgaaaagatagctatgttttcttttgttattatatcttttagttcaagaatttgtccttgggaaggtaaggcaatcactgttaacaacttgttagttggatgcttagcatgatttgataggagcttgtctttatagtgtgattaagttttgaagtgttaaaaagaaaaatttaaaactatcttagatttgagcaacaaaatgcaagaactgaaaaaccattttcattttgagcaaatcagtcttgtgatctgactggcatttttatttttaagttaatatgcattaataatacaattaatttttgttagaagatttgtgttactccaggtttcagcatgtgcatcagtattttaaatcctggtcacacagcataccttcttttggaaagatagtcctgaatcttccgacaacaaatactttgtcctgatcttttacatgggataggattagattcagtttagagttaatgctaaccaatgcctggtaagcagttgccatgtgccaggcactgttctatgtgctttacctgtattcatttaatctttcaaacaacccctgctacacttttgaaagtgattttcacataagaaaaacttattgtggcattctaaaaataccttttatttaaactttcctaattctgcaacacttctagtgtttttcttgtttgtacctattattacagttaacagtgataattctaaatttgcaaaattt

SEQ ID NO: 59275 - DNA, 1771 bp, Homo sapiens
ggatgcccagcgcggttgacaccgacaccccccgctttccggggaaagctggggggcggcggtgcgcagcgggccgggggaggggtgttcccggcctagcggtaccgtctgtgtctgggctgccccggcccggcgcctgctgtctgcgcaactctcgctccttcccctcgcccctccccgcccgggccgcgcggcgtggggagggggcgcccgcctggaccgggggcggcggcgaggttatataacgcgtggagcgccggtgtcagtgtgtttgggttggggggagggagccgtctgccgcgcgccctggcgctgaggctgtctgcgcgtggggtggggtgaaggcgaggatgcacaggcgtccccggggtctccttccttcccccacccttccccgccactggcgcgcaggaaaagacggcactggtggggtgggggggggggtgtgtgtgtgggaggtgggtaacgtgcttgtctgtgtttttaatagtagtggggttttgatccgcttgggagttgtgtgctaagaatagaaatgtgcggaagatgctgggtttggctgatccagtgatgctgtcgctgctggcggcggcggcagctctggctgcaagtaaacagaccagcctcttccttgtccacctcctccggcgcatcggtccgcatcagccatgatgccggtggggcccttcagagcccaaagttgaagcctagctggttgctgtgttgaccctgacgccgaggcggggtcaccatcccttgtttgggatttcccgggaatctacagttagcctagagataaagaatctcgttggggccaggtttttccaataccggtatttactgtttatgttctgaaagcagaggaaatgcttacccacaagtcaaagctgggatgctcacatttcttccatcaaaataatgttgttatgaaaataaaaccaactcatttcaccaatgtggcattttggttgaaagcctggtagtttgcaattgatgaagtttccaaatagaaagtcaacagtgaaacctatgcatctatattgggtaatttctagccataataaagtgttcacactttgattttagttgaggctaaagtaaaaaataatggctttttgtagttaatacattggcagttgtctcaacagtttagacatgtgttccgtatttggtaaagcatggtcatatatgtcttttagtagaactatacatcactaggcaaccactgggttttgtcagtggttgaagctgacaaatgagtgaaactcattggtttaggttatgtatttacttaggaaaacgaaggtggaagagtctaataaagatggtgtaggaaatgaagattagtcttcagaacttgagtatcacttgcaaaatatgtataaacgaatacaaacattccgggggtggttgtctaaaacatgaaaatattttataattaaaatagcaacttattactaagttactagttttccaaggtttatgacttaatgcacaattatatgcaagatatatatccggactgtaattgttttccttttgccagtacattatcttgacttggaaagtttaccaaggagatagtacttgaaagtttacagggagatggtacttgaagatctttttgttttccttactagggttgaccccaatatctttgattggcttgaggttccagttttaaagtgagggaggacaaatattacatgaatgagactgttgaaatttagatgaatgtagggttttagttttcagttgtgtatttgcattg

SEQ ID NO: 59276 - DNA, 1032 bp, Homo sapiens
gtttagtgtttgggtgtctctttaggataagaaatagcaagtcaagagtgacaaggaatgcaaaaagaaacatcacacggacagaagataaagaaaaatacagtcgttccaacatttagaaaatatctctgaactctagtcctgtatgcaggtaattcctgcctgagaaggagtggatcacaaatctacccagacccccagccattggatttaaatcattgttcctttattctccaaatgtttggctttgttcgaaagattcataaaaaaaaccaagcgtattggctctgttacacagaaaaactgcatcagctttttgctaaaatcagttttatcatgaagttaattacattttattaccaaaagataagtatgctaaatgaatccatatatcacaacatctcttataggtttgtagaagtgatggtagggatggcactatttttattatgtctatttttaaattaccttaatttgacctcattttaccccaaattactccttgagatgattttgcaggctgagctgagtcccaagttaaggatggcactgaaatttttctgtagcaagaagttaggtatgatttggtttgttttgagaataaacaagattaagaaaaatttacattttagaccagtcgagtactttaggtgtcatcttttacagatttcacatttaatataattctactcctgacattaaattttattactctacaaactagccagaagtaataaggttctaagagctataaaacacgtatttggcttttctcagctgtttgaggcaatggtagaatttctgaggtacccttaagtgttaatgaaatgaattcgtaaatcatttgttgcttgtcagtcatattgcttatcaataatgctattatcaatttcctctaaagcatgtagatttcatacaaaaatggaagctacgtaactacaatttttcaccttttataataacattgtggggtgcaggaagtggaggcacagaggggccttcaacttctccaacctactgtaacattctctg

SEQ ID NO: 59277 - DNA, 1050 bp, Homo sapiens
tgagcagaaagatcagatatgcaggtgcagcattcattttaagtgactggagcaggttgtatcagtttattaattggtctcgttgaactgaagtactttccaggatttcagaaagtgcagtttcagcttgttggtaccgagaattgaaatttgcattgactgtggcagtgtaagaaatttttctgagaaggtagttgtagataagtaattacataagagtgaaataataaggtgaaccagtctgaagtaatagttctgaacaagtctgccaacatttgagacatgtataccattatctcagcagaaaaaaataaaaaagtgcggtaataatgttgaaatgggactggagatgtcaaatgggttggtttaaaaatatccctaaactgctttagaaactaaacgttggagttgaataaaagtgaatctggatttcctgaatagcaccgtggcttgagtgtgctgtcagtatgtaagccagtccaccaacttaagacagaagtgttgctattccataaatacagtagaactccatatgctgagtttttcaatttcttctgttagaaagtttggaaaaaaaggaagactttgaagtattttgtttatactaacagaagagaaaagttctcctaagaaaaagctggtggcaggagtgtagaggagtagcatatggcattaaaaggagcacagctggaggtagcatttccatctgaacatgatgtcagagcagctgacagcctgccatccctcagccttttattctaacacacagacagggagttagtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggtaggagtagcaagagattagattgagcatatttctgttttggtgttttgtttatttaattttaaaaatcacattacttttctaacccagtttaggaataatatatgaa

SEQ ID NO: 59278 - DNA, 1982 bp, Homo sapiens
cagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaatttcttgtgtgtattttttattgtgattatgtagtgtatagattctaaatatgtatcatacctggcatc

SEQ ID NO: 59279 - DNA, 1048 bp, Homo sapiens
tgcctgctaattcaattgcctagaattccagtcattagccaagcagtcttccaaattaaaacatccggtctccttcaattttccacttaaaccagaacacaggagaatagatttgaccgatcaacttaggataaaattacacacgaaaagtgacttacggtatatggattagtagttgtacagtgtatttttaacaacctatgctgccacgtagtttcatgattcatgagtttctagggaattacctcaacattcttgatgtagattgtgaaaatgggtcgcattttttaaatgtgcatttagtatcttcttaagtgactagaatgcttacacattttccactcgagtgatttaaggcattctaataatttcataaactccgaatagaattgatattaaagatgccaggtatgatacatatttagaatctatacactacataatcacaataaaaaatacacacaagaaattctcagttcatataatttattgcagttagcacacagtttaaaaattcaccaacacaccaatagtacaaaactaaacagcattataagttattccccctcaggaaaataaaacatactatgattgtcaaagctagatgtcagtctaagttttagaacaaaggaagaatgtgaaactaagaaaaggaaaaagcaatcactcacaatgaccacaaaaagaaaatccaaaagaaagtccgttttctcacagacattgattgtcttctctaaattaataaaaattattttaacataaactgtattttaaaaaaactagaaactcttcaagtaactaaagataatgctccaaggccattttcacagctttttttgtttgtttgtttgctttaaatgccattacagccaaattaacacacatttaaccaaatatttccaaaacagtccagcaacacacaatggagttttccattcagtatcttaagcacaaaaataggctatgtttacagtagttaaggcgatcaaattttaaacaaaagcaattaaaaaaaaaagggaaaaacagcaaacgttttccatgctac

SEQ ID NO: 59280 - DNA, 1901 bp, Homo sapiens
gcttatcttggcctgttatcaggaacttgatcaccaactttctgtaggtctctgctggtgttggtcaatattttactatcctaagtcattaggaaagtgaaaatattgcacagttaaaaagggaacagtaaggcatactgtcctgtgctgggtcttatttgtacatcctgtttagaaatcggcacagtctgctaacagaatagagaacagcaaaaaggcacatagggaaaagttatggtgatactgagaaaagtaggggactacctgttttaatcccaacgagtgaacattagagatgaattgattcaattccttttctctttgtattctcctagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagtatgctttgcgtattgtgtttttgttctactaagagaggttagtaatagtatataggaaggagctttatctctgtagtgtaatacttagttcaagaaaaattctcaaataggagcagtatcgttagactcaataagtataaagaacaatacagattatcctacaagccaattactgatagtaatgacttacatgtaaaaataatttataatgaatatataatttctgtttaatagagaatgaatgggcttttaaagtctgcattcttatcttggttgcaagtattgcactgttaaaatgtatttttagtaatggttcagagacagatacaaagaactcattctccttttcaagtatatgtgttagactcttcctaggtattgggtatgcagtggtgacaggagcacagtcttcctgaaactta

SEQ ID NO: 59281 - DNA, 1047 bp, Homo sapiens
tccattaggggatacagagaaaatacgtagaataatgaagaaaatttcaagtagaaccctagatttctcagaagacagcaggtatgcaggccttctttctgtgaagttgctgtcatgcagatctacaatccctaatcaatagaatggaaattcaataagctttaaaactggaaagttttaagtttggcacccagattcatttggcagcaaaaccagtcttgaactaatgttagtattacataatctttatcctcttatagcaaatgatcatatgcgttgctgcagaaatatgtttgattatagaatactactccagatggtatttgcgctgttttacctttctactacctgaagaattctaaatcccaaaacatatgtggctccaaagattttgaaaagacattttgaacctacaatatatcaaaaagttgtttgacagtaaacagtgtgtgccatgaataaatgtcctctttaacttttagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccaggtaaacataaacactttgtgaataagttttttcttttctctctctctcttttttctttttttttttttgagacggagtctcgctctgtcccaggctggagtgcagtggcgggatctcggctcactgcaacctctgcctcctgggttcaagctattctcctacctcagcctcccgagtagctgggattagaggtgcgcgccaccacgcctggctaatttttgtatttttagtaagagacggggtttcaccatgttggccaggctggtctctcctgacctcttggtctgcccacctcagcctcccaaagtgctgggattacaggcatgagccagcatgcccggccaactgtcttttcttttaacttgcctatgtgcctttgaaatagaataaaggaaagatcattgttactttacag

SEQ ID NO: 59282 - DNA, 1975 bp, Homo sapiens
accttagcttagatatttgagcatgttttcgatcttagttttcttcagaagggcattatgatatcaatgacttattagatacatttgccttatggttttcaggaaaagcatcaaactacagctcttggaagaactggctggattcgtctatttaataaatacttttttttcttaatctgtcaatctaaattttaggaagttatctgtataacattgtaaaaaatattaacataaaaaaatgataataaatgaagcattccaaataatgcctccctcagataaaattcatcatctctgtggaattctatcttcaatttagttattacctgaaagatgtttatctcaaagaggctttgctatgatctctagcatatattattccaccagatatatagcactgctattctaatcctaaagttcaattttctgttctgtaggaaattggagaattattacaaacaaggggtagagagtttggtgtaactactggaaggaaaagaagatgtggctggttggacctcgttttgctcaaatatgctcatatgatcaatggatttactgcgtgagtattcttcagaaacatttatttcaggaaatcatagatgattaatggccataggtttaattttgtggagtaccttaataggaaaatttcactctttagactccatattgaaattgtagtgccaggcagaagtagaccaagatatagggggaagggtacacaaggagagagatcccaagttatcctcctagacatccaaggttgttgaaaagaatcgtgatactctaagtatagaggcaggcagaatagggtatgtaggcagataggtggacagatagacaggtgggtagcacagacaccatgagcatgtacagccgggaggcgatgtacctagtgatccgcgcatgggcttaatgtctgagttcctggattcagatctcagatctgtgcattatgcttgtgtagctgagcaagttaatcatcctctgcctctgttttatcctctctgaaatctatataacagcattacctacttcataggggtattttaaaaattaggtgagaaacgtagtgagagcctatagcacactgcctggctaactgaaagtgctcagggaaagttaagttgttattaatacgtatacatgaataggtaaataaatgtattcatatctgtattagactgaacttccagtaaataacaataaagttaaaaatacagtttttggacgagaatcccaaatttagtttgttatctaatttctgcagattttctctttaaaacctgttttccagtcagtttgtcgggaaattttgatgtatcatgaagaggtccttgatgtggtttttctcactctttgacaatttctgaccagaagggtagaggtgatggtaaccagagtgaagaattgagggatgctggcatgtgtgtaaatgtacatgtatcttaatcatccatgtagtgtagtgagttctgctgtgttccacggccacagtgcaaccttaactccaggcagccctcccacaaatacatgttgtttgttcatcaatcataagaaagctgatctgggcatggtggctcatgcgtataatcccagcactttgggaggccgagaggcaggaggatcacttgaggctgggagttcgagaccagcctgggcaacctggtgagaccctgtctctacaaaaaatacaaaacaattagctgggcctggtggcacacgcctgtagtcccaggtactcaggaggctgaggtgcaaggattgcttgagcccgggaggttgaggctgcagtgaaccgtgtttgtgccactacactccagcctgggtgacaaagcgagaccctgtctcaaaacgatcaaaaaagaaagctaagcaaaattcatcagtgaaaatctgttacaattactagcaaagtaactcagtgtatattgtcctctagcgtcttatgtgtggcacgctttaaaatata

SEQ ID NO: 59283 - DNA, 1050 bp, Homo sapiens
cattggcttttgactccaagtaaactattaaagaaagtgtatttctgtatggtagatatgtatttttgataccatagtatgtctagccagtctggaaagaaaacagagtgtctacttggtagagtgaatagttaaatatgaaggagatctttgggggtgagaaagtatgccactctttaattagctcttataattggagggttattccctgagtagagattaaaagctggggaaatgttgaatcctacaaaattcttgtgttgccgtcactccaggttgctacaacactttaaatattcgtatgagggagtcatatttgttttacactaacaggaaactatgaaaataagtagatgagtttcagcattaaatttcttcataatccagtaagtgagtagctgctataaagagctgagtcagtaactgtacatgcattcaaggagcctctctgtataagcacttgcgttaaagctctgacctcgtttttatgtcattacagctaaaatgaataaaaagtaaaacactgagtctttgagagggcagttacagttcagatctgttagatacctataatatactcaaatgcagaattgtaacggtaattctgttttaaaatgtgttattcatgtgtctactatattttaatgtctgtttctgtttttagggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgtaagcctattctaagtaaataatcaaaatgtattaaaaattcattcttcttttttttcttaatgaattattgtctcctgtgcctttcacttaatttgcaagattggtcagaacaacattttcttaaatacataattttggctggacgtggtggcccctgtctgtaatcccagtgctttgggaggcagaggcaggcagatcacttgagcccaggagttcaagatcagctgg

SEQ ID NO: 59284 - DNA, 1050 bp, Homo sapiens
tccaccaaaagaaaaagaaaaaaatttaggtggtcatggtggtagtgcagctacccaggaggctgtggtgggaggatcgcttgagcctgggaggtcgaggctgcaagtgagccatgttcccaccactgtacttcagcctgggtgacagagcaaggctctgtctcaaaaaatgaaataaaataaaaaatttatggttttgtggattatattataaatgcagcttttcaaatacctcacaaaatttaaaagcacattgtaatatagtcatttatttttattttcctgaaagctggtttatgaagtatgactactttgctgggagggttttatttgcagtgaggttaatatagaacctttgaatttcactgtatctctagtttttgttgagcaatgctcttttctgttcctggaaaatcagcatgagacatgaaagctaatccaaatgttacaatagagtgagcaccgtcaccagcccttttctactttgcgtttgtcagttttcatgtcataaagtcaggtaatttattcttgttctggttatgttaaacgtttattagtatacatggaaattggtttttgtctttgtgtatagggttatatggaaaagattaaaccaatggtgagagatggagtttattttctatatgaggccctacatggaccaccaaagaaaatcttggtagaaggtgcaaatgcagcactattagatattgattttggtaagtgagatatgacttatagttaagggagcttaactgagccctaagtagttaaaatataaataattaatgttagcattaaggagttttaaaacaatgtttttagcttgtatattcaggaatgatgaaatttgtcatcttgtggcactctttttaaaggaatattgcagaacacacaatacatgtgttacgttccctattttattagaaaaataaaatcatcatttgagttcagtaggtctgaggttctgtaaattgtggttttcgttggtttatggttcaaaccctggaactataagataagataaattctatggaagaatctgcatct

SEQ ID NO: 59285 - DNA, 1412 bp, Homo sapiens
ggttgtgtataataacaagtggcatcaaagctataatgacattgtatcccctttcgatcaaccactcaacatttgtctgcactggcagtgcacctttactgaagaatattagattgctaatgtctgcctctctctcttttagaagtatcatgtaaactgcccccttttgttgttgtacagtataatacagttaattcagatttaagtcttttgtgtttacagattttagtcattccatttctcttccctccctacacacatatcaccttaattatattgttgctatgcctaaacttgagtaaaaaaataatttgaatgtcttacttattcatatggctgatctcctttattaaattttatttctcagaaggtgacttcagtttcaggattaatttgctgttaagatcatttaccatctgcagaaaccatttgaatgaaatgatattatttgaaatatttttcacagagtggtaatgtcttgatttatctgtgtttctcaggtttaaagttctagctaaccaatacaaatctatataccccactttggaaatagacattgaaggtgaattacaaaaactcaaggtaatgctttctggcatctttaatgttctttttaatacttgtttgccaaattggcatctagatcttttcattcatgcaggctttgggtaagaactggcaaaggaaattgtttgtcttggacatggtatgtttgagtgactttacatgatatggcttagacaaaatattgagtagggagcaggaggagtacctgaagtaaaggagacagagtccagatcatatgtctcatgtgcagtgacagggagtttagatcttaccctggagataatgaaaagctactaggaaattttgaacagaaaggagactagatttgcatcatataaaaatcacttctaacaattggaggacagatcagcaaaggctgagtgagaacttttgaggctaaccaacccatttaggaaggataaccccatagggccagattctttagcactgcactcttaagagacaaataaggtaattgaccaaagattagtcttttcttggcaactagtaggtgtcagtggtgcttacattggccagtagttgaaattcctgtcctcttcattctttcaccttttacgatttttgatgaacttcaaactgtttcctgtgaatctgattattacttcttctcatctatagataagtatcaatatcagttccagaactaagtaggaatctacaaacctcatatgccattctagaataaatgcagaccttaggtctgcccatccactaagttctaaaaaaatatgacctacaaagaacattctaaatgttaggtatttgtatttcagtgcactgattattgtgtagaatagactgccattttctttttattcagctat

SEQ ID NO: 59286 - DNA, 1095 bp, Homo sapiens
ggtgttataaacttctatcatcacttctaaaaatgtgtttaatttattatactgaaatgaggctgaagggatttataacttcagtaatttgaaatgcggtggattttgcttttgtgtattatctttgtttcaacaactgtggttttatttcccctcagtatttgattttcatcaagcagctgatggtatccaggaacaacagagacaagaacaagcaggaaaaaagtatgtgtgggtttttgtttttttggtacagtttaagcatatgcagacctttatattttagttctagaccagaagtttaagaaaaataagtattagaatatcctgttttagagaaaatcagtaggattatgaacatatacttagcaagaaataacataaacagaaaatagtcatatgtaactttattcactgcaatgatctgaccaggagacctacatctttcttgtctgacttaaagcttgtttggatttgtttttaagtttgggtacaacaaaaaagggcattggcccagtttattcgtccaaagctgctcggagtggactcaggatgtgcgaccttgtttctgactttgatggcttctctgagaggtaactaacttgtgtttcaaaatggaaggaatgaatgcattttttgattttttttaaaatctagggtgcaaaatgatacagtcggtattctagttaaatagtggtggttggcttttttaggtttgaaatattaaagttatttttattacattctaattcatccttggttacagattaacttcatgaaatataacatgacggtgatttaatagaatgtcctaagaagacaaagccagagttatatttaagaattgaaatatggaatggtttcctgagaaatagaatgattccaggggctgtggctgtccttgggtggttacattctaaggtcttgatccttgcattttcaggcctagagactccttatgtcctcccacccagaaatcattagctctcagatactggtgaattattgtataccaagctcaacttgaaatcaacagatgctacgttaacacatgctttctgtagccagatctccttgggaaacctagtagtcatc

SEQ ID NO: 59287 - DNA, 1530 bp, Homo sapiens
ttcaggtcacagagttgcttgacacactcttaggatgatgggaattctatgaatatttacatcaagttagggtaactggatagattactctatcttaagagattttttgtgtgtgtgtagatggaatatcatggttagattgccataatcctccatagccaaagacagactaattgctctatgtatttttttcactttttttcccctcttttaagaaggaatatgattttctgtctttcagaaacctgaattccccaatttctatattctttcaggataatcactcaagtattctacagtggggaaaggagacagccaaactattttaaagccttttacaaatgagtagaggtggtaaatatttgggctctcttaagttgaccttttggcaggaggtcattaattcactttggagggagataggttatttgtagtatttatcatcaggctcaattttcccctatcttacattttagggaggaaataatgctggccatacagttgttgtggattctgtggaatatgattttcatctcttacccagtggaataattaatccaaatgtcactgcattcattggtaagtatataaactgaactgcatggagattcccccccaccagttgataatggcgtttattttttattgtcaaaactgttttcatctctcactgaccagatggttcattgatctcttattaattttgaccttgataccttctggaatatacatgactttggctatttgtcactgtaagatcttttaacagtaatactttttggaatgattactttgcattcatctgtgctcactgacaatcttaattctgtaaagaagtattagatcattgaatcagttttccaaatacttttttttccacaaatactttcaaccatgactcatagtaagaaatatgagaggttcatgaatttattttgaacccttacaataaatgatgcaatctgatcttttctactctccttttaatttttaaaaatccttatcacaacctactaaattgatttatgaccactaatagggtgtgattccccaacttgaaagatactgatttagcatgtactgtgaccatgttccatttgcttaaaattacataattagtttccttcaaaatcatatttcactttgttttcaagaaattttcagcttcattgagtataattctagtgttttatattcactatattatgttccattatgtatttaaattatactcctgtgtaaaacttggaatcatttctgtggtaacaccgtggtaaatcagaatgtcctttaagttacatatgtctgagttatagatgtttaccgttgggatttgttggttttcctttaggaaatggtgtggtaattcatctacctggattgtttgaagaagcagagaaaaatgttcaaaaaggaaaaggtatgaaagaatgagtctacttggtaaccagttgttctttgtaaagttttattaggatcttatgccagacgaacaacatgtttgtcttatgctttaaaatttcgggctat

SEQ ID NO: 59288 - DNA, 1027 bp, Homo sapiens
tggaaacaatagatgcaaacctagtggcgttttcactcttaacagcgcttaaggcctgtgttgttcagattcaggatttatggggagttatttataacttggtaggttccccagatccataaatatgtaggacttgcatcaaaggacaaccactactgctgccttaattttaaatcaatatttattttaagaagaagagagaagaattaaatagaggcccaaccctgggtacaggtcattcatctagtaaacattgagtatctgcaggggatcacttagcctgggagtcaaaaatctgaaaaaggcagggattgtgcccacaaggagctcacaatctgggggacaactgctgtgtaagcaaaagtgttgagaaggtcgggatggagaaaggtactagtctaatacgtttctcaagaggttaaagtatgggaccaagaaagtccctttctggcatcacaaaaggaagcctaatactgttttttccccagttctctcaaagtaaaatactgtgctttgttttctgtattttgctgagtagaagctacagaaacttcttaactatagtagtttataccaggctttaagcaaaggcttacttatttattgttcttgaggaaagtaacttcggtggtcttggttataatgacacacatgaagttgcctgtgatcgggaaaggctagagcagtgttccgtgtgtattctctccaaggcttcaaagtcaataaaaagagaaaatactaaagttagtcataagggaaagcacaccccatcacttgatatatgtttataaaagcttgctataaaaataaacatactgaaaaaatattactattttctagctagatacaagtatctgctgaagatctgaaaccactattagtgttaaagaagcataaaagacatatcagcagcaaactaaaactttctccttgaaatagaaaaggtgaaagataatttaaaagaaaataacgttagtattatttaatgccttgaccttgtacagctaaaatgatctgccagactact

SEQ ID NO: 59289 - DNA, 1320 bp, Homo sapiens
aagaggtgggctggcggggagcctttgagagatgcgcgatgcctggcagttgcagttttgcgtctggcgagtggtgctcagcgccgggactgaggccggggtggaggtgggatgcggtccgagtttgaggagctaccgcccgaggcctgctcccaactcttccgactgcgggcggagacccggcgcgacggcagaaccccccatcaccgcccccccgccccgcccagggcggcggagtgggagtggattgtttcgaaacgtcctgaaatcagactcaccgatcccccatctgcaggaccgtggcatgcagtgctttgcttcctctggtccactttgttgacatccaaacccacccacctctgggctttggactgttgttttagggccctgagtttcttgtttttgtttttgtttttacagtgtgctccatacatgaaagttaaggagaaattacttttactagttggtcccagaggaaggaatcccttctctgttcaaaaaaagtgagggaagtaaatacatggatgtcaaattgagtatttggaaataaatatttgcattgttaaggtgacatcgaaagtgaactttcggaaaacgaggtggtaatgtacttctaacgggagacacgtggttttcagtgtaacctttcttcctatttgtcgtttcctttgacgcagcatacagggtaaggcctttgtaaaggctctcagataactctctccagtttcaaaattctaagcagatgagcaataaccactttcaaaacaaagcataatgtaatatttgaagttaactgctatctgtttaggttgcaagaatatttgtttttgaacatgcatggcatgatatgatggtgccatgctgtatatgttctagtaagttataggcccccttgaataccattttgagcatgcagaaacaatgaaatcacaggtatgttaaaaagctaaatgcaaatactgcaaatattctctgatttaccttgtttcgttttgttttgttttcatttagaaatccaccctgcccattctgaaatagctgttgcactaattgcctcttaggaaactgtcactaccacctctccctccttcccttccagcctattatttctccacccctctggcaacacactttgtaccttagcaatcttcagggtgttgccattaaattcctgccccgcactttcttaggaaatactccagaaatccagcctttacctaccttttgtcttacattcagatctggtcatgctgtggggaagacgtatccgaataccgagctttcttgctgtcgacagcgggagagaggctgaggcctgtg

SEQ ID NO: 59290 - DNA, 1030 bp, Homo sapiens
aactttggagtatggcaagcacgcagaatcgagtccaagaactggtttgcctgatttttgcagtgaaatgcccccagaaaaaagcacccggtagagaattgtcgttgcagttagatgcatgtttgggtgtgtttgcttgctttgttctgtagaatgggtttttgttctgtagactggattagtacctctgactgcagtgcttaaaattccttgtaagttgactgacaaatgaaaaattgcccgtcgttatttttgttggcttaaagatgcaggagagcagaaatactacaggccaagagtcttatacagttctaaactttgtattcccttgtattatttataagtttctaaatttacagtgttattatatcttgggtagagtgggatttctcatgccatatctgggaattgtgtcagaagggtgtaggaactgcctgccacttgagatgagtcctctgttgaattctgatgtgagcctggagatgaaaggagatgagttaacatgctgagaaaagtggaacaggacagaaaaagttgaagaggagaataagccaaacaaaagatcctagaaaaccatggcactttgtaagttctgtggcctgtgtcactggttgagaaataattctctggatttaaactttttgtgttcagctgaacacctttatctttcaagactcttaactgcccttttactttctctgtgcacatccccctaatctgaatttggtttgttttttattcatgagggctattactgtctttcagaatatattctgctcttgagatcacagtgtgccttttctcctagattattaaacaaacccgtatttaaattaggagtatacagtggccagaagccatggtttcagagcctaaaagaatttgtgagaatagaggaagagagttttaccttttatatgaaaacgaaaatgcatgttttggcatatagtgggcttctttacacttgaggcattctgtgatacaggaaaatctgcaaattgtggtcgattgggaaaagctagagatggta

SEQ ID NO: 59291 - DNA, 1786 bp, Homo sapiens
gtaagtgatctgcctaaacaactaaaaatacaatctagaatttgtagaccaaaatctgattcactatcttctctactaattcctgcacttatgtctttatattgcttttgcctgtgaacaggagatgaagcatatgaatgtttatcggaatgataaatagttgaattattagacttttaataaacttggtcttatatgttcttttgagggctttgagtgttttatgtcactaattcagcaacctaccattacttattatttttgacctggtagaagccacaaggatgagttaactgtcctttcttctttaaggaatttagagtattgtagaggagatacacaacagtggcaacaattcaagacagaatagcatggttttgataagagcagacaaggatgcaaaggaggagactatgtagttgtaggatcagggaatgctgaaaaatcaaaggtatgaaacttgaagaatgggtagcatccacaaggacagagaacaattgacgtgaacaaaatggcaggaatagggaaagcgcaggtgggatttgggaactatcagctggtccagtataactagagtagagcataaatgaaaggagacaaaactgaaagtttgattagaacttctttagtcagatgtgttgtgggcttgggtgaagggctgagggggctccttgagccagcagaaccatttaaggttttcatggaggggaacagtgtgatcagttgtttagattgagatacaaattttggtctgttatactaatttttctcaagtcagttttggtttttgaaatatttttgtttgatgccaagggtaaattccttttatctttggtaattcttcctattcatcagagatgctttggatgagggttgctgttgtctgtataggcctagtacatcagctgtctggttccaactctgtaaatatgaaaatcaaccttagggatgcccttataatcatggttatagggacctcttgccatgtgtccttgtgtctctttgttagattgtcacccgttccagttctgattgtatttttctattttctagattgggctgctgcggatcatttcttttcttccataactctgccgtatgcatgaaaataattctattgggggtcaccagtattaacttccttctcatggaagaagagtgtgatcctcagaaggttacttaattatgcatagtgttcctattgcttgctgccttatcagtgattatgttcctctgtgtactttggagtaatctaccaccaataaaaacgtcctggagctactttctgagtcgtgggaatgagcttgttcacgtattcctaattgactggcacacatagcaaagcaggtgactcagattagtttcaaatactgagacaaatctctggtgtagtcattttaagtcttcatttttcatagatccagattttgtgcttttcaggttatcttgactaatgaatttttataaaataaaaatatgcaggtatttgataatgtttgcaaattcattgtgttaacaagtttctaccagttttatttatttattttatttatttgttttctcactctgtcacccaggctggagtgcagtggtgcgatctcggctcacagcaacctctgcctccccagttcaagtgattctcccgcctcagcctgccaagtagctgggattacaggcacctgccatcatgcccggctaatttttgtatttttgtagaggtgggtttcaccatgttggctaggcttttctcaaattcctgtcctcaagtgatccgcccgcctcagcg

SEQ ID NO: 59292 - DNA, 1171 bp, Homo sapiens
gaatgtattttggtatagatgtgacagtaacttaaaaacaataaattaaaaatcaactaattggccccacattatttgaaataagtctttcctctctaaattgtgatgtcatccttaatcataatactaaattcttacccatacggaattgttgattctagccttattaccacactgttttaattattatactttcacgttatatttggaatctgattaggccagtttccctttactattattccaaagctttattggccttcatttccttttctaggagtactttgtaaggctcgctgaaaaaaattccataggtttttgttttgttttaattgtgttaaaatacacataacataaaatttacgtttttaactatacaatctactgtgttaggtatattcacatttttgtgcaaccagtcttcagaacttttttatcttgcaaaactgagactctatacccactaaacaacaactccccatttctccctcccctcagtccctggtaatcatcattctgctttctgtctctgtgcatttgactagataacctcatttaagtgaaataatacagtatttattttgtgactggcttatttcacttagcatagtcctcagggtttatctatgttgcagcatgtatcagaatttccttcctttttaaggctgagtaatattccactgtgtatgtatatgccacagaaatcaagctaattttctttttttttattattatactttaagttctagggtacatgtgcacaatgtgcaggtttgttacatatgtatacatgtgccgtgttggtgtgctgcacccattaactcatcattcacattaggtatatctcctaatgctatccctccccgctccccccaccccaccacaggccccagtgtgtgatgttccccttcctgtgtccaagtgttctccttgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatgatgtgtatgtgccacattttcttaatccagtctatcattgatggacatttgggttggttccaagtctttgctattgtgaatagtgccgcagt

SEQ ID NO: 59293 - DNA, 1063 bp, Homo sapiens
taaacaaaaaatctaggatccagtcgaggttcattcacttcctttaattgccgtaagagtagcccacccttcctctgccttcttttgactttgctaacactgatatttttttaaaaaccaagccatccatggccaggcacagtggctcatgtctgtaaccccagcactttgggaggccaaggcaagtggattgcttgagcctaggagttcgagaccagcctggacaacatgatgaaaccctgtctgtataaaaaatagctgggcatggtggcatgtgcctggagtcccagctactcaggaaactgaggtgggagaatggcttgagccctgcctgcagtgaaccgagatcaggccactgcactccagcctgggcaacagagccaaaccctgtctcaaaaaaaaaaaaagaccaggccagttttcttgtagaatgtctcatagtccagacttacctgatttttccttatggttgtcttctggtttaacacatttgacaggaaaactaacaaagcaaatgtagcttttgtatttcgtcacatccaaaggcacataatatcaattggtccaactattaatgatgctcagttcaatcacttagtattgataaggtgatatacaccatatttttccattgcaaagatatcttttttctttgttatttaggaaaaatagtgggggttggcaagtgacattggtgcaacaaatggggagaaatggcaggggagaaggaggtgatactttgagacattgtgtatatcattcttaaacagcctttcttctaatggttttatcatccatgatctttgcctgactcaactggtggcaacaaaatggtgattgcctaattttgccctttcgtctacttgtactagctggctggcttctattaaaaaaagagctttcctccttttactttttttttttttttttaagtattaccatggactctgagatagtctttttattcaatatgctatagtccattatcattattctttttgatgttcaccttttcccatggttgactaatgaaaactgctttaggccagcttctctataatct

SEQ ID NO: 59294 - DNA, 1027 bp, Homo sapiens
ttgaagaatccttactgtatgtaatcttactactctccttccaaaatcaaattgattcacataaaaaaatgtagccttcgtttcctaacttgccatccaaattctggctctccaaaatcaggaactcaaaaaattccgatcaagagggatacttatattctcatatgaatctttgttatatccacacagattctctctttttgcatattatttatctttttatcttgtttttatgtagttttataaaataaaaagttgtacatttttatgtagaatatctgttgatattttcctctgtaaattctaggattttactttacttaggttgtcttttcccacctaaaatttttaaaactctattcccttctatccatatatagttatttttagacacactagaatttttatacatgaaatttatgcataatcaattttgtcaacatgcttttagtaagtcatactttgtcattaattttaaatatctcctttatcatatatcaaattcttatatatacaagggtctgtaccaggatctgttcctgcaacaatgccatattgttttaatgaatatttcaatttctagatgggaaaattccttgttttcatatatttatttatgattgcttaattcttcttccaggtacgttttattttatttttatccacgctcggccccaggtacattttagaaaaaaacacaactgacttgttcatttatgcttcttccagcaatgcgtgagaatgtgtgtaggtctgagaaagactggctaggggtctggagccaaggttaagacttgaataaacctagaacaattaaagataaattatctgtcccctaacctgggagacatccaataggtttgtaacacttttgagtgttacctaagtgttttgtttagtgagctcttaactcatttacctttttctcagtttaaccccctccacttcacctttttaacccctttcacagtcatttcctgtaatttcttatcatataacctatgtacatcctcttccctcttcctgg

SEQ ID NO: 59295 - DNA, 1027 bp, Homo sapiens
aattgattgttgatatatgtacttttctgttaaattgttcttaaaaattctaagaattatcatttaacaccgtaatgttatcagttccgatgcttcctctacagcagggattagcaaactactatagcctggcctttgaaccaacaccagcgtgtcatctgtccttgtacagcctgcaggctaaaatggtttttacattctttttaaggactgaaaaaagccaaaagagtattatatggtgacatgtataaattatgtaaagttcaaactttagtattcataaaatttttttttttaaaccggaacatctattgcattactcatcgttgaaattcttaagatgaactggatgctgcagcagctgccctcttgggtttaggtggtgttccttcacggaatctgtgcctgaatctgcggtctacaatttttaggtgcctcattcgaccagtcccagtggtattttgtcttttagccttggcactgccgttatactttctcttgcgcttggcggggtagccacatttgccacaggtcaacttctgaaggtggtaggccttagagccacagcagtggcacgtgtgcgtcttattgcgacgctttccaaacgatgatgttgccttcgtcaccttgcttctgtggctaagaccagagagattcattaagttttattagaacacagccatgcttatttgtttacctgtttccttgactgctttccggctgcagtggcagagttgagtagctgcagcaaagatttatggcctataaagcccaaaatatttattgtttgacctttaacagaaaaagtttgccagcctctactctgcaagataggtcccttcgaattgggtgctaagtggcttaaacattgaggaaacgttatcttacaaaacaagtccagaataaggcaggctccattccaatgtggtcagtgtctcaactgtgagtgtcatagggatgtaaggtctttattcatttctctaagctgccatccttgggatgttggccccaccggcaggccagctcc

SEQ ID NO: 59296 - DNA, 1034 bp, Homo sapiens
aatatattgtattaacaagcgtcttctgtgtgttcaaagtacttttcagtgtgtctcacagcagttgcagagatcaaagaaaggagccaagtgaaattagcttgatttcacagatatgaaaagtaagcaacttgacaaggttctttagaaaggaaggaatggagccaacagtagggagcccaggtcctgagtaaagagctgcttgttatcaaaagcctggagtgacaccactgaaggctagtctgccgtggcttctctgtacgccgcccccctcctcccaccctccactccctggcagtggaccaggtaatcttaacctctcttacctaatacagaactctttctcttctgtagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcac

SEQ ID NO: 59297 - DNA, 1717 bp, Homo sapiens
gcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaatgttttatagtgctttctttcagattataact

SEQ ID NO: 59298 - DNA, 1600 bp, Homo sapiens
ggagactggggacaaaatggagggagcagctcgctaatgaacatgcgtcagcacgttggtgtccgcggagagggcgcgcgtgtggcgaagtcttccggcgtccccgaaggaaaaatgcctctgcaacgtgcatttttgatgtgaagtcgtgttccacgtttcactcctccctaagactgcgacataacgtgaaacaaaatactgcatattgtcgagctcaatggagaacgcgtgcatgcagggtcgagcccatttttcagccatcaaaataatacaatgcaattttttctagtatttataatttttcccctttaactttatgcctcctttatgtacttctacatttcacgtttaggttatatgtaacctaagggcactccttaggaaactggacttgtagaatatgtcattgtgcaaagtcatgctgcttcgaattatgctgcgcgctggcacacagcaagcgctcagtgttaacgatgtcgaattcatattaagtactgttcattgggcgttttcttactccgtaaggaccttacttgcatgcccatttgatacctttctacaatcccagtaaaatacacagttaaggttgtgtatttatgtgtcacatttttttttttgaggtttttttttgcgggggcggggggggtttttttgtttttgtttttgaaattgtagttagaaactacatactgtgccgggcgcggaggctcacgcctgtaatcccaacactttgggggctgaggcgggcggatcacgaggtcaggagttcgggaccagcctggtcaacttggtgaaacctcgcctctactaaaaatacaaaaattagcctggcgtggtggggggcgcctgtaatcccagctactcggcagcctgaggaaggagaatagcttgaaaacggaaggcggaggttgcagggagccgagatcgtgccactgtactccagcctgggagaaagagcgaaactccgtctgggcggggggagaaactacatactgctctactgtttgctagggaaaagaaaaaaagtcaccctactggtgatatcctgccaattctggattctctgctgaaattataatgctaactatgctttgaactccggatctgaaaggccgtgttgaaggtagtaatattccatgaaggagggggaaatccttttgaagtcattgttgattatgttgtaaaaggaaaactggaaaagtaccagctaaaacaccaccgagtcatcctattttatttttattatgactttgaaaatttgctagagtagacattgttggggtctatttcatttgtctttgaaaagtattttcataaggatgatttattttttattttttattttttttgagacagagtctcactttgtcgctcaggctggagtgcagtggcgcaatctcagctcactgcaacctctgcctcccgggttcaagtgattctcctgcctcagcttcctgagtagcagctgggattacaggcgcctgccaccacacccggctaatttttgtatttttagtagagaaagggtttcactatgttggccaggctggcctcaaactcctgacctcaggtgatacgcctgcctctggtttccaga

SEQ ID NO: 59299 - DNA, 2049 bp, Homo sapiens
gaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcattttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaacctt

SEQ ID NO: 59300 - DNA, 1718 bp, Homo sapiens
acttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattccccta

SEQ ID NO: 59301 - DNA, 3346 bp, Homo sapiens
attcagggtttttttgcaccattatgatcaccatactgtgccaatgacatagttactcatgagcatgtccagtctgtctacattaatgaaggataatgcagagatcacaggctggagagttacatctgacagagaagtgctgcactattggggcatattctttcctgctattcctttaacagttccattctgaaccttacaggaagtaaaataagttatgtctggtaaaatatacgttgcaaacacttaaagcattgccacaaattggtgacagccaagacatttttaaaaattttaaaacaccaagaatagacgtggctagtacagacaccagtttataagtgtgacattaatgctataaaagttaaagcatatatagagatacctaaagagttattggggcttatttaaatgtcaactaacaaaggaattttttgaggcagcttgtatcctgtatcagttgtttgtagttaaagattgggagagtcatggtcacgtacaagaaaaaaagattccaacataactttttttttttttcttgaaaagtaaagcaaacaaatgtgttgatttacatttcatctccttttccttagtctgtccatgtgaatgtgctgtgtggaagagttaaagggcccaactaaatgttccagtgattccaataggtattccaaattaattgctgcttgtacatttaatagttatgttaggcttccagaatcactttaaataggactctttttaaaagatgggggaagagagtaattggtaatcagatggacagagtctctgtaacagaaaaaaaagggtgttttctcttgcatatctgaggtgaagtgtgtattctgtgtgctcttagcaattggcagtcctcttgcttaggtttacaggtgtatgtgaaaatagacctgagtcttttcaaagttagatcatttttctgatttcatcttttaacttttggcaatacatttgttttgatatccaccctacttggtagagtgtaagtacttccttacaatgttctaatgtaaaacagtgcataggagacctttctgtccttggttgcccaaaatctttttcatttctactaaattcagaaatacatatttttactagcttatgaaaatttggaaaatagcttgacatccttttggataatgaagtgattagttcatatattgaagtatataaaatcaactaggaagtaaattcaagactgaaggaatgggagagcttgtgtgagttttggttgtatcagtccagaatatgtaattttccatttccctgaaaaagacttcagaggaaatttattttccccactatacgctccagaatgtctttcggtgaaatgagagggcttgggctcttctgattctagacgtagctatcagagtttgcttaatgaaatatgggtctactcacaaataaagcaatttaatggtttcgaaagagtaggcaacttgtggtttcattaccatttctgttcatttgagaaaaatcataaaattacagaaaaggaaacattcatttcaaaaataagctttgaatttagatggtaaggcatatatgttttatttcacatgacttcagggtagaagtcaaatgaagaaacatttctatggaaacttaccctttaagaaaccagtatatgcaaagaatgattgataccccctgagggtgtgccatataataggtgactgataacatacaggatttaattcttagaataattaagaacagatatcacccattacattgacctacatttttctaaagtgaacaatagaaacctctctcagaattagtatttgcctattaatgtaatcagtgtagccttctcaacataaaaatgtccttattctagaacatggaagcgtacggcaaatgcaacggttgaaagcactgaaaaatatttgtaaaacatctgtagtgctcacattatgaactttaaatgtaatactttgaaaaccatcttcataatttttttgttctaacagcttcctttttaagaaaacattttaaaacattttaaaatggaacttaatgtgcaaaataagttgtgtaaaataccagtatttgggtggtggaggatattggtatattatattgacctgggttgatgactactggactattttaagatacctacttccaaaacttattttattctagaggaccactaaaaatcagaattacagcaatcattttaatttttctactttccttgttaaggtcttctgcttacccaaagaatagtgtatatcttaacatgacttttaaaggggtatcttgatccccatcacagatttttatctatgaatagaaggattgaaaccctatttgatccctagctctttgctgaaaagtgcataaacaggaatcctgaatttattatatagacctcctcgcattatataatcgaagcaaagggaaaccagcgatggagtagaggtacgtagactaaagagatgcttgcaaatgatggtacctagggatagtcacattttcttgttgccaaactcagacaatataatcacaagtccagagaagagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtaggttactcttaaagtttgaaattgtaaagtgtgaaagtctggatagaggggaaggggaacctggactatttttatttttttttgagacgagtctggctctgtcgccaaggctggagtgtagtgacgtgatcttggctcactgcaacctccacctctcgggttcaagcaattctcctgcttcagcctcctgagtagctgggattacagttgcacaccaccatgccaggctaatttttgtatttttttttttttagtacaggcggggtttcaccatggttggccaggctggtctcgaacttctaaccgtgtgatctgcctgccttggcctcccaaagtgctgggattacaggcgtgagccaccgcacctggccaggaacctggactgtttctttttgtctagcatttattgactatcttgtgccagatacttggatgagaatgtaaagataaaaatggccaaggtttttgccaatgagaaacttaggctgtatgtgatt

SEQ ID NO: 59302 - DNA, 1178 bp, Homo sapiens
gtctaaactttgtcattcattcctaattctggagctctgaggttgaggtgttcagagtttggtgaataattgggtttaagttttaacattttagtaataataaaagcaaacacatacatgttaaggcctgacaataggttgcaatacccatgcattgggactcatacccagcataaatggtgagggactgaacattagtgctttgagcaagaattggttaactacctgagatctctaaaacagtaatttgaattactaatacataaaccacaagtctcttcgaattgttaattgcctaaatttaccctaaaacttagttaacgctgcagtgcctttattaaagcttttttttgggggggggtgtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagctaactcatgttggagtgacctttgtcttactaacctttgttactaaacttgttaattagaataagcccttgagaatttggaagtgagctatactactaatgtagtatatatctcttgagtgtgttggagtagatgaaaaaccaggggtccccaagggtatatttttgaaattgaacagaaacaattcatcttaatatttagttttcattatgtttagcttaatatgtgtgctagtttatttggcgtcacacttatgtcaatctcaagtcatgcagaaatagcacagtctcagaaaagaggttaggtgggaaatagatgatatgcttacattattgagcaggactatgctttcacatcctaaccaattgactaaaaatataaatgattgaagtaattttcattagttgccccaggagtctttaataatagttttaagggatagtagattggacatagatagatgggttattcataatggatattcataatggatattcataatgttaacctagaattattcagaaaatataacacctatgtagtagaatctattgattgtaagcctagtgttggtaggcaaacatgttgatgatgggccaggacatcagtaatcactacttggttaggcaagtaattaggac

SEQ ID NO: 59303 - DNA, 8028 bp, Homo sapiens
taaattaaaagaggagcttggaaccttcattttgttgtgacagttaatcacggttgttatgttagaacttgccatgcagagctaggcgattttttatttagggtacttcatttttatcaagcatttgaaagggccaccaaagagttaaaaataaaatttggttacattactgcttttgttggtgagaaaaacattaattgtatcctttaattggctttaagttaaagactgacaacatgaactttaaaaatattaagtattcttttaaatatgggtcaaataagtatttaactctttaaatttcaagttataagcacatcagtttaaagttcttacaaatattgggggtgggctagagtgtgccttctttgtatttatagctagaggaagattagcccgtggcgcaatgaaatatgcgagagttaaggggttacctccttggtgtattattttaattatttaatgatttgactttcaggttacagagaagatcccagtaaggcatttatatacaaaagatattgacatacatgaagttcgtattggctggtcactaactacaagtggaatgttacttggtaaagcttctttttgactgatgtgggctcatgaatgttcaggagggtctgatttcagtgttttttaactagagggcattctaagccttttgtctgtttttatctattctgttaatacttcagacaggtaatattagcacatagtaggcacaggctacattttagtttttgttcctttattagaagtttatgaccaatggttgaaataaaatcttacccgtgatatgcaaatcgtcaactaatttggtctctgcgtatatatccctcctaacttccatcaattctggtacagagatagaaaagtaatagtgtcagtgacaggtgattaggttatatgcttatttctcttgtagcctacatcttaagtagtaaaatagatgagtctttggactattttaaacatctacttcatgaagattaattattttcttaggtgaagaagaattttcttatgggtattctctaaaaggaataaaaacatgcaactgtgagactgaagattatggagaaaagtttgatgaaaatgatgtgattacatgttttgctgtaagttaaagctaactttctatgtataaatggcaaagttagtagctatatctaggaactttaaagaagctttactgaggtcagttttcaatatgagcaacaaaatacaccagtccctggattagtgtaaagacttcattcagcagttgaattgggaaaacacaggacatttttgaggaactcactaattcattttgactgaaaacagtgaacatgaaattgacctagaaaattcagtctagcttctaggtcagtattgtttctggttctggagatacgtgcttcatggtttacaaccatcagatttcttaactgtgtagcccttaaaggccacctaatagttctttaacctgtagcttccacaggataagctttgctcctaattttaattcttagttttttagaaagtttaaggaagcagattttaactgttgaatttttttctgtgtaacagaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagtaagggatttttttttttttaactgtggcatttgaatattgcttgcctggcacaaaatgacatttagaagaactagatgattagtctgtttcatttactttgtgctgtgcatattgctcttaagtaattgtttcccccttatgttgactgttaatctttccataaacaaatttttgtccgttagtgtaagggctatgaaaacttagatatttaaattggccttaacaatatttaaagaattattaggtggtgtctactgacagtgaaatgacatttcttttcttttcactaggttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacatggcgaagccccgttcctactaaaaatttaaaaattagctgggtgtggtagtgggttcctgtaatcccagctgctcgggaggttgaggcagggacaattacttgaacctgggaggcagaggttgcagtgagttgagatcgtgccattgtactccagtctgggcgacagagcaacactccgtctcagaaaaaaaaaaaaaagaaaagaaaaattatagaccgggaggtattctaggtaaactttttgtctttgtctctatccattttgttagtatcttaaagagatgggaggaaaggcaagattaagttggttctttcaactctgagggtaaactgccttccactggctaggcttctgtttttttccgtagtgtttttgagctcttaacatctagcagctaaaaagaattgagtaagtgtaaggtcttgttacatagtttaagtgaccctgtttttgtagcaataatggacaaaggtaatatttaaattataaaatgttgcctgctttacatatagatatgagttgaattttaaaaagcataacttattaaaattcacaagttcaaggggaaattttaacttttgaatataggtggcaggttttaagaagcaaatggcagatactggaaaactgaacacactgttgcagagagccccccagtgtcttgggaaatttattgagattgctgcccgaaagaagcgaaattttattctggatcaggtacgctgtagctttgaaattgaaaaatattaactgataatttagatagattggtgtagaattaatgtttagggttgtaaacataaatttctttttttaaagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcatggaattttaattctgttactgtgtgaaatcttctttttaaaagaatgtttttcctacatattctgcttgtgtaactatgttaaatctattaggacttaggcctcctgaaagttaacattttttccagcaatactgcttcaggaattaaaattgcagttgttacatatgcatatatgtttggtctgtttttatttttaggaaaatatgttactaaacctcaagaattgtcagctttaggattgtgaggattcgtggtgggtttctaaattaataatatgactttgtttcctgcaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggaggcaagttaattttgagtgttctgtatttagttcaggatcgaaacaagtgataattttatagtttggatgtagctgaagtttcttcctcattaatggtatactgtcacagtaactaaagtattcatgtgatttgatattaaatacacctaggttatgttaatggttagaattaaacatttcttttgtctttaaacaattatttttggagaaaaaggaacaatctagaggaatcctaagtcttctgtataagtagggtacaatatacaatgaaactaaaacagctcttgtcttttagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccaggtaatgattcaagatccctggaagcatgattgataactgtagcttagtctggaaaggtgtgagctttatgttggggtgtcttagtaatccgtaaggaacatgataggcattgacataaggaaaattgaactagtaatggtgaaatgagtctacttacttttgagttttttcaggtgtactaaacaagtcagatgcatttctcataatgaataaaaaattaaaacataagaaaccagcagagggtatccagaatttgtgtattgcttgctacctaagattaggggctagcaacctgtccatttctgctcctctctctcacccccacaaacctaacaagcaattgggctcagagctcttagagagtatttcctttttgtagaacttcagaggacgaggaaacaatcgtggctacaaaaatcaatctcagggctacaaccagtggcagcagggtgtaagtaatttcttatgtgctttatgtacattaattgtattttgagttcctaagatttatcagtcttgaaaaagatcttgttcagggattgaagtgtttataagtgttaatagggtaaagtgtgaatcgtcttgcagtagtagccataatctaccttttgaaggcaaaataggttgaagattgctataagttaaatttttttaataaagtaatattatttaatatatacagttcttttactgctagctttaattgtgtaaactaacaaagtcatgatgtttcgttttgtaatgtgtattgataattatgggatattaaaactaaatctggtttggtagaaatcagaggtatgacaggtataaatttgtttccagcaaattactctgaattagattcattgtcatttcctaaaaacagtttgagtggcttattgatgttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatg

SEQ ID NO: 59304 - DNA, 3226 bp, Homo sapiens
ccgctgtattgtgcaaggagcgcaggggctcggcgtgacgtcacttccggcgggaggagccgggcggggcggggcggggggcggaagatcagtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcaggtataggatgctcacctagttttactcatcccttattcgttcgttgatcggaaagctgtatcaggagacaattctgtctttcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcagcagtgggctatcactgggccactagctttcttcagcagcgaatggtatcaatggcagtgcagcactgtaaatactgctactttacccagttgggttgcaattgagtgagaaagtattgcaaacctctaagtgggctttgactgtcagacttgttttttttttttttttttttgttacaaaaaaacgtagttggtttagtgatgagaatgtacaactctgggtgtgataaatagaccaaaggataaaaataactgtttcaaaagtatcagctatggtgtcagcctgctgtgttagatggaaggcattggagcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcagttttaatgtggcactggtaaatctacctggttctggcatgcttcactttgatttcctgctatcctctactgcttgcctctaaatcaaggtaaagagcagagcaggtatgtattaatgtcacattgtcttgattattttaaatacttaaaatatacatgttaaaccttggtattagtttcacaggcagtttacttttcagtacataatttaacaggagtgacttggtgggagtggggctttaaactgaaaattggaacaacagcatgatgtggagaaaagttgtgcagcattaagaagtacatgcaaaaattaagtaaccaagttttgtctacatagcagatatgtttacattggatgtcaaaagtaacacagtatttgatataattacagataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggtaaatgcaattttatgatttgtttgtttgtttgtggagacagtctcactctgttccctaggctggattgccgtggtgcgacctaggctcactgcaacctccgcgtcctgggttcaagcgattctccttgcttcagtctctcaagtagctcggactagaggcacacactaccacacctggctaatttttgtatttttaatagagatggggtttcaccacgtaggccaggctggtcgccaactcttgacctcaggtgatccactgtctcggcgtcccaaagtgctgggattacaggcatgagccactgtgcccagcctttttttttcctttttaaaatagtgacaaggtctcaccatgttgcccaggctggtcttga

SEQ ID NO: 59305 - DNA, 1349 bp, Homo sapiens
agagccgctgcgtgtaacagttgccaatgtatgctataccagtcaaaactgaaatacgatttgaaggagttttaaacgaagagctggagaaacacataagaaggcagatctaagatggaagaaaaggcggattcgggttgaaacgccaagttgaggactgaagaaagcatttggataaagcagcctccaagctgggaaggagaaaagccaaacgagtatagccaccaaagacccagaaaggccaatatatcatgcagtgagtcggttgaactgaaaggcggtttccttttcctccatttgctcagtcccaattggaagcgcactgcgcggcctccaccgcgctctcggcccgggttcggcgtgggggcggggaggtaagtacggtaatgggcggggccgagcgcgggcgcgctccggctttcctcctgcgcagtgctcccgtcagcgcagggggcggggcgcctatattacgtgcgcggcgccgctcctgcgagaggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggcca

SEQ ID NO: 59306 - DNA, 1119 bp, Homo sapiens
gctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagaggg

SEQ ID NO: 59307 - DNA, 1036 bp, Homo sapiens
cgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattt

SEQ ID NO: 59308 - DNA, 1046 bp, Homo sapiens
acagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaa

SEQ ID NO: 59309 - DNA, 1053 bp, Homo sapiens
aggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggat

SEQ ID NO: 59310 - DNA, 1022 bp, Homo sapiens
acctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgt

SEQ ID NO: 59311 - DNA, 1033 bp, Homo sapiens
acggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatct

SEQ ID NO: 59312 - DNA, 1020 bp, Homo sapiens
gactcttttggaattagaccaaatggacccttttaaagatctgctgagttaacaccaccttatatttatatggctgcgttcttcaggccacactgtactgggtcattgccactattttcccacctttctctttacacccctttaaggagtatcatggccagatgtggcgtggtgtctcttaaattcacttaatagacaaaagagaaggacatctctaacagtaatacaagaaaaaaaaagagagagaaggacagagagaccaagaaactctttttttactcctattcagcaactatgtatgtacttatttatttatttatttatttactgagacagaaccttgctctgtcatccgggctggagtgcagtggtgcaatcatagctcgctgtaacctcaaactcctgggctcaaacgatcctctcgccacagcctcccaagtagctgggactgcaggcatgtgccaccacacctggcccctcagcaactatttttacagtatcgactctgtgtcaggcgctgttctaggctctggacgcttgatgagtgtcaccagtgagcttaggacagagctgacgtcttctgcctattctttggctttactccccatagggcttttctggagaagggccctttggagcttgtgggatttcagggtttattgaaatttatttacctttttgcaggtgtctcatgcttcctcggttaaggaatgggaattatcataatgtataccatggtgtctggccacagatgaagtaccacagtcatcagattatgaagcctccaagcttctcttgcagaggactccttcaaaccactctcgtggactgtggctaactgggagtttctcctgggggcccattgctcattccttgctgtctctcccggttgagacttcccaccagggtgaaaagctagaacagtggcttttgtctttagcaaggccattagatggtacagtaactgctttcagatgctgctgatgtggcccagattcagcatagtgacccagaggtgaa

SEQ ID NO: 59313 - DNA, 1085 bp, Homo sapiens
ttttcccatgcgtgagccctctgcagtgtgtggcatgctgatcggcctctggcatgaagagtaaaagcaaggccacataaaaatcacaggtgcccctcgcttcgtgcaacatgtgtgccagtccagtttctgcaacagccccccaggcgctgagcctgctccatgggttgggagatgttagacctcaagctgtgcccctagctgggtgggtatgggaagttacatggcagtgctggctgcattctgcttatcactgaaagaagtggctttggaatgggtgatttcttaaggtgtttccccactcagttcttctgttcatttttgtacattattatctcttcattgttgtacatttgttggagcttagccccaacagtgcctgcctaggtggtgcggactgaggaatagagatggagtaatcatgatatccaatgtcttatctcactggcctccccgccccaccacatcccttcccattggacggtgaggactgaggctccatcgctgaaatgcacacgtgttaccaggcagggttgtgagggccagttcaatgaacataaatacccttgtcagatcagttgtcatgattctagagaataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaaaaaaaaaaaaaaaaggtgagctt

SEQ ID NO: 59314 - DNA, 1238 bp, Homo sapiens
gtaaacctttgggttcataggctttctaactgatgtcatggagtggtgggagggttttgttttcccttatccattaactttattcttaaaataacaatatcactaataacatttatggcatacttgtaagcacttcacatatattctctcacttagcatcatgacaatattctaaggggactgaggcactcagagcttaggaaactcgttcaaggtcacctagctaggaaacgatgtgctgttttcaaggccctcatctgaataaaactatcttccctttactctcagcggtgaaaatgggggagagatctgtattggaagctcattcagatgttgccttcttttgcactcgaaggctttgctctctgaaggcaggaagcagcaggcacgtgtgcagggaaggctgtgtatgtggcatgtgcaggcagcagcagcaacgcgggacgatggggagagagcccaggggagggaggatgcctgcagaagcggctgtgatgtgtgggaagccccgctgggccggcactgtggaaaggtgacctgcagagccacagctgcaaatgaaccactaattttcccatctctgcttgcaatttacaaagcactttcctggtgtcatgagtagctcccaagtatcagagcagggattgaaacttaagttgtttgacgctacactctgatttcctcaccccacctcactgtcttgccagttccaactgtacccctcaggaatttctatcaggagtctgtgtcaacatcagcatgaagctgaagaaggagaaaggaaatggggcaacaaagcacacagatgttcctaaaaagcaaaagcggaagagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggc

SEQ ID NO: 59315 - DNA, 1686 bp, Homo sapiens
gttacacggtggtgatatacgatttcaacatttcagggttgatttggattttctgtactccctgcctggaattttcctgctgtgttgttttgtgctttactgttcaacaagaggaaaataaatctagaaacctgcttaaaaatagacatcctgttttcaattctctatcattaaaagatcttaaaagctagaatttagttctcttcccggtagaaggaaggagttgcgctaaggtcccttcttagaaattagctctagaaatcctaaaattctagctaaccaaccacagtgttcacgggcctaatatcccttacatttttcttgtctgacaggcccagagggctcactgtctgtgagctttcacggggttgttgctatcccccagggttgattgatctgtttattctaagcttgaggccagagctggaagggaggccgtttgttttgggcactgctgagaaaaacagactaatcacctaaataccaccttggggaatgaagttacttgaaaagaaactgaatggagcctgggcttttatttggaatgaggaggcaaacctgggaagctgcatgccgctgaatgatgatgaaaagcacaaagctactgaatgcctctggcttggccgccaaagagaattggtttctgtaagtgtcggagagggaagacccgcattccagagctgcacccctttcttcacatttccggtccctctcccccagctcctgcacaccctgatgctggaccaaggggcctgggcagaggtgggtgtgctgggcgggaaagtacgtcatggatgcctcaacttgccatggatggcaggttgacttccttcccagcaacttgcagatgttcagatgcgcagagttaaggtctaaaacaagaaaagtttgctaacgtagagtggccgctgggtcttatctttccgtcttcaatggccttgaaaaatatggggcacgcatggggatttcacactcttaacaagctaatgtctctaacactacaggttacacttcacctgatttccaggttagtgcagcgcctgacctctctccagaggcaccctcgtttagaagcatagatgatgcaaaaacatggtttctcttctcagttcagattgcctctgttgcaaggactgagaactctgaggagatctaggagatccctaagtatattaggttttaattctgggtcaaatcagcaaatgtttattaagtacacacaacagacagggcactgtaagacaaaacaaatcaatcagtcaacgtcaactcttgtcattgcttggggggtaaaggcaatacaaggaatgactggcaaatacaggtgtgaattccacttaccctcagcaagacgagggaagaagaagattctggaaagggagaattctgccagcaccaacctgatcatccttctgggcatggccaaatgcctccatttttcctctgaggggcttctttgccctgaggaatatacaagttgatagggctacttgccttcttgctcattaatatctgcttggctccggatctgcaggtagagcagtgctggaattatcccagagctgtgttgtgacctctggatgctagcctttccaagcagggactttgctgcgactccctaagttcatagggaaagcagcaaggatgagttcgggagactctggcatatgcatcagagttccagag

SEQ ID NO: 59316 - DNA, 1038 bp, Homo sapiens
caagtgattctcctgcctcaacctcccaagtagctgggattacaggcacgtgccaccatgcctggctaatttttgtaattttagtagagatgggattccgccatgttgcccaggctggtctcaaactgatggcctcaagtgatctgccagccttggcctcccaaagtgctgggattacaggcatgagccaccgcacctggcccctggaacttatttgttagtattcaggctactgaggtgttgcacctgcagactctcaggtggcactcacccattctctctctctgccgagctcccgtgttccatcctttgttcctcagtgtccccacctgttaacgtgttgaatgtaatccccgtgtcttttggataaatcagagaatcccatatcatttgttacttaggatcctgagcattcagttttagctttcacactaaagatagagaaaataaaaatagataccattaatctttacacttctcctgtggtcctgattgccaaccatagtctgaaagatctgcagtggatttattactttgcatgttctttatttcctttaaacccgggcgtgtgaggaacgttgatttatggagcctagatcatgcttggctggggaatgggaggagggaagcaaagtgttgttcaagctgcagtaaatttaaacatcactagtatttctttacacatgcaagggggaaaagtcctaacttaagtccattgctacaggagctcataaattaaaaataacaagactatttcctatacacctggagcttcaaaattacatgccgttaattctttgattgcccccttcacaaaagagccattgagggtgacaactcaaacaagatctccaccacagccgtgaaatccaatcagtgattcaccttgtgtctttgaccttgttcaagataaggaagtgacttgtctgaaacatagactctaagaatttagtcccattatttttttcctcaaacttttccctctcattactctcttctctctctctcctctctcgttttattttttctaattttaca

SEQ ID NO: 59317 - DNA, 1085 bp, Homo sapiens
gcttaatgtgttgtacctcttgcttcttgcatttcctcctttgaatgccccagaccagcttcctcctccctgtgccccaccctctgcttttctttcattctgagttgggcagaataagaaaacctgctttattttttcccgtcgtgatttgattccaggggttcttatcatgcatacatttcttttccctctgattttatatccatatttaaatcatacttgggaagtcacttactagattcctcaagctcatggtagaaactgtttgagatccttgataagcttaatatattcatattaaaattaataggagaggtatattgtttccaactttatgatttgatttaaattcattttatttaatatatgaccacaattctaaaattacttaaaaaaacagatgagattgaaatcaattctggggaccctttctctattactgagttaactgtatgcctgtaatgtggcagacaagctatgctgcttttctcatgtgacatttcgagtctggatgtgggtgtagcaggcaccctccttggaggcttcaaatgagtgctctgtgaaagattatgtgcaggctctttttaaatgctaccattaaaaaaaataaaatttaatggaaagagataagcttttcccaacaccagcctgctccaattttatatttccttaatctgttttatatgctactgcaggaaattaaaccagaattgtcctctctgacatgcgcatgggtgacagatgggagtggtaggagaagggagacacagagctacttgaaacaattgctctcgtttgtcagaaatttattgtaacttttttgggggatggtaatgtgaggggaagccctcctcatcttcctgctgtactgaagggctgtgcccagggccacacagggccctctccgtacatcgttgaggactgtctgccccagctcacccagtgctgaagggctgtgcccagggccacacagggccctctccgtacattgttgaggactgtctgccccagctcacccataggcccaggtgatgttcaagacaaggaccagatgtcctcatcaccaggtgtgaattgcagcttcc

SEQ ID NO: 59318 - DNA, 1040 bp, Homo sapiens
tccgcctgcctcggcctccaaagtgctgggattacaggtgtgagccatcgcacctgtcctgaaaagctcatttaaactgtggttttgtgtgtgtgtgtgtgtgtgtgtgtgtgtgtgtaggcatttccaccagagacaattctgcatatacagcgggggctcagtattctctaagagtaggggtagggggtattggggccagaagaggccaaactgctcatatttggttaaatccaatatggtaaattcttgttgaattgaagtaatacagctcttcacagggtctgaaacagcccatagccggagtcgtgtgcgtcctctttctttggtccacgacaacaccgtattctattctgttctatgtgaaagggtccagtatggattgagttcctcctgcatgtcagacatcatggagaacgcagatggggtgcctgaataaaaagcactataatccagtgagatgataaataaatacacacgtgctcataagaaaggtgtaccatgatggactccacagctgagattcaatcaaagggctttgcggttaaaaggggggtgtggtaggatctagttgggggatgatgaaaactttgtttattcaacaaatatatattgagaggcaatctgctgttccagggctgtgctagtgctgatgctgatgcttcatggaagagcttggaggaggagattagcacctgttctccccgccccacccctcccaaatatcaacgcagagctccaaacttttgtttctcttctctagtgtttatgagggagaccttctagtcctgtcattttttttccctaacacaaaacacattctgaggagctggagaccagtcctgtgtcaattcccctcagtactgcattctcctggattgcaaagctgatttcctttcagtagctcattaacattcacagctagtgtctgcttccactttcgtagtctcctgatgaaatgctgactgcaaaggtgagggctgctgacactgtttgccgtttggtttcttccaggatttttttcccaggaagccatcccg

SEQ ID NO: 59319 - DNA, 1029 bp, Homo sapiens
ggagggaacacattcaaaccaaagcagtagccctgaataacaaaggccttttcctaccctgtgaatgccaaagctgccatctgtaacggaataatgtgattggtaattgtgtcacgtaggaccaatagagatcagcaacctcagccagactgatagagatcctggcatcagatatttcttctccatgtccttttgacttcagatcccagttccctgactttcagcctccctgtaaaatatatcagtaagatcttggtgcttgtgggtctgagttaaagctggtgtgtacatttccttcttttctctgcttgtttaaacccatttcttcttatgcacttattcaccatagaaacaccaaaaacatttttttccaatctaggccaagcattctggaacatgtgattgctagcattatacctgtgaaaggaaaatttatatcacccaaacaagtaaactgccttgttgaatgattttgttgttatgtagtttgcttgtatgtttttgtggaagcgtttctatttctgaatcatggagtcaactcagactccactgcacccccttggatccccagattctgttaaatcagctgcataacctttcttgtaccaagtccttcttttctgttgatattgctgctatcctacctcaagtatttttgcctctagggtctgttttccaattttcttggttttctattgtgataaaatatcttcagccccctttggtagtgcctcactgctggcaaggtaagtccagagttcctagctttgcgcgtgtgtgtctgcacagcctggcctcactgctggcaagagaagtccagagttcctagctttgcacgtgtgtgtgcctctgcacagcctggccttgagtgcacctcccttcccactcccctcctctgctggccggaccagcatgctcactgccctttggcattcagcttcctatcccatcaccagagcaaccatccatcccttcccttgtcccaggatcccatcatcatctccagtggaaacacactcaggctctgcc

SEQ ID NO: 59320 - DNA, 1012 bp, Homo sapiens
tattgatacaattattagctttagcccatttttccaacttgagtttttgtgattttttttttttttttaacaaatcctgattctgctattctttgtgtaaaagaagataactaactttactggttcactttatataccttggctcattaattctttacaataaccctacaaaatcgaaatcattgtcacactttatagatgaagaaatggagagtctgctggattaactaccatggccaagattataagagctcttatcccttcctctgagcttcgtagcagctgcaggtttgataaacatgtcttaaatatcttcatctaaatcatggacttagacttgaatgcctgaagtctgagatatttatgacaagaagtaagtttagttaccgtggctagaaatgatggcctgattccatgccctccaggccagagggatgcactcatcagcgtcttgtgggaacagtttgcaaccacttaacaatccaccttgtcaaatccgatactctgtttattgacactattattgtttttgaaaacacttttgcatataaaagcatcaaacacatttttaaaagtttagctattttaaacatttgtaattggctctagtataatacgtagcacacccagacaaaaataaacttctttaggattgaattctcttaagtggggctgtttatttggcttgtccaccagaaacttgactttaaaagtcaaataagacgtagtcagttctggcccccctgcataatagtatctagagggctgtttcaacccaggattttatgtaatgaacaaagaatttgcagagaattactacaccccacattctgtaatgaaaactgtataaaattcattctacacaattatgtccaactaaccatgagtatgccctgctattagtttctgtttctttgtcatcaggaaggtggtattactctttagccacactggccaagaaaagagtcattgtcagccagcccgaatccttccccaagttcctggggccctg

SEQ ID NO: 59321 - DNA, 1105 bp, Homo sapiens
tgtgtgtatgcatgagtatgtgctttaataagaaagatactgactcagctgggcgcggtgcctcacgcctgtaatcccaacactttgggaggccgagatgggcagatcacaaggacaggagttcaagaccagcctggccaatatgttgaaaccctgtctctactaaaaatacaaaaattacccgagtgtggtggtgggcgcctgtggtcccagctgcttggaagtctgaggcaggagaatccttgaacccgggaggcggaggttgcagtgagccgagattgtgccactccactccagcctgggcgacagagagagactctgtctcaaaaaaaaaaaaaaaaaatactgacttacgtaactggaaagtccagggatatctggcctcaagcctggttggatccagggctcaaaggatccaataggacattgtttctctgcatctctctgttccctcttctgttggcttcaaaatcaggcacatcaaattttagaaattttcttaagctgataggtttgtgtgtttgtcattttccttccagcttttgttaactctagaaataatgattttcctttccttaagaattcccacctaattctagtagttccagaaggcatttctataatgtcgttttgttacataataactttttagcctccacgtggctggggtttgcatttgagttgtcgtccatcttcttcccaccatcattgcactcagagaaaaacctgtagaataccactttccccagccactggggggctttgtgtgtatttaaccatatgaaactgttgacagtcaccattgttgacctgtgaaattggccagttcatacgtgaaattggccagttcatatggttcaacctaaaacaccaggtttgtagtggtaattgtttctcagcaacagcagttgtgtctagaaagctttgcataaattaatgtttttattttgctgttggtttgctcctagcacctctcctgtgccccagtgtgacgaataaacagctggaggcaaatgacagagtgcttgcacatacggcaagccattcataactgaatcccaggtgcaagatgaccatctttcatgtcacagtcagaggtttcggc

SEQ ID NO: 59322 - DNA, 1050 bp, Homo sapiens
tacaaggatgcttagagttctgggaagggagtaaggaggattagcgggggattctgaaacaggtgccctgcctcagggcgccagagtcatgggggtcatccccaggggagggatcaccagtacaaattgctgtacagtgagcctgtctcatacttgagctgcagaatgagttgtaggctcttagttctgagttctgtgacagcctctcccagcctgttgggtgagaggcctcacctagcaagagaggtgatgtttgttccaaagagctgctctaactcgaaggctctgctgccttgtggtagactcccagagtactgcggaaagagacaaggccgcctcctgcccaggcagcaggaagaactgttaaacttggtgaaattggtttctggtggtgaaatggatggtacccaatgagtactacttacctcgtttgtcccctctgaaaccaaaatcttggctccagtggtaaattgggtacctgcatttcagctacctggagggtctctttatcttgggactttgtgaaaatgacaatgagagagaacctgtcatctatgatgaagactcagtacagctaattccaaatctttacaataataagttgtcaaggataatacagagaaacttctgccaccagtctgcagttctgtctcactagggaattgtccctgagcagtgtggccctgggaagctcctctgtgctggcctggccaggatcctcttttcattgtcccctttttgtcctggtcaggcacaattgtgcccgcactaggatgttttctgcgtcttgcctcctaaccacgccaagctttcagcctttacttgggaatctaaacaatgccttcctgacgttgcactccttgttctctctcacctgagtgtttttgtctgtatgaccagctgccacacaaaggaacaacagcagggttctcagggaggggcacttctttggttcacaaagttagaactctactccttcctccttttgaactcactgggcttgggaagaaagcgcctctcctgctttctctgtgggtcccaactgaggtg

SEQ ID NO: 59323 - DNA, 1043 bp, Homo sapiens
agtcgtgagtaggggaggaagctggtatgtaacaaaaaatgtgaccctggacctttgggtccttaagagtccagagctgacatctgctgtcattctggccatgccctgccctgcgtgcggtgccttcgggagcacgtgggtctccctggtgcagtcagctctggaagtaaaacctgggaactttgcccaccccatagtacctgataccctgccagagtttttggtatagtgcagttttatcctggagcaagtttggtactaaatcagagaagtgcttccaattttctttcctcatttggcggtctcactgttttgcctgtcctctcttctgcccaatgagagagcagaaatctctacttaaaggcttccctgaacggttgcccaacaactgaattgaacgacttgtgggaaaaacagatgagagagagtcaacaaggtggaagttggaactgtgagagcttcttgaatgagtatctgtgaatattgtccatatggctgaatttggtaaatcctgctgagactgttgacatgaatgggagctttgcctgaacaatgcatttggcccaggaaatcgcagtagtgcgcggcgctgacttcagatgtttggggttaaaggaggatgtgcccttctttcatttcatcgccttcccaaggtgcacttctccagggacggatgcctggagccttagaaaagagagagagagagcgagagcgagcaagcacgagcgcgcgtgtgtgtgtgcacacgcacgtgtggcagagagcaagaaagcttgggggaagggcagagaagcagggacagagaaggagaaatggattttgcaatcgtcctgaacaatgtagaagagatgaatcaggtcctctaaatgccattcctgttactggtcacattccttttgtacttttttatccagctctattcctctgaagccaatggcctctatcttactatatttcacaccaaagaactgagcactccctcgtcagggcccttgtgcctgtgggaggcagaaaaagaatgtcataattagggaggcagagac

SEQ ID NO: 59324 - DNA, 1021 bp, Homo sapiens
cagtgtgaatatacttaatagtactgaactgtacaccttaaaacctagtggcacaaatacatgatgcatattcttccatttttatttaacaaatatttaattaaatacaacatagaaagcagatgctaggtactagatgtaggagcagagatagatgattaaggcagaggaggtctttgccttcataggaaggtcgtttaggagaaaatgacgtggagttttcgtagagtgacttcaattctagacccagatacgtcattactcaggcagtgaccttgggcaagttacttaattcttctaaactttagatttctgtagatgtaaaataggaataattagtatctgtctcacagattgtcataggaattaaagaaaaatgtatttagaataatgacacatgttcagcatgctcagtgaagttctgtttcttgctgtgctcatcaattcctctctcacaggggcttccagactcatggaacaggtaggagaaagccctacccacaacaaagcccacaaaggcatttttaaaagctgaacagagagggggacaagatgcccagggagggccacgcatggcctcggcccgcctagtgagccccttccagcctgaagacacagaagccctccgcccacctagtgagcccctttccagcctgaagacagagaagcaggccagatagaggggccgcctgtcaatctcatcccaggtggaggggccgcttgccaatctcatcccagtaacttcccccgtagtagtttcctctagatatgagactcaggaacaactgaagagggacttaaaccacaagccgaaggtgtggagccatctagaggagcttgttgggagccgttgtgggtttccaaatctaagagaacgtagggagatggaaaaagcttcccaagagtgatggctgacacacgctggcaaagattacagggagaggtggtggaatttcttcctttaatgtctgtcttaaggcaaagctgcattctcacgtgtctgggtggctgttatggggtc

SEQ ID NO: 59325 - DNA, 1053 bp, Homo sapiens
catgagaacaaactgctgagatcatcttccactagttctcagtatatcttcatactatgttatgtacaatcttttttgacatgtaattcatataacatataattactcatttaaagtgtactactcagtggcttttagcatatttacagagttctgcaatcatcaccacaatcaattttagaacatttttatcacccccaaagaaaccccatactcattagtcataccccatctccccagccccccagtccctagataaccattaatctgctatttatctagatttgcctattctagacagtttatataaatggaattataaaatatttgcttttttgtggctgacttatttcacttagcatagtttcaaggttcatgcatgttgtggcatgtatcagtattttctttttttgccaagtaatattttatgaatgttgcatatttatctatcaagtgatggacatttgggctctttctactttttagctattaagaataatgctgtgaacatgtgtgcacaagtttttatatagaaatatattttaatttttttcaagtgtatatctagagtggaattaccagatcatatggtaagtatgcaattaatattttgaggaactgccaaactgctttccaaagtgggtgcataattttacattcccaccagtaatatatgagagtaatacggagagtacctctccatatctttgctaccacttgttattacatgtcttcttgattttagccattttagtggatgggcggtagtatctcactgtggtttcaatttgaatttgcctgttgtctcatccgtgaaagggccctagtgtggaacctcaggagaatggaaactccccctgctgtgtttaatcttatatccctagggcctagaatagtgcccagtgtacaataggctcccaataaatacttgttgattgattaaatattcaatacttccattatttaatccctagaattaagttagcttcttataggttagttataaggtgttctgaaaccatataagtgaacttttcatactatctcacatta

SEQ ID NO: 59326 - DNA, 1034 bp, Homo sapiens
gaagccaagttatccacttaaaggttgaattcccggggctctgctcagggcgtgcttgtcgttttgctttgccttgtcaaggtttcatcaacactggtgacacaaaatgagacattgaagccatcactgaaaccgagtcgggacattgctgtgagtgtaggaccagtcccctgctgccagtgagtgctctctgagttctacttccttataagagcaggtacaagccctgaagaatggatgccacaagcaaggccagctttcatctgtcagcagcttcacatgtttaggacggtccactgactagaaatacgcatcctagagaggtgcccagcagcggatggaacacacaaaccccaaccgactcggagcatttgtgccttaggtggcctttggctgagcctggaattaaccttcataaacacagactcctctctcaagaacttgccttgcacgaagacggctccctatggccagccctgaatgtgctattgtgagtgcatggtcagttcaggaccgcacggaggatgggaaggccagtggctatgcgaggggagcacagggatgcgggttttcagactcgtttgaaatcagcttcagtttctcctcagctcaactgaaaccaggctgtcttggactgtatcatagcactggcttcattttctctcatcctcttcaagctcctgcttctgtttatatccagctgaaactctcatccttctctcctggccacagaagtagttaaaataaccaaattgccaatgattcgtttttgccaaaggatatttttcgatcttggagacgtctatgagggtcagatgggtggctaatgtttggtaggagttgggagttgaggtgggggttcttggttctggcaggaatgagcctttgttgtctctcgaccctctctgagagcagagagagcattaactagcaaagcaagttttcgctgtcctcttaattcctgcccacaggcactgttaacgctaacaagtcacgtcgacggagaacagaaggaagaccagccatgataatgt

SEQ ID NO: 59327 - DNA, 1065 bp, Homo sapiens
tcctttgctttcttgctcttgcgttctttttctctccctccttccttcccttcctggatgctgtcctcattcttcctcacagtcttgtccacagcgtggtgagacagatggcttccagcagcttcttcccccccaccccattcatgttctgctatctgtataacaaaagaaaaagttctattccctccagctccagatttaaaaactgtgtatttgggatggatggctttggcctttgtgggtctcacacccaaccctgcctggaccgagggagatgaggtgctggcagccctgccaaaaatgcaggtttgaaatgggacagacattcttgaaaacctaggagggtgggtgaactctggacaaaccagaagaatagatgtccactgtactattccactcagaaatagtctaataaacatttcagatagaaaacgactcaaagatggtaaagagaatccaataaaaagactgatgaaaggacaattacatgagagagaaggaagcagcagctctccgccattatgttatgcactggggattgagctttgcaagagcaggttcttagaatttccaagggaacagcaggacccacttggaccagagcacaagccagccatttaggaggaagtctgagagctggaaaaggaaaagatggatctctagaaagcagctgaggtcctacctggagcaaagaaattatgtcaggacctgatgtacctgatggcagtgtgtgacatactctatggaggttctccagttcccctgtgtgctatctccttctggctacaggcattaagtaatatagccagaatgctacaaaatgtagcatttattttggaaatgctacagaaacagtgcaccttgatatcagcaaggcatttgatagtgtctcctggcacatttcctatggatggaaaaataggagttagtgaggttaatttataccttttaaatagctatttctgaaccatagtctttcacagattgatagacccctttggggaaatacgcagtggggtatatgcctcaaagctcagtgtttttttggtcttaatggttctcatt

SEQ ID NO: 59328 - DNA, 1015 bp, Homo sapiens
cgggtgcttccctcgctcctgtgcttgggagctctttagccttttagagaatctaattttgtttgtttttttcttgatgaagacaatgaatccttaactaaggttaataacagagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggcaagtcccagggagagggctgacataagggctaggacgtcttcacgttgggcaaaggatccatgttgtgaagtcattctgattactactttgcatggagcatttccagctgcttctcaaccattgtttaaaaccaagtcttattttattcactcctcttgttcattcacttatgcattcattcatcatttgtaaagttccttccatgtgtcagacaccgtgggtgtacagaaactaattagatgctgtctctatctggagcagatgattacaatacgatgtggcgcttgcagtgacaaagacgggctcagggtggtgggggagctgtagaggaacgcaggctcagacctagcttgagaggctgtgtcatgagcctctgctggtccaggtgaggatggccatatggggcccttggtctggctgacagtaagaatggtcctttatctctctcaggatttatgctttcagttgaatcatttgccttcataatcaccttgtgagccagggaggacagcagggagacggccctgcctcagcttctccttgagtcaggtgaaggaactataggtaattgcttcttgactgatctcagctcctggagaccagtaggtgttttgccctgagatgtttttataactcagaaaagcattgaagggggtagtgttgaactgctgagagttaggcgctggtggatgctgcaccctgatttgcagtcggctgagaacat

SEQ ID NO: 59329 - DNA, 1130 bp, Homo sapiens
tttcttctcccataaccactaacatctctaggaaagagtagcttagaatccttatcattcagtgccattgaccgtcagacccagaagcttcatattaaaccagccacgactacaatggcagtggggattgctgcacgacacattttctcagcatgaatagtaatgaccacaggtggaccaaagttcagagtaaggagagaccatgtaggatgaaggtcatctgggaaggctccactaatgttttactgtgcaagatagcctgagtcaggggcaggatttggataggccaaggctgagaaggaggccgctcctggtagaggagttcattggagtgaagctgtgatgaagggaaacagcaggcaagaaggaagagatcaaggtggatgaaaagactgcaaaaggtcattcagaggctctggggtaaatttatatcccaggcactaagaacatagcagatgaggtttccaatttgctgacgatgctatttaaagagttgtaaagagccagagaaggaggtagagggaggtttccagttttaaaggtgaaggacataattttgaatcaatagcccactgagtttattagcagtcttgggtaaagaatctaggattggttactaaggaatggaaaagaaagctgtgatcatcacagtgctgcctggtttctccaagagcgaatgaatccacagagtcacagctttctttggtaaagtttgtatcgagactttagaaagggatttgacgaaaagtaatcaagaaacttacattagatgttagcaaagctaactgaatagctacactgaaaaaatgatgttacatgattcagtgtcattctggagtgttgtttttccatctcgggcctctttaatgcataattccatacctcgaatgaagatacagaggacaggtttatcaaatctccaaagtgacgtagatggggaggataatagaggtgggatgatagaatcagtatctcgaaagaaaaaaaagagttcaaaagatctctaaatgtttaaatggtatccaagttttaaagacatgaaatataacaagaacatatataaaatttctattcggatcaaaaagttcaaatatgtaaatatgcataagaacatgtgaaaaaaatttagg

SEQ ID NO: 59330 - DNA, 1067 bp, Homo sapiens
gagcctctaaggaaaagcagcctctgaacagcaagtaactgcagacctagtagggcagcagagggccggggagctgccccgtctccgcagcgccgccctgccatgcatgagtgaaccagaagcacccaacagcgtggcctccccaaggacctctttctcttctctgctactggccttcctgcttgtctctccttgtctaatgcttccatagcctccaagcctgaactcatgcatcctcttctccgggacattttccctaaatcccggccaggcagagggctctgcctctgtgctcccatagcctccaagcctgcactcatgcatcctcttctccaggacattttccctaaatcctggccaggcagagggctctgcctctatgctcccatagccccagggcttacctctctgttatcacgtgcggtatttagaaatgatacatttgtttggccgtttcaaccactggaatgtaagctgaggccacatctcagctgtgtcttctcagatccagtacctggccctggagtgcactggggagatgttgtcatatattgagctaaagagcacctgaagggcatgagatttattccccgtagtgccacagacttggtcacttttgtgtctattgtaaataaactatttgtgcaaaagcagagaacatgggagacagaactgtagattgagcagacaagaaaaaagaaaagcaaaaccatcaatacttgcagcaagtcttaaccatgtcggcacgaagagtgacagcatgatcgcagagattcggagcaatggctgaggcggcaaaggccacgctgatggtccttggcccagactgtgcattggaatcacctggggagcttagaaaagataccggtatctgcctgcccccaagagatgctgatatcatttgcctcgatggaacccggtctgtattcttaacagctcctgaggtgattctaagtatatacccaccttaccttactaggcccttacagcaaagaggagagacaaagctggaggaacaacaggtctgcagtttgagggaaagtcggagccctcagtatcccttaaag

SEQ ID NO: 59331 - DNA, 1050 bp, Homo sapiens
gtggacaactggagatttcttgcttaccttttccctacaatggggagcctttcctggctctgagccaatcccggctgagactgctgcttatcttccctctttctctgtgccttggagagtccctgtcccttttgtgctgaattccattgttccctcttagatgctctgtttaacctgtggttatctgctgactgttttccttctttttggtggaggagatgagtgccagctgcctctagtcagccatcttgatgatgtctctctgtttctttaacatttgctccataaggcttttccactgcagcacattattagattgagatcacttatgtaacaacttttactctgagaaaggagagacaaagtaaatgccatgaagataatgaatggacttttcttctgttactcatatacctttttcatgttggacctacttatttttaggtccaatatgaaatatttcacataatcagattgtctaaagaaatcttactttggaagaatgtttacctcactagaattctttcgtaattgttatctttcttggtctgagtaattataagtaaattaggaagtgaaactcggaaaggttcagagatatgcctctgagacttatcccaggacttacccctgggacttaaaggaaaaagtggcaaaaccaagtctgacacccagatgtcatgactaaacctaatgctcctgccagtataccacaactcactgtaactcccattggcaacatgaatcaagagaggtagttgctctcactgcatgagaaaggaccctgagctcattctaatgctgcaggagtccatgaacatgatccattttgccttaagaagaacttttgaaaataagggaattaagtgggaaaagttgaatattctaatagctcctgaagattcaatctactttattgttagccttttgccacaggcaagaatgacagaaatcatgggaaactgccctgggattcctcccagaccatgatctggaatgttagcaaggtagctttccaccagcatccttggttggaaatgagaaggctct

SEQ ID NO: 59332 - DNA, 1011 bp, Homo sapiens
cagaaacaacaggtagaagagaaggatgatttaggcctccagtttggagagtaattagtgacttgtctgcttttccttccttagtcatcttgagcacttgcagctgtgcatcttcctttgtgcctgatgcaagctgatattttagggtgaaagggtgagaaggaaatttagattcaaagtgctgacaagataaagtacattctgtaaagattcattccccttaaaattggagttcttaccgagatatcttcacttagcagactgatgtcaggaaagtaaaaaatggaagggaactttgtggttgaaaattatgttcctagaaatgagggttgaccctgtttctatgagaagagagagcatgtgcggctctgctgatgggtacagagaagtgcctttgtggtagcgcccaagggagaatgcagagtagaccaccatctctactctgattgttttcaattctttctcagatgcctacaaacatttaaaccttgtctgactctgccttcccttggtagttttaaggcatatggaagaatttcaacaaactgaattgatttgggggagaaggaggttagatttttttttaaatgttgccattttaaggagctagataatatacaagagacctttggccttcggccttcctgtggaataggtcccgagggagttatgaacttccaaatgtgaaaatgcctatgtaattatttttctctctgtgaaaaatgcaaagtatatctgaaaaagttaagtaattcctctagatgtgtaacgattctataaattcaggattaaagtaatttataaggctaatttatgccatttatttatttatttatttatttagagacagagtctggtttctgtcacccaggctggagtgcagtggcatggtctcagctcactgcaacctccacctcccaggctcaagtgatcctcccacctcagcctcctcagtagctgggactataggcacacactaccacacctgactaatttttgtgtctttttttc

SEQ ID NO: 59333 - DNA, 1035 bp, Homo sapiens
ttctagccactgaagagtcattaattattgtggttcattctcacagcaaacccgtgttgattttcattgatcccaggctctcaatttaaataagaaagctagcaaagttattttcttttgcctccccttctggcttaacaaagagaactcagaagtacttacgttttgagaaaatagagacccatttaaatagtgttaccagagtgacacattattaactaagaaaatcagaattacatactttttagaggttgcctccacaggacacagtggtaatctctgaagcctggaggtctcatagccctatgatgcagaatattatcaatgataggaagagaaagcattgcctccttaacagtgtacggaggcatcttccaccagcactgggaactaagcctccactgatgaacggcacaggagaaagacacagacctgagaaggctgaaatttacaacgcgggaaagacgagggcagcacagaattattaaatggaatatgggaaacgcgtggtttgtgtctacagtccacacttgcaacacaggtaccattgtgtccattgtatagaggagaaaactcagttccagaagacttgagtaacttgccccgagtcacaagattcaaagatgccagaccagggagctaaatccatgaatatctggctttaaagtccttgccttttctttacctcacagtggtttacatgaggtgcattgttactcgtacactgaatttccttcactacctgcctttttcaatataaggtgaattctgcatcattttgttgaaatggaaagttctaaccattattgttttaatataggaggcacttgggccttgaaggagagttgtcattccagtagtctggtaaagggcatttcagatggaagacacagcctaggcaaaggcactgaggtgagaacgctgcagcttagtcagggaatggagaatagattcatttgaggagaactgagtgtctcagtagatgggggttatatcatgagaaggacgtgagagcctcagcatggagctggtgag

SEQ ID NO: 59334 - DNA, 1036 bp, Homo sapiens
gttcagttatagtgaggcatcagtggtgcccgagacatggcaagatcagcagtgactataggtgactagactctgtacagcgtagtgtttgcttcagactctgcaaagctgggctttggagtttgaatcttttactcactgaccaggtatgtagctgtggacaagtttcttaatcttcctaaatctgagattcctcaactgtaaggcaggatttgttagcctccttcacagagttgttttaagtgttagtgatcatgtaagcaaagggcctcccacaaagcagcatctggttaaatgacagctgctatttttaaaaaaataaacccaccaaccatgaattgagtgactgctatgtaccaggcaccaaggtaggctccagagatttagagataaaaggtagagtccctgcggccttcaagggacatccccgttagtggggatgtttcagagagaacaacctaagctcaggttttccctcaggaagaagaatgcgttctaaccagacgagagcgtgtgcgttctcttaatagattgtataaactgaaattgtgcaatagccagtttgggtgcaatgagctactcaaatgacacattgatttttttttttaattatactttaagttctgggatatgtgtgcagaacagtgcagctttgttacataggtatacacgtgccatggtggtttgctgcacccatcaacccgtcatctacattaggtatttcttctaatgctatctctcccctagccccacctccagacaggccttggtgtgtgatgttccactccctgtgtccacgtgttctcattgtgcaactcccacttaagagtgagaacatgtggtgtttggttttcttttcctatgttagtttactgagaatgatggtttccagcttcatccatgtccctgcaaaggacacgaacttatccttttttatggctgcatagtattctgtggtgtatatgtgccacattttctgtatctagtctatcactaatggacatttagattggttgcaagtctttgctattgtgaa

SEQ ID NO: 59335 - DNA, 1097 bp, Homo sapiens
agacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttccctgggccggagacgatggctttaggaggttggcataggagatgtaggagatgggaaaaatgaaatagattcaagatacattctggggtcagaattgtcatgactctgatagactggatgacatggattggggagaaatgggggaaggttttataatactgctcatgtattagagaaaaataaatactgtcatctctcagatgggaatgaatcttcccatctaaggagtaggtttgggggcagaacttagtcatattaaatttgaaaaatgtcatttaaagagagattttttctcattgaaaaatcatcttccagtacacaagtgtcagagtgaggatactcacagtgggagtggctttgagagaggtgggaagaggaaaggagggtgcctgaacagatagtggcatctgttagcaagtcagggtctggaggaagggcagcctgatttagtttgtgacttgattgaaactgtttagacctataagcataggtattaatgatgatgattttgttaaaatgcaaaagtctattttacaaaatgactctcatatgagaaaatactctgaaattgaatttaacatccaggaagtcctatcatatttaaaatttatttttctggacatttacgtttccgaatgacttggtgagaaataggtctgtgagtgactcactgaaccccccaaaaaagtactcatataggtagatttcctcgtgccgatcaaaagacgttattaagggaagtgttctttagccatggctaactgggacatttgttcttgagttgggatggtctgatgctccttggacagtgtctggttacaagagcaactgatgggtgcacta

SEQ ID NO: 59336 - DNA, 1021 bp, Homo sapiens
agcaggcatccccttagcactgtgtgctgttggcactacctgtcctaaaacctcaatatttatttggcctcatgtttattctttgcagacttattgagcacctactataaatcaggtaggtcatcgtctagataggtctgacccagataaacaaggtttctgtcctcttcaagcttaattttaagtgtaatcacagtgggatactccaagttagggatcaacagacctctctctaaagggtcagatagtgaatgatttaggctttctgggctataccgtctttcttagaactgctttactctgccttgtagctcaaaagcagccataagcaatacataactggaaaggcagggacgagtaccaacaaaacttgatttacaaaaacagtggccgaggtaccatgggctgtagtttgttgactgctagtctagacaatgccaatccactgagacagaatccatatcatacagtctggagtagggatttgtttcccagactgcaaagcagctttccagtcaacgtcggcagccatagagaataagtgcatttctcagcatttgctgcctgttgcagagttactgacagctgcatttgtcatgttcttgaattattttttccaccttggtttaataggtttcccaaaaagcctcagtgaggaagcatcaccctaatttgttctacatgtcatgtgtgtgataagcagaaaggaaacagacaaactcagaccttgaaactggaatgaagcatttaattcctgctcccatgctagcttggcagagttgagcaatacatctacagacgtccttccaacacaatgacttcgttgccctctgtgtggcctcttacctggtgctgggctctagggttgatgtaggacttgggtcctgccctcagggatctcacatcacaggagtggagtcgatgaagtacattcctgccttcattcccgaggcatgtctgactacctgccacacatgtgcaaggagagcaaaagtgaccaaggcctggaccccgtcctagg

SEQ ID NO: 59337 - DNA, 1232 bp, Homo sapiens
aagaagcagcattttgatgtgtttagtttttaggggaaataatgaatttgctgtaactagtcattaattttctttttctattttctttccttttgatgaaaatgcatttatattaattctaatatgggaacacaacccccatggggtgaaagagtctgaaaagttataactgaaaacaatgtcccgaaagctgccacaaaataaggccagggagatgaggcatcttgtctctgtgaagaccttcagtatgaggtcttctcagctggtagcatggggggaaagatcacgttggaagtcatctaccatcatgcagagccccagctccttgctatggaagggtagattggactttttagatctaagaaccttttttccactcagtaccttgagcatttgcgttgataaatgtttggtttctgacagcagtcttggattcaactgtataagggaacctttgaatttgaaccgctttgcaagtgtttcttgtttcgtgtaaagaatgcttggccacatctccaaaggtgtggctacgaaagaaataaggaaatcctacctctaaatggaatataacagtcctcaaagcgaacccagtgagtcaattcttgtctgagtttttgcttattctatggagtaaatagattttgttaatattgtaaacacagtttagtggaatatgcaatgtttccgtagttccttgattttattattgggaatatgaattaaatacaaattaagtgggtttagaaggggattagtaaaaaacaaaacaaaacctgaattagaaaatgttactttaagatttatttgatggaagtatttagcctataagtgagcctttactattatattagatcaactctcagactgacattttgattgtttcacatttgatcagaaattgagactataggatgctacttctatttaaatataaatgtgggacagatgtagtgactgacatctgtaatcccagcactttgggaagcccaggtaggacacttgtttgaacccaggagtttgagaccagcctgggcaacatagtgagacttcatctctacaaaaaactattagccagctgcagtggctcatgctggtcccagttactccagaggctgagaccagaggatcacttaagcccagaaggtggaggctgcaatgagctgtgatcatgctaccgcactccagcctgggtgacagaacaagatcctgtctcaaaaactcgaaatgtgatt

SEQ ID NO: 59338 - DNA, 1102 bp, Homo sapiens
ggtgggcaagtatctgttgagtcgctgctttcgtttgctttgggcatataccgagaagcagaattgctagatcgtttggtagtttaactttttcaggagcatccagactgctttccacagcagctgcaggagtttgcatccccaccagcaatgcacgaggattccagtttctctacatcctcaccaatatttacttttcatttcttttgtaatagccctcctaatgggatgggcatgtggttgtcacatggaaatattggctagtaaataaaaggaggaaaaattgaaaattgaagaatcaaacggtgcttcagacatgagtccctagtcaggtcactgacttagaattatttattcagcaagaatcatgtctctgtaggagctatcacgttccaaaacctctgggagctcagaaaatgaagtttcattgtactctttacccagggttaaagatctccattccctccccaagggtgggtaagagatgagtggggtgccaccgaagcaggggctgatagcaggaagatacttccttatctttatttcttttgatgaagcactgtgagccaagcctcagaggagccagcctgtgactgtacattttggaatctgtctgctcacaggtgttggcaggccctggtcctggtccagcacagcgttttccctggaggaatgccatgctttgaatttccttgtctacagactgtgttattgtccagcctctcagtgggatcagaaagaggttggtttgtctggcaattgccagaacagtgcctatccgtgacctcttgtctgagcatctgccagagaaagctgtgatctctccagggaagtgtagggcttgaagacacacttagcaatggctgatctttctcccagcagttctgatcactccctgaccatcctcacatcctgcctttgtccttccccctttgtcctaaagtgctgtccgctgccgtgactgtgtcttgtttccctggtggtggtggaggtgctgaggtctggggaagggttgggaatcacgatggtgggtgcagggcttgctcctctgtgtaactgcatagcctgctggcctggagaaagtcctttcctgcacagcact

SEQ ID NO: 59339 - DNA, 1116 bp, Homo sapiens
cagaaccagagctggaaaccagagctggaagactggcggccggagaatctgtcaaaatctcttgttctgaacaaaggaaagagatccagaggatcccaggtctctttctggccagtttaatgctcttctctgagtagctgccagctcccaaaaggcagagcattgatattcaaagaaaggaaccatctgtgaatgttatttactgtagggtctgcaattctgaaaattatcagccagggcaatgacccctgtttgactatcatttgtagttcaaaaagaggatcatggaaaacatttaaactattttctgtcttccccataaaatgttagtcatttatgtataggattattattgtttccgtcttcaaaccacagctcgcagagccagcgaccacatgatgagaaacagccatgcttcttagattttggcaagggtggctaatgtaaaaacggcccatctccaaaacatgatggatgccacataccccatggtttccaggatgaagccagacactgtctcttccatagtacctggagcaaggagaaactttcaaaaacatctgcaccctataaggttgaagatgggttggcaagaggaggacgtgcttgtgggaatcatacttgtaggtaggcagacgtgtttggacttgcctggcatatttttctccttggagcaattcatcttctcttgacataaaactttctcactagtcagaagcaacactttccgagatgtcatttaattcacactaacaaattacaaggaacttcaggtgaataggtgggaaggcagcgtttggagctagcccgataggatcctaaatatggttctgtctgttggccttagagtatcatttgcatcagtctcgtttccctcctcgtcgggggcgcaggacagcggcctcatttcgtaagacttgagtgaagtggtgtaaatgggctgataattggtgggcttcttcttaccatcacagaactttagaaattaaggaaaaccttactcggacaaaataaagcagtctctaagttagctagactttcgatctatgtggaatgtagaaatgtgatcttctgtttccaaacactccatatgtcataagtcaagatgtggcttta

SEQ ID NO: 59340 - DNA, 2722 bp, Homo sapiens
gcttgggaacaattaggttctcaaactccacatctcatatggaggccaattgaagatgaacatctttaaatgtcaagaggtgtgtgttctggcctgtaaccacggctccatatgtgtgctggttctgacaggggccctaaattcagtgacgacgtctggtaatgattgagagtgactgctgactggaggtttgaaggacctggcttcccccactttttctttctttatcccttttgcagttttcataggattctctgtttgtgagaggattctgcagtaagcaggtacttgtgttttgcttttataacatcactgtaagcgtgcccctttacatgcttaaactatgcccatatgactctctgcagaaaactggacctgtttcctaggccctgctgtattccagctgagaggaggcataggacataccaagggagttttgatttgcttatcctcacatcctctaatttaatgggtagccctttatagagacaggtgactatccgcattttagatgagcaaaccaatgttcagggaagttgcccaaggtcagagagctagttaattgagaaaccaggattgaaaatcaaatccagttccaagtacagcgttggctccaccatatgtgatggtcttccagctgtaagcgtttgctttgctactgtgagaaacatttatacttgtctgctgagtcatagggcaatgggaatatttttggcttgctctatctggctaattaagcaatggcagtaagataggcagagcccacatttttgaggtttttctttgtaaccaacattcttcatgtaatgtttcccccttaaaatgttaaaattaggccagtcccagtggctcatgcatataataccagcactttgggaggccaagatgggcagatggcctgagcgcaggagtttgagaccagcatgggcaacatggagaaactccatctctagaaaaaaatacaaaaaaattagccaggcatggtggtgcacgcctgtagtcccagctactcgggaggccgaggtgggaggatcagctgagtccaaggaggttgaggctgcagcgagtcatgattgcaccactgctctccaacctgggtgacagagtgagacgctgtctcaaaaaaaaaattattatcccttattcttttatttcttatagtgtctgtagcatataggcctccccagggaacagtgctgtccattttctgggttgccctgcctcaacacaactctccagaccaccctctgtctggcctcaaccctacgtaaccctttgtgtgcacatacattccctgggctcccaaggatagagcctcttgcatgaggaagctggatgaaagcctggaaaggttattttgtttaaattcttaccttgaagttcctttggtgagggagccagcctggaaatcattccagaacagtcgtgtttcatagttacagtgtaatcgggaggctgtcattcatggccattaaattgcttcctttgaagtataagaaaaaccaggacaacttttatggccctttaacccacaggattgtagtacacatgaatgaaagtcaagtgtgttgtggactcttgcaggtactgtggctggcagaattccatcttcaccctggtgctcattcattggttgactttcaagtgaaaactggggtgagcggtatcagaatcttggaaggcttttcttctctctcttttttgcatttttataaaacaaatcagaaatgaggagtcttattttgtagcttgactaaaaatgagaattattatttctctggtagatctctttggggctgggcagcaccttctagatgttagcactgtgctggccattttgcgtaccgatttccatttaatcctcacagcaatcctatgaagtcggtaggctcattcccattttacagataggagacaggcttgagaaggccccttagtaagtggcggtgcccgaattccaatcgaggtctgagccaaagcatgtggttttgctcccatgccctgtggcttcccagaactcatacctgagcttatataacagaggaacattggtggagccccaagtcgtgggtcccagtatctctaggataatcacttgtgtaataaatcacttagatttacacgactgtattatattttgttcttaagagaatcacatgggaaaactgtggagaaagaaaggcaacaaagtaaatattagtgtttaatgactagatgtgtgagatatttatattacatattataataaatttaatgcttcatgacattgatctgtatgtaatttaaagagatgctcaaaattcagatcattggaataataagcaaggtagttttacattgctgaaaaaggtacatctaaaggcaatgtatttcttattgaaaattttgttgatagctgagccgttcaaaatggggtgggaagagataaaaaggaatggggagggaatctttcagtatgtggattgtaaagttactctacaattgttctgagaggagataatccataggacgtaacaatgtgtgaacttcagctgtccatattcctcaataatatatcctgtcacctgtatttattgcctggaattgttgcaagacggaattagtcctaaaagagtttgattaggtcatgataagtcccaccgctccaccagatggcgctgtggtagcatagctacacctgatgcccctgccagaggtttgagaagcagatgacaaccttctg

SEQ ID NO: 59341 - DNA, 1043 bp, Homo sapiens
gtgttcagtttgtgtagtggagcaagcgtaaacttagcaagataaggagtttgtgtgtgatcatgcagatttcagtgagttatcaatccactttaatgctagagccagtgcccctccacccatattaattagttatgccattctcctatgtgaattaccatggcataagttagtggttttaacagagttaatgaactctgttgagatagctgggtcagaaggcagctaactaagagggagcttgcactggggcctttgtaagtaggaattcccactcacagcatcgacagtggtctaggtgatttttaaattctcctcctttttatgtcctttttctaaattttacaggcacataggccaaacctgtagtgttcactttctgaccatgaaaaaccgttatgaataatgttcactttctgaccatgctaaaccattatgagtaaactttaagtcatcttattgaggattgacaccagctgatgattcctatattggtatttaaaattccagaaagtcaaagctcaggcagaatagtaaaagaaaatgaaataatatgaagtcccagagaggaggaaggtggtgtttgaggagtgtttttcaacctttggcaatttcttcagctcttagggccttgatttccccatctatgaaatggggaattcagatcacaaaagttttgaggttccttctgcctatcattttgttgatgtatttgaaacttatcttgctaatacaccattagatctctaaatttgtaatacgatttaaaatgtagatttctagtcccaatgtggtgctagacttcgctcttcctgggccgcatatggggacaagatgacgtcttcagccgtcttcaaaccctgtgactctggaagcatgttatatgtccttcctatgtaagaaagtatccaagttttcctaggagactgtcaaactaggataagcacacctttccttggggaaacaccatctttccttaaccttctttagcttaatgtttttgatattcagcacatactatctaaatagatgacgcagatatc

SEQ ID NO: 59342 - DNA, 1144 bp, Homo sapiens
agagctactaatctgtactccatttctctaatgttgccatttcaagaaagttgtataaatagaaaatgcagtgtgtaaccttctgggtttttttttcacttaggataataactctccagagatttatccaggttgttgcccttatccctagttttttttttattaccaattagtattccatggtgtggatggaccacagtttaacctttcaccctttgaaggacatctgtgttgcttccagttttttattactataaataaagttgctgtaaacattcatgcactggttttatgggaacatggtttttcatgtctttgggataaatgctcaggaatgcaaattgctcggttgtatgctagttgcatatttagcaggtttagcttgcaacttgcagcgatccctaaagcattcatgattatcattcttattatatacatttgaggaaattaaagcctagagtagttagttcacatacccaaaattacataactagttaagtagtggagccagtacttgaacccatgtctgcctgaactctccaaatctacatcttttccagtgaggactctgctaaagtatataaccttttacatgtatcagtgtttggaatggaaactaacggttctgttttcacctgaccttgaatcactaaaaatgagaagatgatttcatagtcacaatattgtatctgatttttttcctcaaaagagcagaaagcaaatatgagtacagaagacaccaaagttcatggtagaaattatcaaattaggattcctagcatttgaatgcgagggaatggagctttatgatcccatctttggtgagaggttgttgctcagtgaatcaagggcagagccaggactcggatatgagctctccatcccgttctgtctggctgccatctgtctctccttcagtgctagggcaggcagctcatggctggtaatgctcagaaatgcagatactatcaattattggtgtgttagcggcaaatatgtgggtagaggagggggagagtgagagattcccaggtgttaggtgacctgatcatgacaggtactgaaactctgaggccatttatggttatgagatgcactgtggggaattgcagccccttcctgtaatctacagggttatttctgg

SEQ ID NO: 59343 - DNA, 1008 bp, Homo sapiens
cattttcgtgagaaaaaagataagcggcagcacttgcgtttgtggtggcgaagcacaagtatttaatttctgaataagctgtgatggtggggtgtctgtgccaggaagcttgaatccgggtcatgttcctacttattgaacccctccggagctacataaatcctcttctgttttcatctttgttgttattaatatcccggttgtatatgtaatacaggaaatatccaaaacagcccaatattaattgcaaaccacgtgttagaatacagctatttgaaaagtgaatgctatttctgtttcatgataggatcttgtaaggttgactgaataaatacagtttaatactagccgggagaaatgtcttacttaattctattacatcacagatcatgtcggacgttaactgtaacttacgctaagacaatggtactaatcaatgctgcgttaatgttgttacttttctagtacttgaaataagcttgggcttagccactcttcttctcatatcccttttgatctagtggcaagatgttgagaactattgggcctggtctgtgtctttgaaatacaatataggtcattggcagagagtactgaacctgcgcccttggctccattacagcatgacctaatcaattgagaaaacgcctctccacggcttttctctggatgattctcccctccttactaccctgtgactgatgtttgtcatcttgtggctcaactaaactgtcgccagttactcctactcttttgatctcacatgctgtgagtcttacccattggcgcttagtagaatttatggaatcaatttgtgtaaatggagacatgaaatctcagtttgtagtatcagtttgagggatacagcaatcccacatttcgaaggctgctacagatcattcacaggtgttagacttattacagagctgtgtctttcttattccccaaagcctttgccactttggttttatatgttggtttcggtaaatacacattttctaatatgca

SEQ ID NO: 59344 - DNA, 1050 bp, Homo sapiens
gggcaggacttaattttgcttttttggatctttctgaatgtctgtagtgggtgttgaagcattttatgttcagaacatatgagcattttaattgattggcttctactgctttacatagtactgtgtgctcagtaaatattagtctgaataaaggcaatgcatgaggagactttggtagattatgtgattttgtgtgaatatcataaattcttaaatttcttcctttgtcttgtttttacatgaaaggtagtagatgaagcagagttaatccatggagtaatcgatgctgtgtatatgtgtacatgtgcatacttaagtgcaggtgttggcatgtgtttatttatgtgtagatagaggtggggataaagaagtagtgacaatggctgaaaaaagagacaaacatttcccagtgtgttctggaaattgtgttaggccactcggaccatttgatttttcatttatccctaagagtatatttacgtatttattaagagtagccactattcagagcccctggaaatagcctcaacaaaatgagtaaaaaattaatctccagtaaaaaacatagcagagaatgtgtggtcaaagctttgttgaaggtaaatacagggtttctggggttgggggaagacaaaacagggcagccatactagaatgggttcagaaaggctttgaagtgtgtgttgagcttagtcctgaagattaagaaggaggtaacttaccaaaaagggtgcaaagtggttctatacaaaggaaaccgtgtaagagaatgattgattaacgcagctctgatttcttctggggtgatcagggagaaatattctgaacttaagacatcataggaggttcctgtgttagaatcggttcactaataatgcgaagtccttacatggagagaggtaattgaacggtgttcccaaagagcagaccggtgccactgagtgctccgtggcttggagtgtgaacctgtggaaggtgctgagctcctcactgcttaatctgcagttaggaatttttacaaaccctgagtatgtggctcttgaattacag

SEQ ID NO: 59345 - DNA, 1048 bp, Homo sapiens
attaccttgggcagtatgtccgttttcacaatattgagtcttcctatccatgagcatggaatgctcttccatttgtttgtgtcctcttttatttcgttgagcagtggtttgtagttctccttgaagaggtccttcacatcccttgtaagttggattcctaggtattttatactctcaaagcaatattttataaagagtcaataatggttatcctagtccagtttgtcattttaataaaaatggctttaacacttcaccactgagcattaagtctgctattgaattttgctgaatggttcttatcatgtttaagtaatttttacctttcctatttaagtatttttaacagacatatttattgacctaatttgttgcacacctgtacatatgggacctcattacctctcttctgcagccttgatagaataaagagttctggtaaaattgctaactgggctggaaatcagtttgtaagcatttttttcctcagtgaccagtgacctctagcctctctgccaagcatgagacggagcctgactgatctataaattagttctggttttacgtacctacaaaatttcttgcccaaacaacccatttatttgcaagttcttgtactggcatcatcattacccagtttgtgcacatttctctgaaggtaaaatagacatcatgcgatatctccatttgacatggagttctcatgtttactgtatgaacacctgtgtatcttacccagaacatgttattttggtgtgtatggacatggagttgtttaaactattttctataaattgaaccaggaatcattataatttgcactgagaactaaattgaggtaatgaatttttttttgcacagaaactcctcttaatttataaaaatgcactgtgaatcagttcaagttggtctttattcgtagaactgttgaattagaagaaaactggaatatataatattttgtggaatgatctctctccgttttaaaaattgaaatcttagactaaagaggctgtgaaagaacctcactgaggtgtgagagaaaaat

SEQ ID NO: 59346 - DNA, 1076 bp, Homo sapiens
atgtagtttcatcatgttgcccaggatggtcttgaactcataggctcaaatgatctactccctcagcctcccaaaatgctgggattacaggcatgagccactgtgcccaggctggtgaataatttttaagattgagatatttagtctatctagaaattcttttgtgtatgctttgaggtaatacaatccagctttcttttttccacaggtggagatgcacatatgctaatgcctttttattatacaaatggttcttttccccactcaattgaaaagtcacaattgagtgatttaacacttggcttaaagttatcataacacttggcttttttctgtgctatctggttaattgttcaacttttctgtccctgttctagaatcattctcttttcttttctttttccccatggtttgtagtaagtttggtatctggcaagacaattccactcccactattcttttgcacacttttctttactgttctgtatggacattattgcaaatgagctttaaacttactttaccaagttggagaagaaaaaataccactggattctaattggaatatatggaattaaatgtatgtattaagtttagaaagcatgacattttaagaaagtaacctcctcttcaggaacatatgtttatctttttgttcatatggtattttatatctttcaataatattttctgtttgttatatagagtttatatatattttgttgttaaatttatactgtgtggcatttgatataagttgctactttttataaaatatttttcatttgattttctagctgtttatctctggtacagagaaaactaatgatttctttgtatatttgtcttacatctttgtatctaagtacattctcttattagagttggattttttattaaagttggattttcaaattatgtaatcttatctgtaaataaagatcacctgctacatatatgtatataaaatttcttcttacatcagcaaaatatatatattaaaaaaatatataaaatatatatattttatatatatatattttattgcattttaagttctaaggtacctgcacaca

SEQ ID NO: 59347 - DNA, 1002 bp, Homo sapiens
tgaggcaggagaatggcgtgaacccgggaggcagagcttgcagtgagctgaggttgcacccctgcactccagcctgggcgacagagcgagactccatctcaaaacaaacaaacaaacaaacaaaaaaaacacatagtatatatttaacgactctgttttttgtgaggtggctttgataagtcttccccttgcagagtctaagaagcacagagtcgtttattgtcaggatacttgtggcctgcaactagaactgggctcttgaaggatctcagggttgggctcatgctcacacttgctcctcccctcaaaatgcctccaaccccattttccttgtttctcagtctcttagggcatctgtacataatgctgcatgcctgctatggtctccttttactaagaactagccaaatcctctcgtcgtatgccacagtccaaacccagtctcgcttccttaattaataactatcgcctcctgtttggacaaaaaccatcccagatggacaatgtcctggtttgttcaggcaatggtaagtgagataagatctgttatcttgacaaaaaaggaatcccacaacagacattactttgtgacttaattttcttgaaattgattttaagaacacttttttttttttgctttaaatactttatctcatttgagccttacaataaccttgtgaagttgctatcattctccctgtttgctgatgaggaaacgggtccagagaacttaaggaggctgctgaagttcacaaggttaggaagtggtgaagcccagacttggaatgggctgtcgggcttccatcctctagagcccttactactgtatactatattacatctcactgcagcaaaatacagtttttttgcataatgtgtgcattatgttccgtagaaatggctgtaatgtgatatattcagtcatgccccattaatggacccagtatttttacttttttgtcactaaaatatgcgatagacattctagtgcatacagctttg

SEQ ID NO: 59348 - DNA, 1056 bp, Homo sapiens
ctttttatgacctcaccatttacgttggacctgacacttagaacctcttcttcatttatataccttggctttcttcctcaacagtgatagagattgttcctctaggcagactaccttatattattctaggtgaaaaaccacccagtttggcctggctttgaggccctcatcttttgcccaaccttttatggatgatgccctactctctgtcttgtagctgtgtcttaagaaatatgttgtacattgagtctctctgaattcataattgggtaacattatctctgtgaactatttttgtgtgtgttgcactgggctacctggctggaatcatcttggcactactacttcagtgtttttgcgtgatcctcttaattagagaaagaaagaaaaattctagactatgagtctaattaaggcctatatggaacctctgatctttcatttcaaagtgaaaagaacactagcttgtagtttatggccctaatctctaagtatttcgtgaaaggttgtttgttggttatattaatgcgttcactagttgctttcagactaatactaaatggtactgctttttgatattatagtcaacttctgtttacttttgttcagtatttactacgtctattgaaaaatttgtatattttatcttggtggaaaccactgtttattagtgggctattgaagtggtaagtaatgactgaaacattgagatgggttatgcagtgcttcttccttccgagggtttgtgagccactgagtaggtgtgggaggaatctcataagctgacttaagtattagaaaatgataatttacaatgtgtttttatattttttactcattttacttgaaatgctagtttgtttttcagttacaggcagaagcctagcctagctgaactggcacagcgcagttgacgtctgttaaatacatactgtgttttttgtgtttaaaacacatagtatgggccggacgcggtggctcacgcctgtaatcccagcactttgggaggccgagatgggcggatcacgaggtcaggagatcgagatcatcctggct

SEQ ID NO: 59349 - DNA, 1964 bp, Homo sapiens
ttttttttttttccatagagatcgggtctcactacattatgcaggctggattccaactcccaggctaaagcgatcctcttgtctcagcctctcgagtagcaggaatacaggcatttgccaccatgcccaactataatccatttttaattaacttttgaatatgttatggcataagggttttcttgattctccacacaaatatacagttgttcctgcatcatttttttgaagagactttcctttctccattaaattgccttttcatctttgttggagatcaattgcccatgtttgtgtaggcctgtttctggactcactattctatcctttcttcagtaccacaccattctgattagtatagctttttagtaaatcttgaaatcaggtagtgtatgccctctaacttttttttttctctctttaaaattgatttggctattttcacttgccttttcataaacattttttaatcagcttgttagctttttaaaaagcctgctattttgattgaaatggtgtgaaatgtagatcacttaggggagatttgacatcttaatattgaatcgtgaacatggtatgtccctttttttaaaaaaattttttttaagacagggtctcactttgacctccagggctcaagcgatcctcccatctcagcctccccagtagctgggactataggtgcataccaccgtgcctggctaattattattattatttttattttttagagatggagtcttgccatgttgcccagactggtcttcaactcctggtatcaagcgatcttcctgcctcagcctcacaaagtactgggattataggcgtgagccactgaggctggccctttcatttatttagagatcttatttagtttatcccaaatgtgcttgtctgttttgattgtgatttaatgtatgcaacacctattctaggacaggcaaagtacaaagtgccttacacttaatctcccataattacttcctgaacatggattgttctcactgtgttcagatgtcataactgcacctgagcgttacagagccaacaaatgttggaactgggattcaaaggagatctggtcactccaaaggccatgctcttagtctctagtagtcaagataacacatttgagaattctgtagataaatatttaaagacatttttagcaattgttgcatgcttgtttctcacctcctgtctccctcaaccaaaaataaacacataaattgtatgagtggatagatgtatctgtggatgaatagattcgtctttaattcaccatctcaaactcacagtggacttgcgtactattagaaaatcatgttaggattatctttgaaatgcattttaattagccttggtttttttttcctgttatctatctcatctagatatcatcaagcataaagtacatcttgtactatcagcatcacataggaaatcattagcattccccagagttgtctgatcacatgccgtcccattgatgtgttggtcacctgaccccatcatcgttccctgcatctctgaggaggtctaagaatgtgacctacttggatgtcacttgttaaaagttgtctggaactttagttctgcctaatggttttttccttcctttaaaagacaagaaaaatgaatgggctgttttataaccccctttcaatcctctgatcttcagagagaaaaatgttaaaaggcatgatgcagccgttttatgttgcagtttataatctaattaagtgtattttatccagatcattatggacttcattagagctctggactttttgtaagaaagatgatgagttagatttatgtagaatcatttgggtattttaaatgttgtgatcatgccagcagtgcctgattaaaaaacattcaaatctgcctatctgatttagttggtcatttaattttggaaggctcttgcttccaattttgctcactttttttgtaagcat

SEQ ID NO: 59350 - DNA, 1027 bp, Homo sapiens
aggttactgaatggggttttctttcatcattcatagtttccaccatacatgttttttaaaaagatgatttttgaagagcaaatttaggttcacagcataattgagaggaaggtacagagttttctcatatccctcctgccctcctcccccacctccaacacaaaacacacagcctccctcattctcagcatcctctaccagagtgggacatttgtgacagctgatgaacctccatggactcttcattatcaccaaagttcagcttctgttagcgttcactcttggtgttgtacattccgtgtttggacagatgaatactgatatgtatttacctttatggcattatacagaggtgctctgtgcctcacctgttcatctctctctcaactctcatccctggcaaccgctgatctttttaccgtttccatagctttatcttttccagaatgctatataatcgggatcatacagccttttcacactgccttctttcgcttagtagtatgcatttaagattgctccgtgccttttcatggcttgataacatcacttacttttagtgctaaataattgtccattgtctggatgtgcaacaatttgattatccattcaccttctgaaggccatctgggttacttccaagtttggggagttatgaataaagctgctgtcagtatccacatgcagatttttgtgtggacataagtttttaactcctttgggtaaataacaaggagtaagatttctggattgtgtgatgagtatgtttagttctgtaagaaattgccaaactgtcttcccaagtggctgtaccattttgcgttcccatcagcagtgaacgagagttcctgttattccacatccttgccagcatttggtgttatcagtgttccggatttggccattctaatatgtgcgtagtggtatcttcttgttattttaatttgcatttccctgatgacatgtgatgtggagcatcttttcatatgcgtatttgccatctgtatccatcatacatttttaatgc

SEQ ID NO: 59351 - DNA, 1126 bp, Homo sapiens
tcaccaggttggccaggctggtctcaaacccctgacctcatgatccgcccgcctcggcctcccaaagtgctgagattagaggcgtgagccaccatgcctggcctaaaacatttatttctaatgagaatgaatatgtgaataaaatcagcattctgttaggaatgaaaaggaatagatgtgtgtagtcagccagttagtgtacactaaaccagttggtattgtcagtagcagtaagagtgactgtctcctcagacttttgatgggctggcttagaaaagtaacatgaagataaagtgggtcctggatgtctttctttatgggagctgagtgattatgccagacatgagatctaggactcattttgcaaatgaagaaaaaacagctgaaaacttgtcaataaaaatgataaccaaaggagaaattatcatatgatccaatttagtaatgactgagggatcataaaaatttattaaaatgaataacagtttattgcttttctgctttttctatttttttccttttttatcttcagaaatcaagaaagacattttgctgctttgggaatgttatgccatttttgtcgttaaacggaatatttagagttaagatatgattaggataaggtaaaaccttatgaaatgttctcacatataaatgtatggaacttttcaattagctgtttaaaatgaaatatttatatatggagatcttctcagatatataatgtttaaaaaaaaaaacgcaacctttatttttattttttgagacagtctcgctctgttgcccaggctggagtgcagtggcataatcgtggctcactgtagcctcaacttcttgagctcaagccatcctcccatctcagcctcctaagtagctgggactacagatgtgtgccaccatgcctggctaagtttttttcttttagtagagacaaggtcttgtaatgttgcccaggctggtctatcctgagtctgagctcaagtgatccttccacttcggcctcctaatatgctgggattattacaggtgtgagccattatgccccgccaacttttttttttaaagcaatatatttagtggtctctggagtagctctgtcaacactgtcgaatttgaaattgtaact

SEQ ID NO: 59352 - DNA, 1003 bp, Homo sapiens
ggagttcgagactggcgtagggaacatagcaaaaccctgtctctactaaaaatgcaaaaattagccaggcatggtggcatgcgcctgtaatcccagctactcgggaggctgaggcaggagaattgcttgaacctgggaggtggaacttgcagtgagctgataccataccactgcactctagtctgggcagcagaggaagactgttaagagagagagagagaaagggagggagagagggaggaagggaaggagagggaggggagaggaggggaggggagggaatgggagtgagggagggaaggaaggaagggaaggaagggaaggaaggaggaaaggaaggaagggcaggcccacaagtttggcccttggctgacatttagcaactgagatttcagcaagtgtttcccccttatctggtaagagtggctgacagtgcctaaactgtttgtgtcaacattatggtttatgctgatcccctgctgtccttccaggagtccaaaattagaggctgcctacaggcgattgaactccaataaagaccctgggtactgagtctctaatgggtttccctgactgggacatttctcacgttatcacagctttttgtaggaggagtgaagtgcctcccttgtgactccctgggggaaggcccttggaggctcccactctgtttccacagacttctccccatgtgcctttccccttgctgacttcgcttggtgttgtttccctgtaataaactgcagctgtgagtacgactgtgtgccgagccctgagagtctgcctagtagataactgaaactgaaggtggtcttgggctcttcctgatgcagtcagctgtggatgtagtggtacctctcatagcataaagaacgcaaaagtggtagcaggtttgggagtgggagcagtgatgcattctgctgtaagttttccaaggtagtcacttatattgctttactagggttattttgagctagcatttattattatatgttttctattt

SEQ ID NO: 59353 - DNA, 2702 bp, Homo sapiens
ctaatgaattaacataaatacctgtgagtaggttaagtacacacaaggagcagattacaaaagaatgaaaacttaagcaattagcaaggattttaaaacattgatctatcaggtgttctagaaagtatttgcttctacatttcgagtttagctcaaattttactgagcagcttaaacagcactgtctgcttttgcctctaggtcacaggtcattgtcaaattcatttataagatagtttcaatctgtacttatttagcagtgcagagaattttagacacactaccttttcactgtttgtaaaaaaaaatttgaaaaataagaattgtaatgtaaaaaatattggaagactaattcttaacctacatgaagaaacagttttcagcagctttctaaatgtcttgtttacatccaaattgttgagaagctcgttgccaatctgttaattcatgaaaattcaaccttttaggatgtccactaagctgccttttattagcccggtttgaatgactgtgttcgtacttgagatgagttgaactgaattgccttaaaaattcaaatctgtaatgaattcataaggagttttcatcccaaagttcaaattggtagggcctagtaataactttagacatttatgtggtgacgagcttttaatcttccttaaggtttttaaaactctgcatgtactgtccttcttctatgttctcttgtccttttagttggttttggtagaaattttataaggcaaattaatgaaagttatctcctgagtggcagtttacaacaaaaacagatgtaaaggagaaaaaaatgaaatgaaaatttggattaaagaagaaaaaagtctcatgttagtaacagatataacaaaaagagtgaactctacgtggctataagttccttgacagcaaggactttgcctttcttaggtggaatctattgacatgtagagaaggaatgttttacttaggaggttgtcaaggaatgtctgtcaagtaggggtagaaggaaggaattaacagggctttgagaacattctcacatttgaagtgctaataatttctggtgtgaatttggtgataacagtgtttcagtatttaatattaatttgaattttctggctggttattaacttgagttacgtttataggtgatgaaacaaacgaagaggattgcatgtttatacacagtagaacttgagggttttctaataagcatactttaacattgcctcagcctgtaaatctgggattacaaggcagataagttttagggtgattacttctttcaccccataattacttcatggatttgccgtggtgtttctgtaagtagtgagcatctctagtaaactgacattttgattctatttaaacaactcattttacccagtttttcagcagcacattgactggataaagtaaggcgcgcatctgtcctcacttttttgagtcttgctcctaagtcttgtgaagaaaatatgggtgcacgtatgcattcctttatttagagtaacttcattgcatgaagttgagctgaagaactaggaggaaaatagctctttttgtaagttgtgctttaggagactttggatttagctaggaatgggatactgagaaaaactgaggtttcacctcctctaaacaatgggacagtgttctcatctctttgggactatatacatatctatttatatcctgctttagtccagaaggaatttcagctttggaaaaaaccatgcacacacacaaagatacaaataaagtgtaagtgaagtaatcagagtaagaggttggggaaggtaagtcgaaaccaaaagtgtaattagtatacagattataggctctgcagacctacacggtcacaggaagaccaccacatatttggctgttagcttttgaacaaagccaatgcaaagaggataacatgaacgatgcacggttcccagtgtctgtgccaaaatcgtctaagttcagtccggtctagaaggccgggggatggagctgacctcaggggaaccctgctgaagttgtgacatttattcagtcaagaagtatttattggacatgaacaatttgtcagtgaccatgctagacactggggatacgcagtcccacctttaaggacacacagtataggggatagatcaataaaatagactgaaattgcagtgcagtgggataaatgccgtggaggggagtaggcatgaggtattagactgggagacggggatatctggggaagatttgtgttggtgcctcagctgacttctaaagcctacatacttcttaacccaggcaaaagtggaaatgcattctaggtagaggacaagtagccagaacaaagtgacaaaggtaagaaagtgccatgctttctgagaactgcatttaatagttcagtttgactagaacagagagtacaaaagggagaaagtgttgagaaattagagagaaaacttgggcacatcagaaaaaggccctgttttccactatgctcgggaggttgagggcagtgggcagccttcccggcaaagagcctgtggagaatggatggaaggataggcaggagacaaggtaggagttccggcagtgatgcgagcaagagagaacagaggcctccattaaagcccgatagtgaggacaggaagaagggagtacagggaagttactcaggagcaaaattgacaggatttggcctagaagag

SEQ ID NO: 59354 - DNA, 1045 bp, Homo sapiens
gcaagcatagcatatttgtacccttttaacagaggtggcagtgaaatgacagctttttgctgcgtgggtgttcttttttttttttttttgctgacctgtagtttgatttccagtgtctagacttaacagtctgaatttaaacacgaggcatatacacaaaatcatctggaactgattttttcacactaaacacttctttctgatcctactttccaggaggctccttcctccaaacatacctccagatgaaaatcacttaattaaccaagaaagactcaaccgcccttaactgcttttctaaacagtcacacatactggatttacttattttgagacatgacaaaccagttgcaaaccacaaattcattctcatgggccctccacacggtctcttgttccttctgaagagggtcttgctgaggaccatttgtcccccttcctgcagcagctactcagtcggtgccggagagtgtggcctttcgaactatttgcggttttcctgccacatgatgctgacggacctcagcctctcccggccttggtgcacatacaacagcctgtaaaagctccactttctattccagattgctgttatgcgtctgcttctcattcaaaggaaataagaggagatgtaaatcgtcgctgtgcagttacgtgtttaatgaaaatgatcttgcatgctagattcacgtccaggagcgagtcgcccttactgctggtattgaactcactctccttggagcgccccaaggctgtgggctgtgggggggcattagtgtgtgtgggcgcagctattatttgtaccaggaggcacaagtctgcacagcaacctgaagatttagattttcaagaaactgcaaatcctgacacacctggtgataaaacccagatgctctccccaactcataccttgtcccgcaactcccactccccacttcctgactagactttttattttttggtccagaagataggggtaagagaagaatgctgaagggagtgagtggatgagagaatgcttggcttacttgcccattagatagtt

SEQ ID NO: 59355 - DNA, 1041 bp, Homo sapiens
ttcacttccccccaaactaaggctccacgtaggagggatgtgggggagatgatggtatctggggcagtccaatagctcactgtccatctaagcattcctgggaagaatgacaacagtctcattcgtcctgcccaccaccaaccccaaatggaataaatggaattcagccttcgcaggcagctggaggagtgagcctgctgctgcctctgcctcaggattcttcagaggaagccacaaagggtttggatgggggtgaacttcaaagtggcatgatgaaaagctcgaggtgatgtcttccgggatttagcaatgccatctttctgttttatgttggctttctttcttgatttgggattgtgtttatcagttcggcttattaatattaagtaattacaaacaatcatacatgcatttaggaacttatgtttaatctctggcaacagcatagtttattggcaaaaacaaatgcacatacactgtaggttagtgatgaacatcagcagacaggcctgctcttgagatttttgtctaactgaggagcgtcattaccatggcagtattgttctgttttatgtgaaatgtgttggatatttatgttgagtttaagatatctggcacgaagctttcctcacacagaagaaaattttcacaacttttgcagattctcagtttgttttcttttattacaaattaaaacattttgatttagattttctgtttcacaattttcatttttatggtagaacatgataaggcagctacaaggtcatgactaagaatacagagtccagaagcagacaggctgtgtgactgggggcggttatctctgtgctccagctacagcatctcaaaattggagagaatctaaatgatgttctatgtagttggtcgcctttgtcatgttatattttcagatgagagccaccttgttttctgcacagacatatcctagtcagtgattcttctccttcccatgttggtttttgatggtttcatttttgaaaagggagaccagcttttcattcgctttttcagcagaag

SEQ ID NO: 59356 - DNA, 1111 bp, Homo sapiens
ttttttgtttttaaaggcctgtataccaatattttcagggatgatggcattcaggattgtgtcctttgggattataatggcaccacccctaggtactaggctcttcccatactcagtaatcactacttgtgattatagtggggataaataagtctgaaattttgaaatattttaattgcacaaataatgtataaatgcaataactttattttaaataatttaaaacattttataacaaaggcaaaattccccttcatcattgtccttaatccctgttttctcccaccgtcctaccctccttcctagaagtagccactgctggcattttggcacctcaccttcagcattacacatccccactcccacaatttttttttacagacacacacaaaaaattgttttgtgttgttttgataagcagcaccatattgtatatatatctgcaacatccttatttttacttacttacacatcttagatatctatgtttattacatatggatttactgtatttgacattctatactccagtgcttctgctgatagaattaatttatcctattgtaatcttcttaggaaacccttcaacaagtatttctgatcgaaccagtaaagcctcattgttttggagcctacttacttgaaatctgtaataattatgcctagaatagaattaaaatttatggttgccaattaatgacttaaaagaatatttgtccccactaagagataaatagcttttaaataccagtttaaaacataccaattacacataaatttttatctgtgtttcattatctaacaaggcagtggcttgttctgctgacccttaagcatttgcaggcgataaaaggtgcatgccattaaaaccatcctccagtaggactgggcactaattaggactttgcttaggtgaacgtaaacacaatggctccctctccactttatctcgccattcactttgttctgttgctttttgatcagggttctgacagatcctcaggtcggtgcttcacctcttcgtgaggaggactcctcttggggcccatctctgggtactttggggaagtgaatacaggaagattatcttatggtgttgtagtaccctgaa

SEQ ID NO: 59357 - DNA, 1854 bp, Homo sapiens
tgtctcaaaaaaaagaaaaaaagaaaaactagaaacaaacaacaacaaaaagtcttccgtttctatatttgagcagtctcacagtttgtaaacacaagcacagagtctccttttgaagcttctatttagataccacagagtgaaaacaggatgcctgcttaaacacagagaagtctttcagctcttaggttttaggttttgacttagggatttagattttgactttagattttgaaggtaaccacactcttcccagagcgaatcaatggacgctatgtaaatctttccttcctcaacgctaaggtcataggagttaaatttgtctcacattttcctttcagtgggttgcattgtttgatagtttatgataatcaaacaaagtggtaacttatctgtattggtgatggacttctttcagaagggctttgcttttgattacacacactaattatccttatgaaaatatacatgcattccataaacgagctgttttgttatccaagccttgattctttcgtccattcttagctactgttgactacctagtgttgttaaccattgttgtagatattggggagacagcagttaacaacacagataaaaaatttctgcctttatagagttcgcattctagaggggggagatagataatacactaagataaatcaaatattaagcttttctgtgtattttatatcaaaaaggtatactgaacttggacactaaggtgtagtaaggatttcctcctttgtatggtaaaagaagagtccttggtaatctttctttttacaataataatagttcttttttctcctagagtctcccgttttcttaaagaactttacccacacaagcaaggttgccctaggacagtggttcccaacctttctggcaccaggaaccagtttcgtggaagacagtttttcatggatggggcggtgaggaggggatggatggttttaggatgaaactgttccacctcagatcatcaggcattagttagagtctcataaggagcacacaacctagatccctcacatgcccagttcacaatagggttcacgccctcatgagaatcgaatgctgccacttttctgagctccagtggtcatgcctgctcaccctccatgagaatccagtgctgccactgctctgagctccggtggtcatgcctgctcacccgccactcgcctcctgccgtgtgacccagttcctaacaggccatggaccagtaccagtccgcagccctggggacccctgccctaggagactgacttacgagttcatgaagaaagtaaaaaataaatttagggatcctaaataaaggatatatataggataaataaagtcgagttttggtgtagagccctgatgttccaaattgtcccaaagggttgaaaaattaaagccttctcttcttcacacagattgaaattttccttacttaatcttatctgccgttaggttacctctccaattcttttttcaattatttgggcattaaactgctctatcgtgagttattagagatcactttctatggctgacaaatgtcatttaaaattaataccaacatttatgatttctgtgtgaaatgtttattctttcatgagataggtttcatatccttgttctcttgttaacatcccctactttgtttttagttgtggggtttttgttttattttgtttttgcattggagaccacagtttgcaataaggctatgcactaagcctcattgatttcctctaagctcttgtttattgagcacttcatatgtgccttgaattctgtgagtgacagacagtcgggggatgatgatatacaaggcgcagtttttgtttcccatgagtg

SEQ ID NO: 59358 - DNA, 1050 bp, Homo sapiens
ctgctatgctgagtatgcctctgggcgggggccatgggaccaactgagtcataagtcacaggtccaggggggtgagttggttgccagcatgctaacgtctgaaaaacgtttcgaaagaccaatcttaggtactacaatagtaatgttatctgtaggagcaattgaggaagtcacaaatcttgtgacctctggccacatgactcctgagcagtaagggattatagaaactacgcctacattttaacaaattgcaggcccctcccataaccctaatcttatggcctttcattagttttacaaaagcggctctggtccctgagcaaagaggggtttagttttagggagggactatgaccatccttcctgtctcccatggttagcttggcctgtgcctaggaatgagcaagggcagccagcctgtgagactagaagcaagataaagttagtcacgccagattcctctcaccgtcatgatcttggcaaacgtggtttcagaactcctcaaatatccaggagctcgatttggcctttaggctaacttgaaagaaataaatacttctattttaaattctttctttaaaaaagtttttttgtagagatgaggtcttggagtgttaatccaggcctcaagcaatcattctcccttggcatcccaaagtgccaggattacaggtatgagctacattgctcaggttattttaaattttttctagcaggaggagagatgtattcaatcctgagctggtacactagtaattaaaaaaaatagaagctaggggctgggtgcagtggctcatgcctgtaatcccagcactttcagaggccaaggcaggcaggtcacttgagggcaggagtttgagaccagcctggccaacatggcgaaactttgtctctactaaaaatgcaacaaattagccaggtgacatggtgcaggcctgtagtgtcagctgctcaggaggctgaggcatgagaattgcttgagcttgggaggcaggggttgtggtgagcaaagatcacaccactgcactccagtatgggtgacagagtgag

SEQ ID NO: 59359 - DNA, 1056 bp, Homo sapiens
tgggtgacagagtgagctcttgtctccagaaaagaaaaaagaaaaaaaaaaaaaaaaaggaattgtcagttggttaatgtcttacagggcaataaaactgttgtctttggggctatctttctatcacacaaaaatcatttacatccttttggacaaaaatctgcaagttaatatgttacttagcagtccttatgctgatagataataagtagtaagccaaacaatactacagtattaaaaaaaaatccttgggtgggcctgtttagactgtggtccaatatttaaaagaatataaaggtaaccttttgacatattttcaaatttttcataatttttactaataaagtctttcatttcgtttggtttcggtttataatgagttatatgattcttgagcaaatacaaattgtgacctttatgtgtgtattgtgtgggttttttgtttgtttggaccagaatcccccttacttgggactcagtaagggaaagggctcatagttttgacttacctgaattgtaggtgagattagctgtgttattgtttaggaacttttattctgtgtgaagggaactgtagtcacccaactggctcttcctgtctgctgcacagacaaaactgaaggggtggcctgcccctccacacttgtgggcgtttcttgttgggtggaacgagagacttgagaaaagaaagatacacagagacaaagtatagagaaggaaaagtgggcgcaggggacccgcgccggcaccagcctctgagttccctcagtatttatcgatcattatcgggcatttctgggagagcgggatgtggcaggacaatagggtaatagtggggagagggtctgcaggaaaacatgtgaacaaatgtctctgcatcataaacaagttagagaaaaaagtgctgtgcttttgatgtgcatatacataaacatctcaatgccttaaagagcagtattgctgcccgcatgtcccacctccagccctaaggcggttttcccctgtctcagtagatggaatatacaatcgggttttacacggagacattccattgcc

SEQ ID NO: 59360 - DNA, 1170 bp, Homo sapiens
ggtgtccatataatttgtggtccaaagcagaatgctttgagaaccaaagagggcattcttaataattatgttgggataagaaatgtaaactgggactgtaacaggcaaattgcaacctatggtaattctagtcattcggcatgctagattcttgtacattgttcaagcaaaggcaaaaggaaataaactaattattctttttctactgtttttagccatccacatatcttaaacaccccttgtttcaccaaggaaaaatatttttatctataatgcaaattatcaaatcctttaaggttgatcagaaacaaagatatttgaaaatgttttgtagcaaaggggaggaaaagtatctttcctgctacttattttgggtagctgggaccccctctaataaaatttattttattagaaatttattcaagttttatgtgacatgggagacttcataaggaaatgaagacccgaagaagcagttaaacgtgagcttgtttcatagtaggtttgatgaagagtggagagtcttagagaaatgtgataggacaaagcgggggatgagctgaatgttataaactggaggatgcttagtaagacctatttgttcaggtctctatgtcactgcatgtttggagataaggatgcccctttcttctgggtatagggagggcacctcacacattagggtcctttgacctgcttcggggaaggtcataaaacgtaggaaagattttataacctttttcaggggagaaggggagggggaaggtctgttttctcaaatccttcagcttaaaatatctaatatgccaaagtaccatattttggggtaggatgtcttggaccccatcagtagctacctctggcattgtggcagatggtcaccatgtgtcagatgataaacatccacctctggattaattcctcattagggtacttcagatgttaactaataccattagggtgtgagtggaaactaacccagatacacataaatcacactggaaatacttctatattgaagtgtttaaaatttactatagatagtgtaacactttctttgctggagataaaatttatgttgttaaaagagaaaatgcaatattctttaggatgtacagctttaaagctgcattaggagtaaaacacaggaggtacatgcagcatttagtg

SEQ ID NO: 59361 - DNA, 2016 bp, Homo sapiens
ctctctctttctctatagagagaggagtcttccaagtggagaagacccaatttcagttcttggtggagatcaggattttgttcaaacagaagatggtgttctctctgtttcttccatgcccatttaatgaccaacgttcagctgtcactgaagggctaaaagagagaagctcttatatgtgattattttgacttaatttttctggaactggtttctttctctgttaggacatactgggtgcttatgcaaggattatgtatgttggacagtttggccattcatatatacctttgtagaatttttctgtatcttttcttttgtactctagtattttaatatattttgtcattttgcaatttaagcctgggtctgagacagtttcaccttattcttaataatgctagataattccatatccactaatagaaagaaagggaatttgtgatggtgactgctttggtaccaagaggacagagggagaaaaagaacagagaaaaactgactggattcttctagtgccagccagtggaaaatggaaagaaaatttctccatacccacatttcccccaaatctcccttgtaaaaacacccctcccccagaaaaaaaaaaaaaaagcaaactaccaatttcagacataggttttaaatgcagcatcatgaaaactgagcaatttggagggcgagaaaacatgtgagtggctggcatttggggtaggaacagccggtaaaggtctaaaagttttgtctactcatctcctgttcataccatcatgagataaaggggcagttttctacccgagacttttggttgagtagttgaaaacttgttttcatggtgtgcaaaagaaatataacatgaaaatctggatcaagtgaaatagaaatatttttagaaaccaaaatcttcaacaagcttctgtgaaggtttgtgaagattcatatgttcctttctcacggtcttaaaggagcaactgaagtgatttcaggaatctaagctattctggctcgaaatagggatgggttggatatgcacctttcccaaaataattcactgcatctaaaatttataattaaaatagttcttaggaaatataataacatgaagtgctactcatggacatggaaaatgtaactcatgcctaatgttttggttataggagaaagaatgttccagggaaatgtcatctttatgtattgaattttctaaaagtagggtcgagtggctgggcttagtggctcacacatgtaatcccagcgctttgggaggctgaggcgggaggattacttgagcccaggagtttgagaccagcctgggcaacatggtgagaccccatctctacaaaaaagtacaaaaattagctgggcatggtggtgcatgcctgtggtcccaggtacttgggaggttgaggtaggaggatctcttgaacccaggaggccacagtgagccgtgtttacgccactgcactccagcctgagtgacagtgcagtaccctgtctcaaaaaataaaagatcatctcaaataaatataaggtcaagtaattacctacacaataatcaatgaattcaaagcctctgaaactaaaaatgtagctaaaacttttctggatataaaatatatatgtgtgtgtatgtacacataaatttcataaagataaaaacatttgccatcttcctatacaaattataagctgtctgaaattattagaaggggatgtaatataggaagtgtattgtgacaaagctaatttttcaaacttttggggatattgtactgaaaacaaaaataagcactaatcaatgtcctcagacttacctctaggataaaataaaattttagttggactacttcatggaatttccctcattactcttaacttttttttttctttgagacggagtctcgccctgtcgcccaggctggagtgcagtggcatgatctcggctcactgcaagctccgcctcctgggttcacgccattctcctgcctcagcctcccgagtagctgggactacagg

SEQ ID NO: 59362 - DNA, 1008 bp, Homo sapiens
ttgcccctgtgtgcactcacttctgcccttggagtgcctagcacattatctggcatacagtataagttcgataagttatttgttaaattaatgattgagtagctatgaagagatacgaaatggccatgggctccttcccctttctcctggacagtcttaactcctgtttcgaattgttttgcttcctgtgaaggaaagaagtatgaagttgtatttgtgctagccacccgcaagcccatggtgtggggagagacagacaaacacattccagtgctgggcatcattgatgcgatgatatgtgcacggggctttggaagcccagaagaggagcctgcagttcagctgaggggaccagagaaggctgtttgaagaagatggtgcccgagcagaagaggatcaagacgtcactgggaggggcagagggtctaatagagataccaatgcggggcttgccgtaaacactcagggccacagaagaggaaagtccgccatggagggagggaatggcaaggaggcaaactggagagaggctccgagatacgctcagcagatttagatgcaggttagatatgaaaagtgggaactgtgatgtgtgttaggtttgttatgatactgatttctggtatttctggagggacattagccgtgaagaaatgaagtatggctcatgtgatatgtcactttaaaatcctgagggacagccaggagtgatcctgtgcgttttgctatagaaaaagcagtggctctggacctttgtgtatctgcctgggcattgaacggcaattctttgaccttgttacaacccagagggctttaaaagtctggaaagttatggactgttggtggcgaggcgggggacatgctctctggaagatcagtctgagagagccccaagtatccagatacactaagtcataatgatacaaaacttaaatcctgtagtctttcacagcaggcggaagtgcaaggactgggcttatggttcagtcctctcttctaagtttaaga

SEQ ID NO: 59363 - DNA, 1339 bp, Homo sapiens
acgtttctttgtctgaacaactatatttttcacgtgttttgtgcattttccaaatatttaagaatccaagaaatactttgtaatgaaagaatttttaatgaccctatgcagaaactgtaaattgcatgtctatgttgtgagtttcttactggattatagattactggattatgtaggagaaaatggaatgagcacctacaaatcaacaacttggataaataatatctagaaactagcagggactcatcatttcattgtctttggtaagatggacagatcatttggtggttgttgcacatgtcttttcccataaactgtacttgttgtcacgtaactggaattagagttacaatgataaccatttgttacaatgataaacatttgttacaatcataaccatttgcaagaaccgtgaatccttttattcaacaaaagttagttctggtatctttttcatatacattgcctgaggctcagaattgcaatgtattctagttaggtctttgtgtttaggctcccaagtacccgtattaatcagaacatctaaaaagcattcccataagtacaatggactgagattgccaggtgtctgatgtagtgcaaagattattgctgtttaaaagattttgacctcagagcttcattcttcccatcgtcataattttctgagcgctgaggcattgcagatcttgtctttctgtttattcagctatactttttgccagcaaagaggcctgaacaagtaggtaatgagactgtctacacagaggttctgcgagcccacagctgcccactggcaagacccgtttaggattaatatttcagatcatctattctgcttgctctgagattgatgcgcaagacacaaagcaacctctagacacttcagctaagaataggtattaagcgtgaatgcatttgcatatttggtggcaacctattctacattcttccttaacatttttttcttgtttattaaacagaggatgcttttgcttacctctcaactgcagaaaaggtactgtttgatatatatcggttttatttactctgttctcacagaattgcacgtgtgctgttcatgggggaaatattttatgtaatttccaataaatattgaagaaaatactataatcatggcttgatagaaggtgtctttgtatggatatttcaagggagttttagtaatggccctgctctatgaaaaataggagttgaagttgatgttcaggccatttctcctttatttactgttcttgtatttttttgacacagggtcttgcctgttgcttaggctggggtgtaatgacataatcacggatccctgcagcctcaagct

SEQ ID NO: 59364 - DNA, 1004 bp, Homo sapiens
agcctttttctaaatgcacaaaatacaaaatattttctcctaaagtccatgaatggtgccttttggcctctctgaaccctcttcacacagcaggatttcgaacgtgtgctggacaccaggaaactcatgtcattcccgcagggctttggatttaggactttcttagattgacagggaccgaatatttgaaataaactattgacatgcaagaggcagattaatgtgaaggttagtagttttggagctaattccatcatctttcttgttcttgatttgcatgtgtgcattgaattatgttgtctttttgggtgcgggtatagatatagttttacccaattgatcattaacttttttgagggcatctatttgtatcttgtttatcttgatggaaataaaatataaaaatcagtttagtggtaatttttaaataattagacacaggaaggaagaacagggttgcaacaaaaacactacgacaaaactaaggatggtggaaaagcaagaaggtaaatttaatgtagacgggtgtctgtaaaatataattgaaactaaacttctgacaccacataattttaatcacagaaatatacttgggaaggaaataaattctcaaagaaaaccaactagatttaagattgtcactaaggaaggctgatgcaggtgccacacaaagtgatttaggtctagggccccggacactcctctacatcatattgatatgataggtagcaggtagatatccaagtctgagttggtcacgaagcagaaggtattgtgtgacttctcaggcagtggtacagccctctcggtgaaagtactggttggaaactggggtgggattgtgggggttggaaattaaaggttggaacaaaggaatgagaggttttggacaggtctatctgagaactctggagtactacagagcttttgcttttccagctaactctgaccaagccaatatagttcgtatacgcatattggcaaccactggtgacctttattac

SEQ ID NO: 59365 - DNA, 1010 bp, Homo sapiens
aattatgccaagggtgttttttttccctttcactttaaatcacccgttaggatcatctcatcagcttcctgaatgttgctgcagatgaaattattattgacatcataatgttggaattttaattttttctctccagttgtcagtgaatccagtgttcaacaatcactagtttttcttagccccattgggaccaaacccaaactagtcttaaattttatttgcacctttttgggtttgaagcttgattgttcgggatattggtgacagtgctaggactcagtgtcagtcattgttccattgcctattgaggacatagttctacttcttttggacagacagccttgctttattcaagcgtcccatggaaatcagtttgttgccacagagaagcagatgggtagatagaatggtcaaattttgctgtcccttcactaataacttagagaactgtttattcacagccggccatgaaacaaagtaaatgtttgtttcaaaatacgtatcaaattgaatattattctgaagaaacaacttgcccgataggcccgacacaaactggctattaccatttattttcaacttatcagtctgatacaaccaaagagattaaatctgatagttgaaaactattgtaggtctctagcattatttaaagatggagactggttagaagaggttggctggaaaagggtgggagaaaagcaaaataggaaatgttttgttccttttatgaccaaaaattctactattcccagagatagcctagaagtagtttggcaaatgacattttagttatttttggagctgcttttcaatattttaacatgtgtttatgtgtaagcctgaaaggattacaaatgtgtgtgtgtgagtgtatatacatgtacatataactacacatatctttctttatataataattatgtttttgaaaagttgagtataataaaatacttacaatctaaataccattttaataggacaagggaagctgactttctaaatacaat

SEQ ID NO: 59366 - DNA, 1986 bp, Homo sapiens
cgcttgcctaccgggaagagtgaaaagatgttaaagaaaaagagggaatcttttcattccttgaactgttgtgttgaataaattttaaagaaaaagaagcaaaatgaaataacttgagaacaagaacctaaccgcatatgaacataatttacatgccataaaataccattttcaatgtacaattaaatgatttttataaaatttacataagccatattttttaaagtattaaaagacagttatgagctaagcttttaagtacagtgatgattgagagtgtgataaaaatactgcaggtagcatttaattagggaaattcctgccagttgaaagatgtggatggggattggcagagattgaaggaacagccattttgtgccagacactctgctggaagaggagcagataaacgggcgagtctgggagcattttaagcagcatttaaaggataataaggtcctgtcttcactaagccattgacatgaatgtgatacttttatatttgtttctgttttctgactttagccctaggaaaataaagggtcatactagcattgcagttattttctcacataaaaaattatatttggctgcttctaattggaagtatctattttaagctcaactaaccctaacatctcaggtaactgtggacagaacttcacatattataagcgtcttactctgtaaaaaaaaaaaaaaaaaaaaaaaaaaaaacaaaaaacccctaaaaatacatattactagtgatgtattcatttaaacaagctatgacgatttatctagtttctggaagatactgaaacttgatcatttctttgctgcagtgacctacagcataagttaaatggtagttttagttgattatgctttattttattttgttttttaagtcaaagcctgtttttctccatgataatatcctcctcatggtaagactgcatggacaagaagttgcatagagaatagagtgttcgtgggatctttctataacttgtaagcaaaggaggctttgggtttgctgtggatcgtcctctggagagtcgcattcattttctcagaggagctctgtcccaggatgctcaggaatataaaaaataaaagtgcaaaaggaaagaggacgtggcagagccgaccttttccaactctgagggtgaatatcttctgtcttgggaggatggtgacaagcttggacttggaaccagaaccctggtctcttgagccatgtttgtccagtcctgagcgtcagcaagcagtcagggaggagggaaagcaagggttgcaggcagatctgtggaaaaagtgagctttggtatgagttgacataggcattgcctgttggtgtggtaattgcccagtggagacgtccacaggccttggagtgactcctgagtggggccatctgactcgtcatgctgccaggcagcggcaggtcacagttgacatgttttcccatttcttcactacctacctggcttttccacaaaaatgaactcccttttaatcatcatttctgcagtctatttagagagtatgaaaagcttatactaatctaaaataaacttttttttgttttaatgcgttgaagtcttgctctgtcaccaggctagagtgcaatggcgcaaccatagctcaccacggccttgaactcctgggctcaagggatcctcttacctcagcctccaaagtagctgggactaccagcatgagccatcatgcctgtcttcccaatctatgtattagtgccagtaaaacaattaagaagagtgaatatattagataaatatatcctagcacattccgaagatgaatagaatttattatgattttaaatcgcccactccagtttttcctttggcacggagaactgaaagctgcatatcagtgctgggctgtccataaatacttactagtcattgtactgttaacagttatttaatgatttaatcagaaaagactggctttggatttctgatgaggtaatga

SEQ ID NO: 59367 - DNA, 1054 bp, Homo sapiens
aggacttctcatttcagaaagttaatggtcttctctcctctctgtcagtgtgatgtatgtaaccactgattagctgactcatttgttcagttggcagatacagaggcgatcagtttactcgccttgctgtttaaaaatcatgataattttgcactccctttgagaaatgggtaagttcagaaatcagttttgggactatctttatttaactaaggcataagtgactgcaccttcagcaaatttaattcctggcttcagactgcagtaatcttaaatgagacattttgttgtatgcttataacctcagggattttatctgctgccgtcgtggtcttttgaggaggattctcctgttgcaaaggatgtctacaatgtaatgaatggcaagaagtatcaggagtattttgagtgcttaaacccatccgaggtttattaattttccggatatgggttaacatggttccatgaataggcacaaggcctagagagtaggattaggaaggtttccagggattctgaactcatgtcaagcaaaactggcatgctgggcagctaagtcaactgaatagggaaaagactttgaaagtgctttatctcactgcataatgtttgtcaatttcattcaattaatttacagctgcagggctcatgaggctgaaattaaagttttgtaaagtttcgataaggaggcagccaaacaagtttgattagcagtggatgttttggaaatgagttggcagccatgcaaaaatagagggtttgaatttcaggaggcacgttggcatggcagtgcccatttgattaaccgtggaaagcccattactttccacctggcatttcgggcatttcttttctctgtgtgtcttctctgaggtaacctctaacattggaataaacatctttttagttaagtctcatcagcccattgttcttagtctgttttattagcaataaatccgttgtctgtgttattctttctacagccatacaacatgctctttagtctttctttccaaattgtagacatttcagtaaggtgtttctccctctgcag

SEQ ID NO: 59368 - DNA, 1001 bp, Homo sapiens
ccaggataatcatcccccattgaaaaactaaccttttcaaggttaagtataatgtgaaacaaataatattgctccagaatgaatttctgtgcagtttgtatgaattaacagctggctaataagaagctcttgaagtctatcataagcaaggtcttgtattagccatagactgagcagacctattgctgcctctaccgtttacctcacatggtgaagtagtctgggaaaaagcagtgtcactgttccactccagatagctgtcattatggtattacataaactagcagactgctgtgggacgcaaaggggatgtgcaccgttttggttatttgaggggactttggcatgcccttgtaggagcccagaaggaaggatcatacagtttagtcttaagctgtgcaaaaacatgaccacatgaatgaaaccagtcttcctgaggccagagggcttataaagaggaaagatacacaccttgagtagacttctttttgagcaaggatatccagaagtagagtgttaaggcaaagcaaaagattctttagactgcactcaagtctgtctttataggcatttcttgcttgtgtagcatggaaaggaccactgcttgctcagtgtggcttttttttctgctatgctggaccatgtaagtagccattgagataatttattcctgagtcaaaataagagggcattaaatttagtagaactgaagttggcactggctagactgattactatgatgggatcccttggagagcatcactggtgaaagcacctggattctatttagaaaaacttaagtatgtaagttgccttctttgggggatgaaacttataatgaactattgtagagggtatgaaagcccacggcatgtttctatcatatactatatatatatatgctatactaagatgttatgcatgggtcagggtccttggtaaggctcacctgtcatttcttatgtagtttatatttgtttctctttgcgcaaggatttggt

SEQ ID NO: 59369 - DNA, 1054 bp, Homo sapiens
cttctcaaagcaagaaatgtgttttattcgtttttgtatccccactgtagcaacgtggaatgaacatgagattaaagaaagccatccttcatgtagtcatttttgtcaacactgagaaaatactgattgagcaggtggtgtaagccaggcacagtgcttagaggtgggggtaccagcttgtgtgatacgtgctccctgcccttctggatctcacagcctagcagggaagacagatgtgtacataactaaccccaaatacattcagagtgtctggaaacacacaggagggatggttgggttggagatgatttcacagaataaatcacattcaagtttggctggcctgtgacccataatttataaatcaaaatattggccatctagccaatgtcattatgagccacgcattatgccaagtgctgaagatacagaactggacacaacatactccctgaactcaagagcccattgatttgtagaagacatatacagatgtttaggaatccaacaagtagaaactgtgaatgggatgctgtggaaggaggagaaagactgaagaggagagcctcagtagggccggagaagagaggcccagcaaaaactatacgggaagcgacccttgagtttaggaagggggactaggaatttagtaggtcagtagagggtggattaaggtctggtttcaggcagtgaaacccctcatctatgaaaatttggagcatgataagtgatggggttccggacatgctaccccaaaatatggcattagaacaaacagcagaagcaagaaggtcgctcttatcttctactcatccttatctcctgaagcaagttataaatccttcattccagaggcatactctctatacctggagaagagaccatccttatcctcaaaggcagagagataccaagaagaatgtgaacaaacaggcgttgctaagttttccccaatttattaccattagatcatattcccattgtccaatcacacttccccataactctctggtcttcgtcagacctaagcataaaaatagaccaatttccctgc

SEQ ID NO: 59370 - DNA, 1561 bp, Homo sapiens
tcaaaaaactcaaagtatgttttcccttgacagaaacttcctatgaagaagttctgtgatccatagatttaaaattggcctcttttgggagccatttgattggcctgaagttaatcatggctacgcccttcattgtgtttttcagtgcagatgtgaaattagtcccggagagcaggggcatgtttgtttggtgtccttggttaggacatcagctgagttcggcctggtcaccatacacaatgtcatcttacatttggttactgggcaatccagagttcaatgaaagtgtccagctaagagttaaatgaaacgtgtcctttagtcaaatatgtgatttggtctttaattagttggtgcatttttgaaaattacttggcaactagggatatttcattagcatgtaatgggattaatatttagtgaatcatttttgaaatacatgacagatgttcggagccttggtaatttgccatatggtagcaagtagtagttttcagaattcttagttctgtcatatacgaatacaccttcataagggtgtgtgactctgtgtttgagaaacagcactctctttgttgcttaggctggagtgcagtggtgcgaccttggctcttggcacactgcagcctcaaacacctgggctcaggtgatcctcctgcccccgcctcctgagtagctgggactacaagtgtgcatcaccattgctggctaattttttaaatttttttgtagagatgggatcttgccatgttgctcaggctagtctcaaactcctggcctcaagagattctcctgcctctgcctcccaaagtgctgggattacaggcatgagctacctttcctggccctgcattctttataagtgtgtctacttatctccaaagaatattggagattctttttttttttaattagtcttttcttcctgttcattctgcaagggatatttatatttgaaattttggagaatgagagtttttcctttaaaattgaactatttttgaataccactccagaggatgtaggtgttgtattaactgaagtttcattctgaacatggaaagtttaattatcttgtgatattttatttgattagaactctgtagtaatcgctttgctatattgtgatgctcttgtcacagatgatatgcccggtttctgtcattaacgctgcactcttttccctataatgacatcactgattactcattttagaaccagtttccagcatatgttcttcctacttcctgcaacagtcattttgtagttactggcctggagggtaagtctttatccttccattagacgggttcagtatgagctgctattaattttaggacatgaaagagagataatcaacactgctatttctctgggaatacactgaaaattaaatatgtagactaaaaactacactgtatcttaagtcaacttctgttcattttaacagacatttagatgaattttggactctttcatttttaaaagattacagttataatgaacaataattaggaaagctttttttttttttttttttttgcaaaatggaaggaatttc

SEQ ID NO: 59371 - DNA, 1164 bp, Homo sapiens
gggtacatgttaggaagttggctctattcaaacctcgccttctttgtggacagcatctttggattttatgcaatttaattaccttcaaagacttagtgatttggttgataaaaccttaaaaaaaactcgtacagctgtagtctttattgctggaagtaacttttctttctttctttctttctttttttattcattcattcattcatttggaactttttaaatagtcactttggccaactccacattttacagactgggaaacaaactagagaggttaagtgacttgccttaaatccacagccaattagtgacaatactgagactagaacacaggctaaaggtactttttaaagagagtgtttatcacttattaaaacagttgcttttgcaataatagtgataggataattcatcattaattcaacacttattgactttgttatacacaaaatatggtttaagcattggcagtgaggtaaatacgaagacaacatcttttgtggaaaggatcttaaatggagagattttaaaataaagaaaatgtggtatattcgtagatatagatatagtgacaaggatgacagacatgacttgtaagaggcgttgataggaagaaaggctgatggcagcagatgcaggactagtcccatctttgggtgctagggttgccatttcgttaacggttcctatgtaaaattgtgcatttctcaggggaaaaaaaacacaagaaaaatggacagtatgcatccctttgtaatgttttaattaggcattttggacttagcatactgccttatgtaaaacaatacaagcatgtaatacaattttaatagcttcaattttattagggacaaaaataaaaagatggaacccaaggactgccaccattaggaaagtcagtgcagaatgatttgtgtgtgtgtgtgtgtgtgtgtgtgtgtgtgtgtgtgtgtgtgtgtgttttgagatggagtctcactctgtctcccaggctggagattgtagtggcgtgatcttggctcactgcaacctctgcctcccgggttcaagctattctcctgcctcagctgcccgagtagctgggactacaggtgcccaccaccatgcccagctaatttttgtacttttagtagagatggggtttcaccattgttggtcaggatg

SEQ ID NO: 59372 - DNA, 2663 bp, Homo sapiens
attgagagattttgaagacacaaagattccccatctgtcccctgcctgcaccttgtcttccatcttgcatattttttgaaggatcgcaatgaacaagaatgggatcaacagtggggagggccacacacctgtaatcctagcacgtttggaggccgaggtgcgcagatcgctggagccctggagttcgagactagcttgagtaacatggcaaaaccccgaaaaatacaaaaaaattagcagggtgtggtggtgtgtgcttgtagttccagctacttgggaggctgaggtgggaggatcacctgagctggggaaagttgaggctgcagtgagctgtgatcgcaccactgcactccagcctgggcaacagagtgagaccccatctcaaagcaaaacaaaacaaaaccaaaaaagcacacaacacacacacacgcacaatggagctgactaatccagatactcctttcaccccctaaagggagaaaaagagtatctgagctctactgagtttctgttgtggcgagtatggaactttgaagtcagactgcctgggcttgagggccagccccactgctcactggctgtaccatgtagaacagctgttgtactctctctaaatcccagtttgttcatctatgaactgaggattcataatatttaccttgcaggcttttataataaaaattaaataagatttctatgtaaagcacttatcaatgtgcctggcccatagaaagcactcagtaaatggtatgtgctattgttcattctttccacaaatacatactggttaacttaccctgttccagacacttttcagcatgctggactgtatagtgaacagttcctcccctcatagaaatatattctagaggtaggaggcaactataaccataataaatgagcaaattactttgtatgctagaaactggtaagagctatgaaataaaactgaacatcgtaatagagatggggaggaggagtgcaggaattggggcaacttgcagttttacatagaaagtcacattaggcctcgtggagaagacaacatttcaacagtgacttggaggtatttgattgttattgttactaccaagtaggattttgttctaccaaacagggctttgctttacgcctacatttctacccttactgcattttgtaaaagttgatgataataataaatgcatacttaatactaataattaaaatagtaatactggaaattataatctatgtttacactcattttagctatataatctcctctccttttcgtatttttcttttcttttcttttcttttctttttgagacagagtcttgctctgtctcccaggctagagcacaggggcgtgatcgtggctcactgcaacctccgcctcccaggttcaagtgattctcctgcctcagcttcctgagtagctgggattacaggcacgcgctatcatgcctggctaatttttgtatttttagtagagatggggtttcgttatgttggctaggctgctcttgaactcctgacctcaggtgatccacccgcctcagccccgcaaagtgctgagattacaggcgtgattcaccgcacccagcctccttttcatatttcactcatttccactgcagtgagtttagggattagaccagtaaggaaattagttctttttgcttacagacaacagaaatagaagaaaacaaactagaaattagctccttaaaaacaaaatactaaaacaaaatacagaattcttctacaggatttctcaactatcttttgtctactttatccaactttccaatgcagtatcatcacactaaaatgctagtatttctgaaaatacttgggctcatctttgttgaagttattgacaaaaaagttctcaccttttctgtgaatgagaaatattgaggtgtttatgcagtctatggtttggtgctgcagttgactcaggttggcatgggaactggtgccttgtgaccgcttacaataaccaagcatcctcaaagaacaggaaaagctgccctttcagagttctatatggcattaatctgtatttctctcttctaatcatgagcaaatgatattttcctttacagagctagcatcaccttttggtacttttgcactttaccttcctgtgtagatacattggaatccgctctctacggtttctctgtgcatccaaagcagtggttactaaccctattagattcagtgctgcatctttgtaatgtgttttggaatatccccttcatttctgaaatgaaatgtattaataatataactgcctctacacataaatttaagtattaaaatagtgttacaattttaatataaagaaaagagaaagatagctttcagtgcattttattatgtaaatgcttacttgttgactattcctggagataaaatgatgtcatcagatgtttggacctacttgcaatgaatatatttggattaaagaggagtaaaacaacattcaactgagtattggcaaaagcttttctttctatttgaagctttgaaataaggagtaaataagtatacacataaacatacatagaatcctataaatgtaacatctgtgtatgtagattgatgcctggttattgtgttggtgattgaaatgccatgaattgtcgacatgatttttcacaatgatgaac

SEQ ID NO: 59373 - DNA, 1052 bp, Homo sapiens
tcagaactgtctggagtgcaatgagtggcatgtaactactgcttttaatccaaacagcattttctttttgtgattagggagacattaaaattctttgttatataacgagaataaaaattggatttttgaaaacaaaaatgccctgtttttacttaaggtttctagcttctttttgaatgataaatataggttgtaattttctttcactgatgcagtttttaattttaaaagggtagtcactctataagaatcagcatgttttagcataaatggtcttcctgtgagagacagtcaatctgagctacctgtattttaatttaaatattttggtttttgggagacataaaatggattcagggcttataaatgggagctcaagtgtttataacactgaaaatatggaggcctgggaacttcatgaaaagttggacaaccctaaatgatcttagtgataattttgtctacatattaaacgttaaaactttcatcctaaattgtagcctctcaaggtgaagagttccctccatttatgatgggatgaattctatgatgatagaaaaattgaacatataagtttttctcctgatgacttgctgtggtcacctgcctctggggaacctgttttctgaggatattctttccaatattgtacttgcaactcattctgaaattatggaattagtattgttagtttcctcttctctctgcctttaaacagaagtagacatagctacagttatatatttgacttggcagaattttcagttttcaaaatgcctgctatgaagggcatggtaaggaagtattttttgctgtgggatcatgattgtttctatgcacaaatttagtgagtacactctttgcttgactagctaacaagtgctatgggcttatatccatttttcagtctttaaaaaaaaagagaaagaaatgtgttcagaactttctcaactcgatggggaaattattcatgttacgtgaacagacgagtcctctccatggcagcctctttcatgtaacctctagtgagtttttactttccttatgtgtac

SEQ ID NO: 59374 - DNA, 3350 bp, Homo sapiens
tatgtgtttgtgtgtgtaatgggggatgacatacaaagcctaaatgaaatttgttctaaaattcagggtaataatctctgagaggaatttggagatttcctttttttttaaatgtgtgctcccaaataccaaagagccattccaaaactcagtagtagaattatatacaaaatgtaatggaaataccttcttagatgactttaaaatggaaaaagaaatcggcttatcctataacccgctacttccgcccagggacttgcagagaaacacctgtgcgttctcagaacttgtttcactctgtagggtggagggaaaaatcgatcatgatctaaggctgtggttgctgaattgggttattagttgtgcaccatctacttttaccgtcttttgatctggccactatatttaggttgttatggtatccagtggggagaaaaacaacttaaacttttgcaattgggaaaccaagtgatactttaaaaaacttaatgaaccttgaaaattgctactcaccgtgtgagagtaaaaatgtcgcatcaggtgggtagcaaagaaaattgtcttgatacttcctgcattctgacaatatttctttggcagataatcatgtatcttttactgagagtctgctttgtgcagatacccttatattgtccttgtatgcactttggggagatacataaaggagaaattaatattaagattaaaacatgtgaatcccatggactcaggtgaggagaaatggcgagtaaccactaataggtccagagtttccttatggagtgatgaaatattctggaattacatagtggtgatgagtgtacagttttgcaaatatatgagaaacaactgaattgtatactttagaagcatgaatattacagcacgtgacttatataacaattaaaaaaacccaaatccaaaattctagtatatgcatgatcagaaaaacaacaacccaattgcttagctcgtagtccttggacctgttgtaagacttctgtttcttatcctctgcctactgttccctgaatgatcttccacagtgactgatttaatagagttaaaaactttccgtgaactctcattgcttttagttaggtctgtgcatacagttgggcagactgtgctctgcagaagtctaagaaatgtctttctcattctgcttttttggatgaattcagactcattacatgacatttaggactgtctgcatcttagttccagcctaccattcagcaacttcattcatttatatgcccactcattcacttattcattcattttatttgtatgttcattggttcctatgttggttcattcattcatttactcactcattgattcatttaactgtattccttatcttgcctactggttgttatgttctccctgcccagtctgcagagcccatgctgtacattgtctcagcctttttcccaccttcttcctccaactcccagatatattctcaaggccctgcttctatcctgcatttttttgcacctttcttttgccattacagagttgtactttttttctttaagtgcccagtacataacaaaagaaggttctatctcagatggggcagcattattcacaactgtctccgggctcctccatgaggtgtctaaggtgtctacctttctttcaactttaaaatctgaacatgatggacctatgcttttggaattgggggtgggtagccaactaaaaaatggagagccactctttacctggatagctaatttttatgttattgtaggataataaccacaaatcaaggcacagctacctattagagctggcctgaaagctttaaattctgcagaatgtgttatatgtgccattaactccaatctgttggtgctaatttgaaatggtggtttgggaacatgtgcagttcctggtgtacttgaagatttcaggacatgaatgacaaacagtaccaataactctctgatctaacagtgagaagttatcagcaggcactgccagatttgagaatattcatcttttctcacattgttttctttcttattttgcataagtgaataaaggatgattttggaaagccttacacttgatatacattatacaatcctagaggcctttaaaaaacaggacagaaaacttacttgaatgcttgaaaggtaatggaccagattagagtttgaactagatgactcttagcagttccttctacttggatgatgtcatatgcttctcttttatttaaaatgtcattttggtttgtatattaaaacaattttagctgtatatttctactctgttcatatataatatgtatacattatgcatatataatatgtatacattgtatacatacacgtatgtgtgtgtgtgtgtgtctgagacaattgccagactcattttaattatgaagctttaaggtgattgatattgggatcacttttgcctctgcatcttaagcaaatttatgttctttgcctaatgacttctatatttgccagcatggacttatcttgagatgactcaggaatgttactggaagtgatagttgtttggaataatttgacgcatgtccctaagatggcttacttttgcccctctgtcattttagaacatacttaagctgtgcacactgggatagcttccagaagcttaaattttaggatttaattaggtcatacaatattaattaataaaaaactttttgaattgctttgtgttcgcaggtactgtgtctgatgctccacatagaaggatgaatgggaccaaaggtcctactctaaaccattcacagaggagtagtgagacctattagaaaggatttgaaacaaaagctttcaggtagatgactgaatcactgtagctcttcagcatattgtaacagaaaaagagccagtttttgaatttttatgagcatgttatagttttaaataatgtgattttcctgaactgtaatattgatgtaattctaagtcagagaagctgttttgcatttccagctcttcctgcctacttcagcactaaccaaggtaccaaacagcagcctcttcagcatatatgctaagttttttttttttttttagcttgactgggaacattttcttggggatgtaattttagtttggtgtgatatgcaaacaagcacactttaaaaatagatattatttagcattgaagtggaaattaaaaatgagtcattaaaagcggcaggggggggaagaaaatgtggtcaatcaatttcagttgcatataggtgtagatgcaaatggaaagctgcatggttatttaaccctctaaaagtcagagggtcttatgtctcctgttcagagatgctgcttatatttaaataatatgat

SEQ ID NO: 59375 - DNA, 2462 bp, Homo sapiens
gctgcagtaagctgtgattgtgccactgtaccccagcctgggtgacagattgagacccctatctctaaaaaataataaataaataaatagcatttccttccaaatgggcgggataaaaaggtttgatgctttaaagtataaactttaataggaaaataatccaccacggagcagttccttcaatgaagatggtggacacttccgttctctgttgcacagctgcagtaactgctagcggtactaatactactggtgctagtactaatactaaagctaacatttgttgaccttatattgttgctagaaagtgtaagtctttcattttttcttagtcccaaagaatacgtgtacaagatgaataccactaataattttccagaggaggaaataggcttagagaaaagtgtctgggccaaaataatgcacatccaaagcggtggagctggaatttgaagcgaaaggtcctgatccccagaacccatcatccttttacctgttttaccaagcatttcagcagaaacctggcacttgtacctcattgaccattactggcaagtcttctcatttgtatatatgtgcattcttcatgatccttttgaaagagatcttggtttagataatattcttatgtaactaaagaatgatttgtccattcttatgttttgtcttcgatcaaccaatacatgatgaaaagaatatcttgatgaaagggagaactgtgtcattgcagagtgaaatatgggtgattcatatcttaatgaaagggagagctgtgtcattgtagagtgaaacacaggtgattcatatctttgtgcggactatccatggcatatttaaaagcttagatcagctgctctttcctttccagcaggattctttgctgtcttctcagagtgtgatgaaatattcaattcttttaacattagcttgaacaaaacaaaattggagaaatagcctgtcattaaggccttctataacccaccattgttaaccatcttggattttctgtgtaatattagcacatatcaacaatttttaatttaaaattctacatgtgtaactataaaatcagaatttttcatttttgttaaagaaatgtgtttcaaactcagcttcttgaatgcttatggcatgcagtttgttttgctgtgaattgacaaagggaattactagaaaaagagaaaaagagtgcagagtttgctaaattcctttcctggaaaatagggaattgatagttgagaaatgaaagtgtgttataaagctcttataacacccactggaaaataatcattaaatattagacaatatgattggattaggaatgttttaggtagaatgaagtcaaccaagttctgtttttctgtgtggtcttgagaaaatctatgtattgaaatactcatgttagcctcccattttcattagatatattttataaacattttttggtccattgagaaagaccctttataacagaaggttaaaaggttaattttaggtctttggtctatgaacaattaaaatttcccaggaagcttaatcagacattaatgtaacactcaatcagtcccctgaacctgctgtgagtttcgccattactccttattgattagactgtattctttttgctgctaatgaattatttatggaggattccttgagagtattcaggcattgtgaaggaagaagataaaaaccccttcctctgtatagctcaggccaggggtttggtggctgctgtgactgattgtgaaggctctgtcccctgggtccctgttgtcttaactgtcctgcagctttacaaagtcttgagttactgagagaagatacaaaagggattagattatgtctagcaaacttgacagacctgagcatttagaaaatattttccacatgatttgtttatagagagcggtacaaagaaatttaggtactgtgcaaagtatttaaactttttttaaaaataaatttttggctgggcgcggtgactcatgcctgtaatcccagcactttgggaggccgaggcgggcggatcacgaggtcaggagatcgagaccatcctggctaacacggtgaaaccccgtctctactaaaaatacaaaaaattagccgggcgtggtggcgggagcctgcagtcccagctactcgggaggctgaggcaggagaatggtgtgaacctgggaggcggagcttgcagtgagctgagatcgcgccactgcactccagcctgggcgacagagcgagactccgtctcagaaaaaaaataaataaataaataaatttttaaaatagtttataggaagagatgaactgaccaaaatgcagtcaggttttttgttttttgttttcagttcgggctttattttgttttaaatcctagaagcttagtattatgaaaacaactgttttaatgcaaatatctttcataagtagtgagcgaatatatacgaagagggtgtcttgtt

SEQ ID NO: 59376 - DNA, 1057 bp, Homo sapiens
ggtgtgagcaccatgcctgtcctgctttgactttttttctttcaaaatgtgttatggagagaactgacttagaatcctattgtatacccaagactgcaaggacactgtttaaacttacaaagaaaggcacctgttttgaagcctttgggaagacgtatttcttgcagtaatgcatgattcactaagagtccctatcctttaagcaggtcccaagaccctctacactgttagtctaattggaggatgcatgtttgtgtgtgtgtgtgtgtgtgtgtgtgtgtgtgtgtgtgtattaaatatacaactgtatttccattaaaaaagataatgtaatccaggttagcttttttgcctgttaattcacattagtgagattttgttgtccattgtggtggcaattatttcttaccattccatgtgggtcttacacaattaagagaggctggttgcacagccagacttgcacagaactttctaccctcgtgtttatctccatgaagaagctgccaaaggttggaactaagatcaccaagcccttcttacttgtcttcacactaaacatgcttcatgatgttctggccaatttgtgtttgtaggtgtccagaaaagagcaatatacttacgagaactctctactgaaagtacagcagtgccccccttatctgaggtttcattttctgtgcttttagttacctttggtcaactacagtctaaaaatattacatggaaaattccagaaataaacagttcataggtttacagtcgtgcactgttctgagaagcatgatggaatcccgtatcccccgggacatgaatcattctttcatcaagcgtatccatgcgtatacacgacctacccattagtcacctagcagtcaccctcagttatcagatggagtattgcagtctcacagtgcttgtgttcaagtaacccttatttgacttaataatgctcccaaagtgcaagactagcgctgtcaatttggatatgccaaaaagaagctgtaaagtgcttccttcagtgaaaaggtgaaagttcccgacttaataaggaaag

SEQ ID NO: 59377 - DNA, 1110 bp, Homo sapiens
ttcagcatacctttgtaatactaggcctgattacagaatgggagtggtctgtataagtgagctgtggtagaaaatacaacccttcagaataagttaaatgtaattaacttcactttaccagagtcatttttgttcccacagttacccgagtactaatttctaaacttgatgtgtcaagaatgtggcagaatggtgtcaacttaatggccaagaaatgtgatctgttttgaaagagaatggaatattatagtctatagtacacaagaatggaatattatagtttatagtatactttctttgagtaacatttctgtgaacattgaaattgggaaagaagattctgttattttcttctgagacttaagagagtatcacattaaagtggcaaatttgtgtttatgccaaatgttactgtgatgttttcttctatagaatcaatccctgtaaggtaagttaaaaaaacagaatttctttctctatagctgcggatgcaaaagaacagagagattaaattaacttgcttgtacatatagaagttaatggttgtttcagataaagaatgtgtagaatcataaatttcttaggacatgggttaaatggcagacagaggaatctttgggttacattgtagacagaggggtgatctttgcatatgagcaagttttgtgtcttataggtggtgctttcaaggatgctccttagaatcgtgatctctattttgaaagggatgaggatttgatgttaatttaatattctgtctacttggcatattttggggttttgtctgatgtagcagaaaagttcctacccagaataatttttaaaacatggtaacattggattagggcagtaacacactgctcatctcaataatgcttccggcttttgaattcattaaaataataaaagcttttttttatctgcctcattatttttaatgcagttccatcatagagcagacttaatccctttgttggtgaaggtagttaaaattttccttttgaaaggaaaaaaaattatcacttctgctagttaatctgatacctttctctttagggtattttgaaacatattaataaagacaaaactaaaactaaaattgaggatcag

SEQ ID NO: 59378 - DNA, 2190 bp, Homo sapiens
acctgcaactgtccattcaatctgctgtgcataaccagtggggaataagcccattaattagaataatttaagcatctcagcttcctgcaatcttcaacctagtggggtctcactggcaacatacttctttatgaagctcatctctcatctgaaccacaggtctagatccttaatgcagtgatcagaagcttgcgattctgtggcacttgaaaatttggaagccccataatatatggtctggtttgcagattctcaacgcagttccactagggattgacacacccatgctagtctcttgtgtaattaaccacaacaacagattgtagcagaatataaaagaaggaagctgacctatgggggggaaaaaagacaaagcttattgttgtggcaaggagggacttcattcttttaggacaggctatccaggtgacctgataatggatatagaggaattccagtattgaattaggccttttgcatctgacaaaggacaggattaaaaggaataacttgggagggaatgtctgttggcatctgtttgcttgatgatccacccatgatgcctgaccggatgagagcctgtctttgggaagctcatgagtttataagaaacagaattgctgctgtttcttaaactaggcagtgttctggtgaagaacgtgggctctgggacaagagggccatttgctggttgttttctcttgtcgagttaattatcgctctgcctcagtgttctcatctataaactgtgagtagccagacctccctgaaggacacttgctggcaaggccaaaacacaagctacaaacagaggccaagcagtggaggcagggggcgccccgaagggacaggtgacaggcagtgatgccaagggcagctcttgtcctcgtcccagacttcgctactcattggctttggtgatgtaagcgctaagtaaaaagctactgctgttccaaacagatgtgaggcgaaggtttaagctttgcggtctgcgtatgaccttttcatctttgccctcgtacctcctagcatccctttctttgtgaatggtgcctacgttggattgtttatccaaaccagacacctgagtcattctagggtcctttgtgtcacccacctccatgattcagcaaatcactaaatacggtttgttcgacctttttacctgtgatttcctttttagtgtaggtaattcctcatcagccttcaaattcagctcaaatatgacctcttaagggaaagcattctgtgactctccctttcgtagtctgattaaggtgcccgttttctttgctccccaaaacaccttgtagatattttaggaaacacagcatttcttgcaaatgttaatttagtttcctccactagactcttaagctcctgtgggcagagactgagtcctatttggttttatatccctaatggttggcatagtgcctcacaaataacaggcttttaatgtttattgaaggaaccaaagaaagtaggtttctgtgagttcaccttggatcataaccatgatatagaacttatttttatggggaaaatatgttcttaccttcccaataactcagagttataagctttagagtattagcagatgtcattctaaaagttcctttctttagaatctaaattatttaaaaaacttaattttgtgtgcaggtaaattgcttgtctctgccctcatcaacatcccaggggcaggatttaaaaaaatcttcacgttgttgttttattttgtttcacttttttcttgcccatttctgatacaaaaatgggacaaagagctttctgatggaaagttattattagctccatttactagaaatgattcataggcccaaggaagtctttttgcatgtagtaaacacatagtaaccaaattaggtatgtgagccaaaggttaagagccaaagtcaaacttccagaccttaacattaattgaaaaaaaaaaattctgtccttcgaactctgtagctcaagataaatgtgattcttagaggtcgatatatttttttttttttgaagacatagtctcgctctgtcacccaggctggagtacagtggcacaatcttggctcattgcaacctcagcctctgagattcaagcgattctcctgcctcagcctctgagtagccaggactacaggtgcgtgccaccacactaggctatttttttttattttt

SEQ ID NO: 59379 - DNA, 1028 bp, Homo sapiens
ccagctgttaggaagtgctggttattttgtaatgatgcctgaaaaccatggactcctcagcattgtgaaatttggatttaggggtaacacaaacaaaaattccagattcttgaggagataagaattttaaatgattcaagaacatgcacaccaattctattagtttaaaaataattaatatgccttacgtggcagtagagttcagatcagttggctgcaatcttcagaaatatttatttatatggtgtcaacttaggttgtctctgagacacattccaattgatacttctgcctgcctctgacagacttcttttcccagaaacaccctccacatatgcttattcctgttagcttaacctagttctagaatgttcttttagggtaattgaggtaagactctcttttcacttagccaacttggagttgttggcatttcaattagtggtcattgcgggatagcattacttcactcattctcactttagatacattgctcccaccgacttatgttgtatagtagtccttctctgatagattcaccaagaaactactgttgcttagccggccaggtacacgtccacacgctttgacctcacttactgaacccacagctctgccacgctgtcctcttctgttcctgaaactctccaagcttgcacccaggctgttatctttgtaatattttttttaccctcttgcaaccaacacacatgcactattgcctggcaaactcctacttctaggagtttttggcttgaagcctgctattggcttaactagagaagagtcatatgaaggtctggagagaggccagataagtcagagctgtgcattcaaagaaaaatcaggacttgggaagacatgttcctgcctgtcatttgaaatatactgtcattggccagacctgtatttgattctctttttacattttagaagaacaatacttttaagccatacatttgataagaatgatcaaaccaccactttgttgcaggtttactgctaggctctgtgggtacatctattcg

SEQ ID NO: 59380 - DNA, 1032 bp, Homo sapiens
aagatgcttacatgctcttttaaagagtatctaaattaataaacattgagtacagaaacctaatctgaatttgtgtttttattgagagcactctcattaaacacaggctggaaaaaaaaagaatcaaccagaccctgatgcctcttgcaaaatctgatctgttccaagtctagcaggtagagtcctgattgcctttatttgcaagttcagaagaatgcaggtaggtgaagattagaatggcctcgtagtgaatatgtataagcctataaaattaaagtagaacttggttaaagagcaatacaatctcttgctatttcatgaatgcttagcagtgttataaagacgtgaacatattgctgtgtttcagtgagctacagccttaccctttgatatgcttaattattttcaaggtcatttctttttataaaatcaaggcaagctggaaaatgtcaaacagcctacaagtatagaataaactattttcattgtcattttatagtcatatatagttgtggttttgagtttcccagttacaaccagtcactgagtgtaagagtcacaataaattctcttaggaacatggtatcctttatctcttcaaccattaatgttccaaggatattttcaaatgaaagaatgataaaaattagttgatgcgttctgggaatatgcacatttaaaatttcaagttaacaatacagatgaaggtggttaaatgtgcaagagctagctacaataagagaaatgtagttgaggctactgctgaagggattatgtacttagcctctaagccacttaggatatatattaagttggttgtgctctaccattttggctgaagataattttcccttacataaagcaaatatttagtaacaagtgaggtaagtctgagttgttcattatgcaggttatatggtacggttgaaatcctgaccataccactagtctctgtacctctgagtaaccctcacattgtattgtacttaaaggtttgaggtgattcttaagtaggcattgtaactgagaaat

SEQ ID NO: 59381 - DNA, 1171 bp, Homo sapiens
tgaggctataaggtggaagattgtttcgacgacttttaacccttcacctctcctcacccctgaaagcatcagcaaacctccctctttctgtcccgaaatccccaaaggcaaggatgtcttttcctgttttctagagctcactcttttattatttgatggacctcactctactagttatctagtctcaattattttcaccttttttagcctttaaatgtgcctgtcttcctcttaggaaggaagaaagcgagggaggggaaaaaaagaagtaatgcctttgctccacctcttcctctacttatctttgaatcatctctcctttcacaattacaactgaaattatttacatttttagtcttcactttcttacttcttgtcacctccgctgtagtctggcgttcaggtccttaactcaattgaaactgctgtagttgcgatgagcagcaatctccatgttgctcaatcctccggatactctaacttcatgtgtcctgtggaccgctccctttcgggaacgcttttccctgggcttcggtgacaccatactctcctagttttcttcctgcactactgtcttcccagtcggtggggttctttcgccaccttgtttgttctctgcacactgtctgtgggttaccttactgattcctgtagcttcattcaccgtctctgtgtggctgactcccaaagttagcttgtgttttagttacctttgtatacttccagcagccaacatgggacctgttgcacaacagtagcctatgttaagtaaatgaacggactgataaatagatgttttccatgattgatactcttcccaaaatctttcattattaccatttgtcacccatcacaagaacataaactccatgagagcagagacgttatcagtcttgttcaggactgtgtgcctggcacgtggcacacgtatccagtatgagcaaaaaacaagtggctcacccaaaatgatcctggcaccaggaagtttctctttgggcctggcttccttggttactcacatgcccccgtccatgtgttgtaggaagaggaaagatgtaagcattaaggatttggctcactggggctggtcctggtggtttggaaatagcagatctctaaggcattccatcacctcatgagagaagtcttatttatttatttatttatctat

SEQ ID NO: 59382 - DNA, 1043 bp, Homo sapiens
tgaagtacccatacatgctccagcacgggtgaacccggaatacattatgcttaatgaagggagccagacacaagacgccacatgctctgtgattccgtttgtatgaaatgttcaaagtagatgaatccatagagacggagtgcagattgatggtcgctagggcttgtgggaaggggcacccgagagcagctgccttcagtgggtatcgagttttcctctgtagtgatacaaatgttttggagctggataggttggtggtcgtttatcattgtgaatgcactcaatgttactgaattgttcttaaaatagttaattttatgtttcacctcaagaaaaaacaataatgactaagttatcccgcggcccctagctctcaggtattacagtcagttgcagcttttatggagcacatatttgcatgttattgggccaatagcaagttaaacaaacactgtgataggcaaacattatcttgagcactttacatgtgtggacaagcacaatgactgacgtggttcccagactccagccgagactccaggaaccaacagcctttaagaattaacaggggaacagacaaaatatgaaggctgtatgttgatttagcagacactcagcaaataaagggcttacattttggtgacgccaacagctaaaatgctttttcacacagtgagtagggtgttaccagacttacatgtgtgctcaggcagcatgatcttatcctcctcctaatcagggtaggtttcagtcatgcatgctggagcaaatgattccggtgagagaatctgaaagaaccctatacaaacatgtacctttttttctttaggactgtgaagggaacgtggcagtgtgtggcctggtgcagcctgtgcccagagggtttttcacgttcagtatagacctttgatgttctcaggttattttccaagttgcccagaagcatgacacatacactgcactaaatccttgaggagttgcaagaaaacagatagtgcttttcttcttcttttttttttaaaaaagggaggggaacctagtcc

SEQ ID NO: 59383 - DNA, 1011 bp, Homo sapiens
catgcccaaccttatactgtatttttattgtacctcttctatgtttagataagtgtagatacataaatacctaccattgtattacaactgcctatagtattcagtacaagaacatactgtacaggtttgtagcctaggagcaataggcaatatcatgtagcccaggtgtgtagtagactgtctcatctaggtttgcgttagtgtgtctatgatgttgacacaaggacaaaatcacctaacaatgaatttcttggcaggtgtctctgttaagaagacatgactccagtactctcaggtgtaagctcttttccagtgatgacaccggcactccctacccccatccctctggaaaaagaatgatctaaaatgttatgatttaaagcaaaaggatatgcaaaggtgaatcagagaaattcaaagaaaggagggattatattaatgtcatataaaaataatttaagataaaaaacaattgataggataaacttgatatcttttataaaagaaatatacctttttttcagttatctttgaaacgtttaccaaaatcaattcttgattgtacacagacagcattggttctacctcacccaatgcgtgggagcacagaaactctattagaccaaagtagaaatcaaaaccacttagaaaactagaatagagaaccataacatgtactgaaagaaacaaagtatactcagaaattgataatctgaaagtagtaatttgtagactatgaaaccatagaaaataatcttctggtttaaaaaaaattagagggttgtttgaaaaataacatgaattttgcatataaaaaaactgaaaggttttgcaaaatacagtatttagcggtcacaaacagtgcaggaaaataagaagtctacgagctttaagaaatgtagaagattacttggaaagacatagtatgtttgtagatgataagactgagcattataacgtgtcagtctttctcgactacgtttcttgaaagcagttttccaggtaattttt

SEQ ID NO: 59384 - DNA, 1420 bp, Homo sapiens
tttattctgtgtctgcacagtataatatacttggaattcatggctactttacacatgtttcatttacaatgtatttgaaagccctccttaatgaataatgataattaggtgattgacatattctcccacttgacaatcacacatgccagtaaattaccctctattttcctggagtgtcggcaataaatgtttaaaactttcccctagcaaatgtcattcagcaaaatcctaacagattagaagatactctgtttccccaaattgagtgaatgaccaccctgtgaatggccctgtcttcctcgatagttcacagactacttccagatctgtgatggaaagtatagttcaaacttaagaagttagatttgaatatttaaagtgttttaatcctcaggtggtagagggattttcaagtctggagtacttctgtactgtaaaggttatgcataggaaaaaataacctttttgtttaataagcagacagttattactccagatctcaaagaacaaagcatttattttacctgaattgtaaacctctcccagtggtgctttttgttttatctcctatcagttggataatactaagtttattataataaggtatgtaaaaatcatcttgaagcctgactctaatttttggtgcaatataaagggatatttaccatgttacaaaatacgatgacacaatattttctactcaaatacgattttgtaaataaatgaatgtttgtctgtatcaccagtgcgttttctacatagggcacaggcgcagttactccttgagctatacttagtttttcccccaataatttctgaactttgaggtgtattgtataaatgataaaatgtgtatatttaaggatataatttgatgatatttgagtatagataaatgcatattcatgtaacccacactctcattaatacctaaaagattttcatgaccttagaaagtattgtaatattttagatatttctaaaagcagcagagattcatcgactggtgatcagagcaaacgttatttcagtttatcaggtgcttaccagatgaaagtgtgaagaagaaaggcagatatattataactaataattagtaattgttgagactccactctcctggaatagatccactgttaagaaacaaatgtagtcatgcagcggtgtgtacctgtaattccagcattttgggaggccaaggcgggagggtcacctgaactcaggagtttgagaccagcctggccaacatagtgaaaccccatctctactaaaaatacaaaaattagtcaggcgtggtggcatgtgcctgtagtcccagctactcaagaggctgaggtaggagaatttcttgagcctgggaggcagaggctgcagtgggctttaattgtgccactgcactccaacctgggcgacagggcca

SEQ ID NO: 59385 - DNA, 1731 bp, Homo sapiens
tggagtgggtgtgcctgtttttatgctgtagccatgcatgcacttgtccattcattcatttgcttgtttcagtaaatattgatcgagcaggtatgatgtggcaagcgtgaaaatacttccacaaagcaagtaactcgagtggagcctctcccacttcagtggtgtttttggcttatactctgtctacggcatttctcaactgtatgtaaatgactcccggtctaggagatttaaaatggtgttgtgtggtattgttccttggttcattcaagttcagtctttaatcttttcagagtagctccaaccatcttttggggctttaccttcctcttgaatcatcaaattcttgaaggtgatgggtgccacctgcttgattccagaaggaccgtctctgatccctggcattgttcattcaggtgactggcaattgaacatccatcccagatttacagttgcgatcctatgggaaagctccctcctcctgccatttcacctttggaactgttgctacactctggaagattttccagtaactacatctaattagaagggtgaataaattaccaaagcaagttaaattaccttgtgtgtcataacaataattaacattcaaataggaaaccactgccatttttataaacatcactaaatggaggcagcaccctttttgaaagcaggaaccaagagagtagcacctccctaagcctgctgtaaggatggcctgggggagttgctaggcgaaatgttgagaacatccgtctggttgagattgatgtcattggagaaattctttaattgctctacttaatatctgaatccttcgaagtagcaacttttctatgtactaatcattatccactctgtcctcatagctctatgtgttttgcttatgtcttccatctttcgagaaggaatggaaattgatctggtcacaagacatttttggactaggctttacttagaaagcaggtcacagcctttttagaccccacctttcaacagttccactccttccttgctcatttaatatacctacctttgttcttttttgctgttcttcttaaacattttctgtcctgaaaatgtttattcttctccatgatgctacttcggtgtggtctcttgattttatgtttgtgcttttttgcttttctatagagtgggattatcaattgcttttatttattcagtaggctgccatgtctagaatttatttagacaattgaaggggtaacttggtgcaactctggcttaaataataatgagttgttaaaggtttttgttttgtcctccttttaaacttataaactcttaaatgatgtttggattgtaagtgatggcatgtaatttaagaagacagcattgaagttgtaaatttgctcataattgagagattgtccctaacatactcctacatgtttctactgaagagaacagtatattagcagagtgtagtaaggtttaaatcacctgatttcttaatattatgaataggtggctcttgtgttttgaaaagatttaaccaagccataaataaaatcatagatctttataccctcaggccaaatataaatcacagtggttcctgtaatatccaaacagcaggcctaaaaacaatttaaagtttcttttccttttcctttgtgtttcaccaatttgggttaaagtctatagtttggggattcagacattatgtttgtatgttatacgtgcattcttttagttcaagag

SEQ ID NO: 59386 - DNA, 1150 bp, Homo sapiens
atttcaaataattctttttattattacaaatgccccctgtgaaataagcaaaggtaattatctctacgtgatcattggggaaatgtaggtacaatgtaattaaacaatttatttgggaatttagtatgctagtgttagaattcatttttcaaatctctctacctggcttctctgctttaagttgtgtctatgtatctggaggatatgttagcccactggtgcttggcacacgggttgtagaagtactaatatatctcagagatggacatccttcatcctcttgaacgcatcttaaggactagatcccaaaggggacccctatgtgtctgtttcataattcagtaactgaatttatttcttataaataaaaccatacaagttaagaaaaatcacatacctatggggtattctgacatttcctgtgtttttgtgtagaggagatctttggttgcatgaagtgtgaatcatgaaatgatagaatttatagtattttctttgaatttcctgagtcctctagatgtcagacaggatgtcagatgtactgccattactgaatagtctcagctgtggggagtggcagggatgtcagctgacagcctgaaatgctttgcattagttttgtaagtacacagattccttacatcacagctgagtataatgtcaaggatgcctcctacttccactagagctgagactagtgtatctgtttgaaggttggatggaggaagagtacaggaaaacctttgtccttcagtgcaatcatttgtattagaaatttgtaaaatatactctaggcgagacattgatttgccttgctctcttgagacactgctttgcatggccatttctctcagtggaatgaaacctctgttcacaagagcacttgtttccacatcccagaggcgcatggttcctaccacttctcaaggatgggaatgcatgtggagagatgaatgatagtaattttcatagttaaatgatcactttatctgtaggaaacaaatagaacccctatgatggacatattagagtagagtatgttcctccctgatattttgttgcttttaaagcacgtcacatctctttatggctccttacgcctctttctctgtttctgtcagttctggggagtgtttctaaagggaggaat

SEQ ID NO: 59387 - DNA, 1687 bp, Homo sapiens
gtcaatgagctctctggtctctacctgtgaggacactaatcctattgtgtcaggtccccacctgtatgacctcatttaaccttaattactgtctgagaagccccttctccaaatagaatcagagggttagggctgcaacgtaagaattttgggaggacacaaacatttagtccataatctgtgatattgttagaagcaagaagtcacacatctgaggtacagattgaggatggcaagaagtagtctccccagaggaggcctggtcattgttgaagacagccaagagttggtgagtttgatgccaatctgggtgcttctataattagaagatactaattatactgacccattcctatttatctgttctaatttttcagtggttacaaggttttcccaataggaaaaaagggcaatatacttgcttttctttctttttggattttaagcctgagacctctttgggtcatgatatatatatttagattctttcagcatgtgtaacaatatcccagaaaggactagtgttttatattcttttaactcctggtttttctacctactgcctttactgctttggtgctcatgggaatactgccacttagggaaaaatacaacctgatcttttgtggatcttggagtggcttacttggtttaaaataatctgggacgtggataggtggagttatttcaagcccttcggctttacttccatgcctaatgtcttttctcatcatttattaaagcgctttgactttgatatgtatcctgttaccaccttgtaaatccttttagtaatacctttctatgatgaaggtgtaaacactgctgtttctaccgcatttacttctccctccgtgtcatttttataggactttaaacctgctaatgttccaggttattaatttaaaacagccagccaaatagtagaagcttctttctcatctgtaatgtcctgacctcattttacctgtttccttttcaaattcagtttggaaatctcaattttcataatcttttgagctactacttcacttccctgatatttgcaatttagcagccttattattttcaagactttatatcaggaccacacatgaaataattactttttttttttggtgctggacatactcccctagctagtcaggatttttatttatctttctttatcttgtaggaaatggaattcttatttgcattttccctgatttctcaccttgcttcttcttaaccttgttctgacagtatttaagtgatgtagcttggacattgtttgcttttttatctcttatgccaaccttcttgtatttagctacatgcttagagctgcccaattaaatggcatccagtaaactgtattagggtttgtgcttgaaaatgctttgaagacgcagttgatgttttctttgtagtttctcgttattcctcaagtttgtaagttagtctaattgaaaagtattgtctggaaaactgcctcgtttacatgcagatttcattgattgccctgggcttgtacagacttcgcaatacttttgttgatggagtttctcttatgtgaaacactttagctacctgtccttggttctggactctagctttccaaaagcaacatggagaatttaaaggggccttagataaaagccaaaaatagacttagaagataaagttaaaggggttacaattattt

SEQ ID NO: 59388 - DNA, 1153 bp, Homo sapiens
cataagaaccttattgttttctcagagtgcttttgggtccttatttgatatcttttccactcttcattcctatttgtttctcctttcttttcttttcttttttttttttttgagacagagtctcactctgttgcctaggctggagtgcagtggcacgatctctgctcaatgcaggctctgcctccgggttcacaccattctcctgcctcagcctcccgagtagctgggaatataggcgtgcgccaccgcaccaaagtgctgggattacaggcatgagccaccttgtttctcctttcttaaacgcagatcttttgactggagctgtggaactggggtcagagttgagctccatcagcacatcacctcgttatctagcacatcacacctactttgtatgtttgtgtagcagaccatttcttctttcgtgtttcctcattttacatttcatctcttcagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtaagtattcagagggatcattttgagagaagtgctgtggacattgacagtgccagactctcacaggtcaagttttcattgtctcttagttttggggctgatatgaaatgaacttgggtctttttctgagggctttcagaaagttagcaattaaacaagaattctaaattctgttttttgaattcacccaccgtgctgttctctggtttcagagtacttgtgcatggtaagggactgtgaggaaagactttgaaatgattaaaaaaaaaagagcatgttttgtctactcaaccatcaggtcagctctgcctttcactgtctttgagctgtactagaattgtgtgtgctgcagaaaatagacagtaaagcgcctggttcttgtccataaaatgcagttgtgtttggagaatgcaatagattattttcctatgcatattgactagttttgcacattttacatcttgctggcatttctgatgcttatgtatttgtgtctt

SEQ ID NO: 59389 - DNA, 1004 bp, Homo sapiens
cctacttcccatgcttccttttttttttttttttttttttttgagacagagtcttactctgtcacctaggttggagtgcaatggcacgatcttggcccactgcaacctctgcctcccgggttcaagcgattctcctgcctcagcctcccgagtagctgggactacaggtgcctgccaccacgcctggctaatttttgtattcttagtagagacggggtttcaccatattggccagactggtctcgaactcctgaccttgtgatccaccctccttggcctcccagagtgttgggattacaggcgtgagccaccgcgcccggcctcccatgctttctaatgctgaaataaaactcttaagtatacgctacggtctgtgtgtggtgctttatacgcaccattttacttaatcctttgttaagcagtattattttgaggaaacagattgagagcgattatgtaacatggccaaggtctgacacttagtaagtgataaacttgggtcttaaatactagtcttttggacttgggcatttaaggacgactagcctgtattacctttcctttgagatccttcctcagataggaggtgaatttaataatctggatttcttgaaataaattagactccacaaaaacaaatcctgcctttaaaactgatctccatatttccccttgtttgttacggtgccagttctttaaacatttgcttgaaaagagaaatgtacatgttgcttttagagacacgtgtctcctaagcacatacaaatgacagtattttgccgttgctgtgcctgggagtttttattttagttatttgggctttaaaagcagcatatgatggagtttcaatatgtcttaaaaccacggagtgctaccatgatacgtacataaataaaccgtagggggtctctttctttattttgcccatggagatgtctgatagctttcagaaaaaaggcagccaccctaagtgactaatgtcacccatttgtagggaaatagtt

SEQ ID NO: 59390 - DNA, 1026 bp, Homo sapiens
aagttgcaggagttctgtagcccctttctttttgccaatttcttcaattaaacctcttttcttataaattaaaaaagtaaataagtaaataaaataaaaaatagctgagcatgatggcacatgcctgtggttccagctgcttgggaggctgaggaaggaggatcgcttgagctcaggtattcaaggctacagtgagctataataataccactgcactccagcctgggtgacagagtgacaccttgtttcaacaacagcaacaaaaacaacaacaaaagccacacatagcctcttctgtatccaacttttaagtgaaagttcttaagatcttcaatgtatgattcttaattttttccgtaataacaacactccagtgttttcagatgtttcagattgtatctgtttttgtgcagtggttctcaaacttcaaggtgcatcagaataaccgattgctgaagtttctcatttattaggactgggtgggactcaactgcatttgaacaagttcctgacttactgatgctgttggtccgtggccatacttcaggaatgactgtgttatcatatttgattcttcgagaatccagtgagatcttgggcagatacagatagggaaaatgaagcttgaagacatttgtgatctttttccagcgacacatcatgaattaatggttgaacaggtaccagaacccatgaagacctttctggttttctcctgctcatggcaagagttcagttcccaaaagacatctctctgatttcaaatatgtttgatctttttgtcttattcttttaagagctattcatgtgtttggatacacacccctaatattcacatttatttataatatatgcttaaaattttcttgtctttcagttacatgactaatttttgtgcctagagatgttctaaaaatgcagtgtctttctgaagaaacaaaaccttacataacttgtcaaggccacccaaggttaatcatgaggaaaaacgttgaatttttttacccaccagcctagtcttctggc

SEQ ID NO: 59391 - DNA, 1030 bp, Homo sapiens
ctaggtttggcatgtctactcgtgagataatgtctgtgaaaaactgtggcatgcagccgggtgcagtggctgacgcctgtaatcccagcactttcggaggcctaagcaggcggaacacgaggtcgggagttcgagaccagcctggccgatatagtgaaaccctgtctctactaaagatacaaaaattagccgggcatgatggcacatgcccgtagtcccagctactcgggaggctgaggcaggagaaccgcttgaacccaggaggtgggaggttgtggtgagctgagatcgcactactgcactccagcctgggtgactgggcgagcctccatgtcaaaaaaaaaaaaacaaaaaaaccccacaagaactgtagtatatgaagtgttcaaaaaaatgtttacttttccccttaggaagtgtgtagacccccttgatacttttttaaaacaacaacccacaggttaataaatcttttgttttaactttcccagtatagtgccattgctcatgtacctcttaaatttcatgatggtatgaggaacctttagagctgcagttatagagaagtacataaaaacagcgtacctctcttaattgtgcgccacccccaaatgaaagagaacataatgaccaatttgtatccattttgttccccagcactggcttgcgtgaacatgatttagaatgctttgctgcttttgccattttggtgtacgtttgaataaaagggaaagcttgaaaggggacacaaaggtaagaaagaaaagaaggcctagaattaaagagggagaaaaagaagcgtgagtacccggagagctgcgaggacgatagcagccgtctgcggctcggaagaactgattgtagatctacaggaagtgtgctgttgtgctgctggcggaggccgtccctgaggaagtaggagaagaccactagggctgtgtctaaggtaactgtaaggcctctccatcctttctgctgattatgactagcagctaatttggatctgatttatactgtggggaagaagctt

SEQ ID NO: 59392 - DNA, 1348 bp, Homo sapiens
tcctctgtatcgtaagatattactctgagaaacaccccttcattctttcaggtgaaaggcagcctattatcacaggcagccaaccactgcaacagctggtattgacaaaggctctgaccccttttggttaaaaatgaagcaaaaatctgagtgttcgtagggcttcctaacctccggttgagctatatgtaagaacccttcacccattataataatccaggtatgcgatgttgtattacagtgacctgcagggtcatgacttagtgagaggcattctttgtcaacacagggaaagttaacacagaaggtaaaatttagaagaaaggtgaatggttataatattctttcagtgcgtgtgtgtgtgtgtgtgtgcgcgcgtgcacgcacatttgtgtgtatatatttgtatattccttcagcaacatgtcatatggtctaggaatccctgggcgatttctggttttggagaataggatgtgaatgtacctctgaaactgacagaatgatgtattaccttgtaggtcactggagtagagtccagatgtgcttaagcatttatgaaaagttacctattgtcacagaggccccgtaccacatgagtcctgtgagactttaaaggaaatctaaccaaaattgaactctatttcaggtatagcattttctgtggtttgataatgacattatacctattaaaataattttttgccctcattattaaaaccattagtttatttagtgacttcacagtcacaagttttttatatttcctgggcaagcaaaacctcagtagcataaacttagttttgtcactgccccggggatcccacttcatatgggccaataaatttccaggcaactacaagtattatgtcatatgtgcaaaaatgtgatgtcttttttgatccaaacctttgccagacattcaagagaggttaggatgtagtaagtgtttgtaaaagactggagctctcagtaggccaagtatagcgtagaaactggcagtggtgaaaacctggctgcaggtacaagagaacacacgtatatggattgtagttacagctttagtgtgagcgaattaatcttcattgtacgagggacccaatgtaattcttcagacgtttttgtggaaaatcttcgtgaaggagacttagatcattgttgtgccgtagaatttctctgataatggaaatgttctctctttgttgtgcaatatggcaatcagtagccgttttcatgtatcaaacacttgaaatgcgttgaatgtgactgaggaattgaatttcaaatttaattttaatgatgttttaaatttaaatagctacatgtggttagtgactaccttttggat

SEQ ID NO: 59393 - DNA, 1060 bp, Homo sapiens
aagaccacagagataaagtgccgttttcattacatcctacctggaatatgctctattgacttgacttgttgattttgaccttgatcacctagctgaggtcgcgtttgtcagccttcgccactgcagagctcctccttttcccttccacactgtcctcgtcacagggacgtcactaggcaccacccagacctaaggagaggggagccacgttccacctccttgaaggaggagtatttaatatgtaaattatttggaattcctctgaacaggagatttgtcttttatttatatcagtatgtattcgtacacaatttattttatatctctagttataatccaatactactttatgttcttgcccaaaatattctaacttttggccgcagggaactttttcagttgatttctgtgtccgtttgacatatcctcatcattgcagagttgtttttttttttctttagcacctcctcactttctggcactacaagatgcttcaggcttattttttatgtttcctgctcatatcctagaagcagccatttcttcaatgtgccctgttttcttttattggagaatagttttagaaattggagaatttagaaattggagaatagttttagaaaacaagattgggcactatttatgtttattgctaatgagttttctttgcttctaggccctatgaaagttttaacttttaaattttttaagctgcttgagctgctatactaagcaactatttctgtaaatgttggtggccaaaagtgttaaataaatagtttaaaatttgtttttcattggggaaagaatgttgtattgtagttacagttgagaattgccaaaaataaaatttaaaaagaacaatacttagaagaacatttctaaaaacatttcttagaattgtataattgtctcagtcaacttgcttttattatttttcaagataatttttaatgattttatacaaagcagtgattccctgggtaatgattgtgaagattttgccttttgtgcttctcttttacagtggatttttcatttatttaacttggattagaat

SEQ ID NO: 59394 - DNA, 2029 bp, Homo sapiens
tactttgtttaacttccaccttggataaagccttggtgtcattgtcaatcaagatctcctggtaagcatccaccccaccaagccagcgaatcaggtgtgctcttctgaattttgtacgtgacaagatattggaaatgtgtcaaacgttgtcctgaagggagggagtatccagtaatttctgtttagagccctgtaactgctctaagccctcacagtaaatacttttttcaaaacaaaacaaaacttaaaatagcctggttggctgtataccaaagttccctgtttggtgcactgaattggaaataattccacaagcagatgcattcatttgtttaatccaagaattattaagtgatttccttattctttatatatccagtgtgaggtgctgagtgcattcatagaagagaaatatcaggttccctgtccctggggtgtgctcagctcagtgacttcacagagggcacgtgatcttagagtagtagcagacgtggagcatagcctgaggcacaatcccagactgaattttgtattaggtatagtgacagttaatctaactctaaaaacatcagttatggacataaggatgggaacagtaggtactgggactactagagggggaagaggggatgggggcaagggctgaaaaactacccattgggtactaggctcaccccctgggtgatggagtcatttctaccccaagcctcagcgccacactacatacccatgtatcgagcctgtggatgtacccccgaatctaaaatagaagttgaaattataagcaaaaatttacattaaaaaaccctttaatgcccattagttacttataatctgtttaaagaatagccagttgctctcagccttttcatttgtttcattaattgcatctgtttatttactcagtctggtcaagaaaaatacccttaatcgtttatattaaaaagtaggtgccactataaaattctaagcttttgctgaaaatcgtgacctttgattgttcatactggtaatttatttctcatttttatgttgcaattacaacattcaaagcagtagactaagatctaatgatttagaagcaccagaggcattgctgggccaggatgacaagcctttaatgactctcttaggcagtaaaaaagccactgcaattgctgtatgaatattcatttaagaagcattcattggttgtaaatcttttaacatgtagactttaaaaaagatgaataacatactatgtaccccggtcattcttattgaatgtgtcttcagatattttttatcaaattcattttactgctctttttgcttatgaaaataaaatagtatttcattagttgagctcatttgaatattagaaataaacagagttcatatcatgtgaaattgctgacagctcttaaaatcagtcctgcactttgcccagaggcattattcacattgctggttacatctgttcttgggaaagagaacctgccttgactgtgaatgggggtccagtttgccccaggtttagtccctgtgatactcagcaaatgttgcctggttctttactaaatatggctaccctgtgatgagaagctttgggctgattgggccttatttgtcttcttttctcttactgggaaagcaaagactgctgaacataactgatgtcagaatgggcccgtgttagctatatactgtgtacaggtcaagcacataactattaatagtaaaaatcaacttagacaggggaacgggattcagatccagcagttttatcctagcccacactcttaaccacaattacaatggcaaacaaataaatatttttaattgtatgcagtatgatttagtattggaaagactgtttaaattttttaaatagactttaaattttagaaagtgtagatatacagcaaaattgtgaatagtacagagtgttcccctatatattctgtacccagttttccctattgacaccttatattagtatggtgcattattacaattaatgaaccaatattgatatactggtactaac

SEQ ID NO: 59395 - DNA, 1735 bp, Homo sapiens
gtgaaagaaaagagggtttggagcacttcattggaacactggaagcttcctggtcaagaaaataactttgttagaaagagatgacacctaagtattttcttgagctaatttgtgatagctgaactgtatctccttgtaaggaccaccctaggtttctgtcttcttacgtctaaattccatgcctccttttaagtacaaaacttcttttattgtcatcttcatagactccacccttctggagtaattttgacagttcataagtgaagtgacagatgagaagaggctaaattcagtgtagttcggagtgggttcaaaggaaccccctccgcagagcagcacactggtatctcaggaattaagtctggctctcaggctaacagatgtaaaagatagttctggcctgatgtatttctcctgcaaatgaagttatgttagaatagtttaaaaattaaaagccaggagattctgagtcaaggcctgaagagtttgcttatgagtgaaattaatgaatgaacattaatcacctattttgacaattcatagaatttttttcttaccttctgatgattgactgtgttctaaaatgttaagcatgcagataaatggaccttttgggtaaatgacagaatgatatcagcatttgtctctttggaagctcaattgtgccatttgaaggaaaagtggggattttaagctgtcgtgccatgtaagagtatatatgtgacatgatggtccagaatcttgctaaaccagtgaagcaaataggtaaattaagtggtgagctttgacaaaggtaagattctttgatttatcattcctccatttcattgggttgttctaaagaaagagttaagccaatttatttagtaatcatttactgagcccacattctatgctggacacagtgctcagcactggaaatatagagacacaggatctgctttcaaggagctcacacttgagaagggaagcatggcaggtaagatatgggggcttcagcattagctgtttaagtggggtctgggaaaaggaattggtacaaagaagcctgttttcattaatgtgaggatgagtgacaggtcaggaaatggggaaagtaaatttaagagattatagggaaaaaataggggaaaaatagattataaacctattttatttggcccacttacagtttttggggggagtttctgtttttattatcagcatataaaacttgggaaattacatataaatatatttctgggttctcttacaaaacacagtagataccctgggctctgttttcacacctgactgaagttagctggcaatggatagtgatctccacctttagcaggcactggtactctcttgttctccatccggtccacttaggattctcctggctcctctatatttgagtttgagacttctagtttagggtattttcacatcttggcagtgatgggaagcagctagataggacagggggaagatctggactaggagtgggttgttggtgcattaaatatgaaaaagatttgaggatgttattgactgaggtagaagagccaggagcaagtgagaaacccaggagaaggagagtgtgttctgggctgaactgtgtccccgcaaattcatatgttgatgttctaaccaccggtacttcagaatgtgaccatatttggagagaaggtctttgaagaggtgatttaacatgaggcctttagggttgaccctagtccagtatgactgg

SEQ ID NO: 59396 - DNA, 1007 bp, Homo sapiens
actagttatttattggttagaatgacaaatctacttgtctgagaagatgctgagttagaagttctgttcagacagtccccaaattgcctttatgcagcacagtggataaaaatctgaaaacagaattggttattgatttttgttttgcattggtagcaagagaagaataatactgtaacttttttttcaagcatacaagttctgtacataatttttctctgtcatttttgtgtggcttttggtaccactagaacattccatatgaccctaactctatttcttatatttctgtgagattctttgagtctaaatacctctttattacaagtttctttacccatgggattcctgttgcttttacttaagagatagcccagaactcctcttacattcttttcagaagtgttcatgttggtttatggtagaatagatttcaatgtaggtttcccttccttccttccttccccattttgatgtttagttatatgtcatctggattaatttgtttttctttttttaaatttattttaggcttaagttgtatctagatttttataaaatacattttaagactactcttttttccctagtatttccacatctaattgaagttgtcctaaaaacagtggaggaatattattttattcaatattttctatagaaagcccgatccttgccacacatgcagcatcagggaaagcctcagctgagacgtggaaattgaagacagcatgatgggtaattcatcacaccagtgaatttagtatttgttcacccttttataggctttaatattgtgatccccactttacatatgaggaagtgaagatttagaaaagtttagtaacttgccttaagagtgtagcagaactgggaagtttgctcttgttgttgttgtctttgttgttttttgaggtggcatctctctctgtcacccaggctggagtgcagtggcacgatctcagctcaatgcaacctcgcctcctgggttcaagcgattctcctgc

SEQ ID NO: 59397 - DNA, 4464 bp, Homo sapiens
tttgttgttactaaatacttgagtgattatctgaggtaatatgtattcttctgtatttatttatgtgactttttttttttttaccacaatcttgtacagggattacattttactcatctttatgctacccatagaatttttacacagtagatattcaataaacatgaaaaataaatatcacacaatatccaccttgttggattccaccacttactaacatatctgcacgtatatacttcaagcaagtatcaagtttctttattggaagatgtcatgtaaagttcccaagtctcatttttggttttatatgaagaatctattcattggtaggacatattgataaaaattactacctcttcccccttttatttgtctccctcttgtgtactttctctgcctttttcctaaggtaaatattggtattgtctatatgctttcatcacaggtacaattaatttagtagaaacattgcccatctgaaagaattatatattgtggtatcagtggagagatgtttatttttttttaacattttgttgttattggttaataagaacatgaccaagacaagagctttaacagagatgtgagatgtgtattcaaccagtctctgaaaatcatttgctttttgtgttttatggcagtaccttgtggatctgcatttagaatgataattcatgctaacgactttcatatcccatgaggtagcagaaatcaatgctaaaatggcagaatgaaacggtatagcaaataaagtcaatgagctgtcaaagaatttttcttcatcaaacaaatcccaaagcactggtgttatactgaccttccctcactcctctttcctggattcttagaccaatttggttcatgatttttttttcctataatagaaaaattaacaaacatgtttggtcagtgaaacagaaggtatttgaaaatgataccttggagcagtgtctcaatcttcaggaaaatggtgaagaggaaatacagcattgattgctgttgctaagcaacggctttcacagcagacgcgcctgggacagtggtggtgtctgccagcacaccatgcggggccgaaagcagtgcagcactcatgtttctgcgaaatcagaattgaagccctgcatttcctccttcctctcgactttctctgatcaatacctgagaagttaagatcgtacggtcaaatatatagactgtgagaaatttggagcaccttggggatttttggagagctgcgaatggatttgtagagccaattctgttttttttgtttttgtttttttttttttagtttcgcccttgttgcccaggctggagtgcagtggcacaatgtcggctcactgcaacctccgcttcccgggttcaagtgattctcctgcctcagcctcctgagtagctgagattacaggtgcccgcaaccacgcccagctaatttttgcatttttagtagagacggggtttcgccatgttggtgaggctggtcttgaactcctgacctcaggtgaaccacccacctcggcctcccaaagtgctgtagagccaattctaaaggaatcagaattcctattttatatcagaagtactgttagttttctccttcatgcatttatccatccagtcatgcctatgttctcacatatttagggaatattcaaggcaccctgttacacttaagagcttggcatctcttacgttgctgacatgtgcactatgcgtgtgatggtaggcaccattgctgcagggtggtgtaatggagagcatcctcttaggactgtgactctcaaactttagggcacattggaatatcctgggcagatcattaaaagctttctcagccccacacttggtgaggtctgttacctatttccagacctctggaatatgtcctgttacctgaggtctggaaagtaacttaggaatatgcattttaaacaggctctctaggtgattctgatattggtagtagaagagccattcttgagaaatactgaagtcgaagaattagtgaagatttgacagagttaccagataagatgtcatttgtcagttgtaattcatgaacggggaggctactaactgtagttttacctgttcagtctgttccctcccaggttgcctctcctgtgtttccatcttggacttgctcttgattcactagagtcagactaatttgagttctttccagaaactggaatgtgattattccttagtggggaggggtagccccccatcactgcttgggactcatgcaagagcaagaaatgcaagtatacaaaagtacccaagtcttgatctcagtgttctgcagtacaaaccactaagacggaaatttcaaactgcctttcactgaaaacaaaaagcaaaagaacaaggaaacatctaaatcaaccagttacctttttttttttttaccccaatgctgataatatttcagtggtctgtcagttatgaatctgaccagtcctttaataaaatcttctatgcttataaagcttaagtgatttttgcttatacagtcttctaatagataactctttttttccccctcttgttatatataccctgaatcccagttttggtcttaatgcagaccatgtttaagatcttggccttatgccattttgtagtacagataaataattaatggtttttattagtttgtataattcattaaccattcatctatcaagctgaatgacttatagatggcttttacatttcaaattgttcagaagttattaaggtctgtaatttatcatcacagccatttctgacctcgttcttggtccctcactggaatgatgttcattgaatgtgtatgacacaatatgaagaaaattaagttgcactaaagacattaccaatatgagtagggaggcttaaaatgttggcagtaatcaatagtgggacttaatttgtatattctgtgatggagacatttttattacatttatatttttaaaattgattccatttttaaattagttgccctcatttcagactatactcaacagcgaaataatatattttctgaatctaaatcatcatatattatttgacctttagctgaatccagtagtaaagatcaaaatgaattatgcttgagtggaaagaggttttaatgttgctttacacttggttttcccccattccacatgctgtttaatattattgattcagcttgaatgatcatgagcccaaaaactactttagttggttttggctaatgcattcttggatgctatggaagtgcctgtaacacctgaatggttctgcgtaaatagtcacgcatttttataccgtccacgagaggacatgcaacgtgattgcctatgagcagcagagaacagttttctagacgtatgtttttcccttggtacaaacatgtagcttccgttagccctaataggagctgcgtgtttgcatctaagaattcagtatttagaatatgacaagcagtgagtatttgaggagttattactgaacctttcaaataagttgaaaggcagacatgattttgagtactggggaagtgtattaatcccttagaagtgaactattcagaatatttaactctattatcatgaagtgttagtgagtagggaactatccacatgtctagattcctttcagcttaatagtgtctccatacattttacagtcatatcagctcctcgtaatgcacttcaccacgtgaagtgaatgaaatagcctcagtcttgttcacaatgactgggcctttcaaactctccttatttaatttgctggcattatgatggctcttgcaggacctctgttgcagaatcaaaatgtgcatgcagagagacagctgtgctttgatttagcctatgagataataactatcattctaaaattgtcttacatcatatagacacaaatttcaaatctcacctattttcccagctctctcttcagatatgactttgctagaatgaggcatattcttccttgtcactcttcatttttaaaaaaattttgagaatgtagatttacttctactctggcagtttgcacatcttggttaactagaccaattaatgcaaaagaataacccccaaatttactgctccccaggttattgtccagtccctgtctcttattaatgtgattcctgtgaaaacttgagattgaagaatatagtgaaaaagtaccatctaccccaaaagcaaatctaaaatgagaaaactttcttaagcaaattctcccctaccaggcacatgtgatttatttttcttccttccacttagaattgaaaaaacatgattcatatcccatcgttgttataattttgtagacttcagagcttttcttttttcttttctgttttagttaagttgtacgtttctttgtatgtccttttgtcttttactgtttgtaagtgtccttgatagatattaccataatggccctttcctttagcttatactcctatgttatgat

SEQ ID NO: 59398 - DNA, 1062 bp, Homo sapiens
acaagtgtgagccaccgtgcccggccttgagtttgtttttcacattagtccagagtgctccatctttcgctctctattcggtttccttgtgagttattgactgttagagtatacaatagaaaaaatatttttatgtcccttttaaggaattatacctttcaagtggaagatacacactgactttcctccaaatagttacacattttagatttttgtcgtgtcagtggactcatctcaggcaggattacaccccagggcttcctttaaaaaaggaaagtgacattggctttacgtaacagaagcagtttggacatttctttggacagttgagttccgctggcccctttctgtggcatgctgctgctcagcccagctgcatgaagacaggacagagaacgatggccactgagagtgatccaaagtactctgtgggagaaggcagatggataaatattttttcttaaatgcaaagctaacttaatgttactgcccattactggtaactttctttagggcttaagacttgaagaatttaatgttgcctgacaaagttttaagatggctcagcattaaaaaaaaatggtgtctttgaacagtaatgagcgccaagtaagaaatatgggtgtgctgactctttttgatgatctcaaagttatttatttaactacatgcatgaagccccagcgtgtgtgtgtttttctttgtcactgacttcacagcagctcagtaggattttaaatatgtatattttatattttcctgcacctgccccatgacaatatacatagaccatgcaaacaaagatgtatttagtgaagagattgcgaaactgttttattactgtccggatctccattggaagtgaagctgctgtttcacatcctctttaggcatatctagccgccagcaactgtgcagattagaatcatgagcttctcttccacatgcgtgtggccattgtggtgatgaccgatgaatcatcgcatttcaactggaatgaacaaaaatagaaagctcagcagcagcattttttagagaggtaaaaatctgcataaataaaga

SEQ ID NO: 59399 - DNA, 1030 bp, Homo sapiens
gagttttattgccaatggaagtggctctcagtggcaaggtgagctgaaaaggggatggggcaggaaggtaatcttcctgtgaaatgcggtcatctctggccagattcttctccagagttaccccgtcaggctgtccctctgaagtcaagctgcttctctccgacatccagctgcagtctttgatgtccagctgcttctcttctctctgctggctggatctggggtttttataggcacagggtggggtgggatagggccacaggtggttttggaaaaggcagcattcaagcagggaaacagggatgtaagttctactttgggccatggtttgaggcttgaaggtggggttttgttggggaccaccattttctgcctagaatttctctgccccctgtccctatcaatagttggaggggaaaatcaggagttttagttaaattaagcccaacctatataaaagagaggcttgacaactcccaggcatacagataaagctattggtgctctgtgaaatggagatctacatccctggaaaggggacagaattgacaacgttggtcatttccttaccacagtatcctgtattttccagaagcatgtgattgtcttgctatgatattcctgaatgttactggtttcctctttttctaaagcatgtttgttgtgtgcagaactagtatagcttcaggcttttggctaagatacccgtgagtattattgcttttttgttttgttaaataatttttattgaacacacacaaaataccttaaatataaggtacaaataacagtaaacaaacaacttgcatagcagtcagccagtcttaagaaatacagtgttgccactacttttttttttttttgagacggagtctcgctctgtcacccaggctggagtgcagtggcgccatctcggtttactgcaagctccgtctcctgggttcaggccattctcctgcctcagcctccagagtagctgggactacagccgcccgccaccccctggctaattttttgtatttttagtaga

SEQ ID NO: 59400 - DNA, 2073 bp, Homo sapiens
cgtaggtccataagaaaagcaaggagtattaggtgtcctttctggtgacactgactccattttcagtatatacataagatgacaaaatgagcaaatactttgtaaagtgctatatgcctccctaaagcaagaggtccaggaacaagaaactagaattatggagattggaaggtgtctgaattttacaggagactcaggctgcctctatcttttccagttcagtagttactcccagtcaggtgctcaggaccaaaatcaaggcatcgctcttgattaattctttctgtcatcccctaccaccatccccttcatcagcaagtcctgttagcattctgagaacaccttccatctctggcaacactgctgtcttcttggctcactgaatcagttgtgagtggtcatacatctgtggccccacggcttccttatgaccacttttctcctcaccctgggtacaggagactctctttcctgaggagacctctgttcccctccctgtcttgaatcaaaggagttgggcagatgggtaaaagctctttgctggaaccttcaggaaggaatctacaaattactgatctcagaaacaggaaatgtgtgacaatgaatgtcaagggctatctttatgctataggaaataaactatttaacttcatctatcttcatgctatagggaataaactaacttcattggaaagattttcatgtattagatgtgaaattacaatattagagcacatacgatttagcatcaaatgtaccgtgattattactgtaggacaactctgccccttctaaaccgcatggtgacccactcattatattctgtatatttcttcaggagacaatgagaggccactgaagtatgattgtagaacattgagttctttgcatccttcagtttatattaatgttttaggtctaaacttttctttttccctaaattgaaatcacctttgactcctttgtgaaaagagtaatgataaaagttttgacttcttcttatcaaggaggatttcataaattaaggaaggatatattcatgaagaatctactctatgacaggagctcttgctgataacttttatatattttatataattctcaggaggaccttgtgagttaggtctcactgtgcttgcgtgttcaaatgaggcaatggaggctgtgagaaattaagttacttgtttaagtttacacagctaatgaggcacagatcggctcaaatcctgttcttatttctgagttcagtccattttctgtaatatggatctctctgtgctttgttccttgtcgataataaagtccgtaataatacctgtaatatctatttcttagagctatgataatcagatgaatgtgaacacaatacctatacaaatttccagttctattatgattattagtagcattcatttaaccacattaccaaagtgttcttttaattcactggcactttatacaggatttctgaatacaacagtggatattttatctgttagactccttgtagttatgtttgggttgctctgagaatgagttttacacccttccaattgttggcaaatagtcatactgaagaaaaactgcccatctgttcagatgctagccaaaacatcacaaacagtcaaaatagcagattcaaccctatgtgaattgtgatgagacaatataacaggatataagtcatactgtcatggggtctttggggtgtcacttttctggccggaaacatgtgactggtggtgcccttgcctgagttttgcttggacctgctgggcttgttccacccactcgccctggcaggctgcgctcagctcatgctaccagcctggatcccgtgcttcaaagggagtctggagtcaggcatggagtggtgaggggtgtgtgtcagcaaacgtggggtccgcccactgtgcggtcagacacaccagctgctgctatggtgtgggcagctccaggtgctggcgtgagcaccagctctctgtgaggctgtggctggaccgggttcactgcaagcggctttcccgtctggcaccggggaatgtggtgacatcccggaaacttggagatgcc

SEQ ID NO: 59401 - DNA, 1104 bp, Homo sapiens
aaaattgtatctccagccttgattgctatactgagctcccgttcgtatgtccagccatctactggtttcatcctcacttggatatttgaaaagcatctcaaactcaacatagccagagcagaactcttgattcctcggctccctctgccaccttcctttttctgcttctgtttttcccacctcaataattacccccagtcaagtgctcagtacaaaaatctagtcattactcttaattttttttctgtcacttacccccatcaccactgaattcattagcaagtcctattaacattttctttaaaatatgtctaaagtctgtttcccctgctttctttgccaccagtatagtctaacgtaacatcatatcttgcctgagcaatcatagtagtcttccttctgtccttcctcctcctccttcctttcctgctcctctatattctttctcagtggcgcccacaatgaccttttaaaatatgaattaggtaatccctgcaccttcccttaaaaccttccatcgacttccattacacctagaatacagtgtgaatcccttatgctatttcagtactaatatatctgcccctgggtttcctctctgatgtattgctatactttggatacatccccttgaccacacctcagccacactggctttctttctgtccctttaacctaccaagttcattatcaaacagagcccttgcagttgctaattcctgtgcttgtactgcttcggtcttcagggcacagttcaaatgccacaccccaccccagaaaggtcctctctgaccactcagtctaaaggagcttcccattacatctactgtatcatattctccttggaggatttagcattatctgaagtatttttgttcacttacttgtttatctgttcatcgtctctgagctttatgaggacagagtccttttgccagtcttgttctctctggtaggcagtgtatgaaaaaagataaaacagaacccccaaagaaacctgtgtgtagaatgaaagattctcagaagaatgcttgtaaatagaagaatctaaatcctcttacagatgagaagtcttgaaaatgaaaagaatccttcagttctttt

SEQ ID NO: 59402 - DNA, 1534 bp, Homo sapiens
taattatcaatattaaaattagggagaataaataacctcatctaataatctcataatgctaaataaattcaagagtagattttgaaaccaaggaagatgaactagatgatttataaggtcttcttgagctttaaagttcattaatgaagattattaaacacttttggttttaatatctttcatagaaaatatatttaattctgttgccttcttggagtacttgcatatctccactttattcagaggttagtatgagattcttatagcagagtttctctttattccaaatgtaaatttaaaaatcaaaataacaaagctgtaaaaagactagaaatggttctgtttcccagttccactctaacccatatttgaaggaaagtggacgcatcaaatgtgtgtgatctttatgtgtaaacactaacacaaatggtggcagacgctgcagtgactcgagtgaagaagttttagtcagttaatgggttatataatcagcatcaaaaaatcaattctaggcaaactataccactaactgaatgttttattttctgtaatttataattattctagcacagccattgatgaaaatatatcttaggtctcatgtagattaaataaatctgtagtacatggcctcatctttaacttgtctttatgtaaatttaaaagaatgatatttaactcatgcaaagtgtgcttagtggaaaagaaagtcctctgacatgttaatggaatgctgtgaaatgcatttataatacatttagaaattcggtatcagtatgaagcaactaacaggggctttcacaggtcatttagttcctcttcttcttctgtcagcatagtgtccaaaacatttatggaggtaaaaatgctacactttgagttcgggtttatagagcaggtgtgtggaagtttattttaggcaagaagaaacttcaaagaacagattgggagacagtgtgaaaaaaagcaagtaaacatattatggaaaccgatcttgtcaaaggtgactagatcatacattggccttcattattggaaataatttggaaattggattcataatgaagtttccaccatttccagttagaagagcatcttacatcttttgtattgtgttctttgagatacatctagccttgcaatcttgtaatatttaccgaatgctactattttgcacacatttttaaaaatgaagaatatagttgttacgaatccctccgcaaaacctctgattagatttggcagaaaaatatggagagattgaacaaaagagatactaggtctgagatgtatgtatgttgtagatccgtatggtttattcaggaacttcagcagaatgactcgaagaggaaaacaaagaaggagatgattacagatgctccagagacactgtctttccgtaacttctgttgtcacctgtgttaagtgtgtgctggtgcgggctcgctctcctgtgctctagctctctcacacacttgtgcacaacttctgaaaagactgctatgtagttattgtctcttccttctcccctgtt

SEQ ID NO: 59403 - DNA, 1040 bp, Homo sapiens
atcaaagtgctgcaataagagaataaatgctgcgcttctcctggactgtggtctcaagtgttataactgttgccatagcaaaattaggctaaatttcctaaaatctgttcagtgctcccaaggaaaaactcaactggagcataagaattttcatctcactttttccccttttgtttgatttcctctccttaacataaaataaacattggttgtacccttccttttgaaaaattgattgctgtgagaagttgacttatattggatcttgcatgtaatgtgtgcagatttgtacccaaagcagtaattatcattcatgccatgcctttttgtatcaagtcctgtttctgatgaactggagccccatatgagttaaagcagttttgaaatgtaagagatactatctctaggatattatgaaatgtttcgtgatgttattttgatatttcccttgcagtttaaagaaagtaacttcttttttctgtgtgtcaattggaatgtgtgtgtacattatagcaatgaccagaaaacaatttttaatatgtagtttatagttactatgtagaaacttttctgaatactgtaaaaaattattggtgcataaaatttgttatattacatgcttttatgtattatactcttccatatagtggggatatatatttacttattttattaaatagatctattgctgatgctgatatctactgcccagtgactacagaagctcctttctggacaacccgtttattacactctccatgtatccacagctatatcagaaaagcaggaaaccagagaaaatatacctatttgaaagtggcatgtcagctgggatgagagagaagagtaagaatgatggatagttttagagaataagactgctttcaggaatgaatgaagacaagcatccgagcacgtccaatgccatgcttagcaataacccacacaactcactggccaaaagtacactaagtctgtaatcggaaaaattctctggaataaaatagagactcatatggaagtattcaggtgaaaatata

SEQ ID NO: 59404 - DNA, 2395 bp, Homo sapiens
ggagatgccgcctctgcagaaaaataaaaaaactttgggaggccgaggtgggtggatcacgaggtcaggagatcgagaccatcctggctaacacagtgaaaccctgtctctactaaaaatacaaaaaattaaccaggcgtggtggcaggcctctgtagtcccagctgctcaggaggctgaggcaggagaatggcgtgaacccaggaggcagagcttgcagtgagccgagatcgcaccactgcactccagcctgggcgacagagtgagactccatctcaaaaaataaataaattaattaattaaataaaaaaagttagccaggtgtggtgggatgtgtctataatcccagctactgggaggctgaggcgggaggattgcctgagcccaggaggttgaggctgcagtgagctattattgcgccacggcatgccagcctcggcaacattgtgagaccctgtcattcatttcattcattcatttatccataaataaataattaaatgtatacttatttatcataatatttctttattaagaattaaatgtcttttaaaaatcacgctagttttaaaagttgggattcttactttttagggatttggttataatactgtatagagtttgagtgttctgccttatgagccctcaagttataatattttatataccacatttttcaggaatgtatatatccaattataataagtctttactctgtagagtagtgctttctgtgatgatggaaatgttttatatcttgtttctagtattgtagtcattagccatatgtggctgtttaagttcattaaattaaataaaaaattcagtttctcagttgcactagccatatttcaagtgcccagtagccactcagtggctcatgatttccatattggacagcacagctgtagagagagcttagagcttgtagggtcagtgaaccccttgaaaagaccccaagggctctttccccagccctccccttcctagaggagaggctaggaatttgctctagaagaaaaattcaaatagaggttctagcataatgtggggcatgcggaatgctgcggaggggaaggtctgttttgagttggtactactgtgagtctgatactgcctgtgagctggaggtggctcaccatacatgtctttttgtctgtctacctacctgtctatctagacatcctgcagagcctgactgttgcccagctgagacccacaactgtgtttatttttatagttaggtattcctaaccagattataagtaatttgagagtcgggttgtattttataattctgcattctccacaatgaataacacttttgcaacatattcaggaaggacgtaattatctggctagaagctgatgtgttatttatattccagtagaaattgagactaattcttcaattttggggcactggaatgactaaatatagggaggttaggtgagaaactaatgtaggatttatgacactttccagttacagtggggaaagcggtattaactcctgtcttttcttctatgattgtatatcttctgcctcaaccttatacttagaggcaggtctattagtgaaatgtttgacttttagtttttactaagttagtagctcaaaggacctcctagttttgatactaggagcataggaacctaatgcaaagtaaaacgtgattccatgttgtaagatttgatttaacgccacattccacttttcagtaatctgtgcattttcacacctactcctgctttctctttttgaactgaagcaatctcatgggtaatgacctgattttccttcttcagtacaggttttagtctctctatgttgcttttgaattggtttaaagagatacatttaaatataatatataattctagttccaaattgtgtagtcaaagaggtttcttgtctaagctgtaactgatttgtatatattatttttaaattaacatttacagtgcaccatggtttgttatgctaggtgtttagcctttcttgcaagttaaatgcaatattctattatatgaaatattttaagatactaaaatgtaaactacatagtggcatggataggccaatagccatcacagtgtgaattgaaggagtgcttctcccctatacggtatatattcatcacagtgtgaattgaaggagtgcttctcctctatacggtgtatattcatcacagtgtgaactgaaggagtgcttctctgtacagtatatagtcatcatggtgttaacggaaggagtacttctctgcatggtatatgttcatcacagtgtgaatggaagaagtgcttctcctctgtgtggtatatgttcatcacagtatgaactgaaggagtgcttctcctccatgtggtacatgttcatcacagtgtgagtgga

SEQ ID NO: 59405 - DNA, 1075 bp, Homo sapiens
actgagatgaatgctttgcctggcctgatagcagaattaaagaaaattgaaacttcagcgttttgaagatcactggggtatcatttggtatgtattcagaatagttcatgaataatgtttagatggagtccatataaacccaattcatagtagagtggaaaaatttttatatacagaaaactgctgtagccagatagtaaaagaagatatatttaactgtttatagtaggcaacagaaggcagtgtggaagagtccaatgaaaacagtgttaggagtgcttcttgtccctttttacacaactagaaaatataaagcaaaagtaatttttataacatatgccaaggatctactcatatggtacatgttttatatctgccataacagactgacatagcatctttcactgtcaaattgagttagctgtggtacatatcatggatggtttcaaagctattttgccattaataaggcatttacaaatactataataagtgcttatagtatatactgccggtcctttcagattgctgctttgcatgcatcaaatcctatttataaagtggtattatccaaagtgaatagggaaaatgatctagaaagtcaggattttttttttccacactcacaagtagaatccttctctctagtgaattgagtcagcatttcagaatggaaaagtctgatgtgcaaatagctagccccaagatacctataaaatggggtcactcaaaaaggtgaaaagtacaatgaatttacatttaagtgtccttggcctcttttaggtgtgggaaatgagtgatgagtagctgactcaggaactatagctaacctcttttatatatagtctatgtttagagtatagtaaaaagagaagaaactgctttgtgacagtttcccatgtacaagagatattaatgaaataaaatgtttttttaactcatatatatatatgagtcccatgttaaaatatatatatacacatatatgtacatatatacgtgtatatatatgtatatacacatatatgtctcccaagtagctgggactatagacatttgccaccatgcccaacaa

SEQ ID NO: 59406 - DNA, 1031 bp, Homo sapiens
gaaatactgtgaattaggtaaaagaagtcagagagcggctgggcacggtggctcatgcctgtaatcccagcactttgggaggctgaggcgcgcgggtcacgaggtcaggagattgagaccatcctggctaacacgatgaaaccccatctctagtaaaaatacaaaaaaaaaaaaaaaaaaaaattagccgggcatggtggcgggcgcctgtggtcccagctactcgggaggctgaggcaggacaatggcgtgaacccgggagacagagcttgcagtgagccaagattgcaccactgcactccagcctgggcgacagagcgagactccatctcaaaaaaaaaaaaaaaaaaaaaaaggaaagtcagagagcttttgcataactggcccagagggtgtggtagatggagctacactcagactttggagcctgactaataacacaattagagcatgagcaagaggaaggccaggggcagctttgacatgggaagagagctacttacatactgaccggtaattgataatgggaacaaacgacctgcccaaattactttccaaaaagtctctgttgggagacatttcaagtttagaaatgaacaattttgagatgatctgggcagatttgaaatcttgtgaaatcccttcaaaatccgaaaatgagtgtgtgagagcccagcgtgtgttttgtgaagacttctcttgtgtgtcttgtattgcttagagggcatgatttgatgacatggtcagaacattctgggcagaatcgttacatcatcagttcttgtcatattggctccaaccttattttcttacggttgcttttcagttttatgaaacaatttcctccaaacaccttatcagtggctcagtatccgaaccttttactccaaatacagtttcaaaagagatatgctctctgcctgttaactatttcagttgagacccaaccttacatcaatagaatgaatctctgcaacggttggtttcagcaaggtggtgagagggattttgatggtgagggacagcgaagc

SEQ ID NO: 59407 - DNA, 1880 bp, Homo sapiens
ctttatcagaaaagaatgttcccctgtgaagcctttttatactgtcctaacaacccaaatccaggaacacaacccctgctcccaactcaaatggactttttcacccagtcaaatcaatgttggttctgtctgtccattttctttacattaggaaatgacatgtagcccaaaggacaaatgttttaggggatggataccccattcttgttgatgtgcttgtttcacattacatgcctgtatcaaaacatcttatatagcccataaatatatacacctactatgtacccacaaaaattacagaaaaaatagcatctgaaacaaattgccaaacttatgcataggattgagtgaagtaaattaattttgagtctcaaaatgttgctggtgtatttaatttttaaaagagcttaagatagtgggctttcaggtttacattttagtttattgctttcttaaagcagttaactatcattaaaagatggttgcactttaaaagttgattcgggagagtagtatttattgtccaaagtttcatattcatctttaaaagatgtacgtcaaagtaatttttttcttgttttgtttgatagagttctaaatacatgaatatagctttaagagatggaccttaaattgcaatttaatttcagactcaatagacacacgatactctgctaccattttggcagtgttataagcctattgattatttctgatattatcagtgagcagcttttgtagtggtcaaggtgctatataaatataatgatttcttactgactttctgtaaacttacgtgtttggactggtgaagatttatttctagaaataaaatattctcatatgaagtgtgaacattgtatttttacacctagtttatgtgaaaaatatctgtattgtgtattatagttttgcagtcactgaaaatagtgtactgaattcagctgttttcttcaggtagctattccatgataactgagtttgtcaagcaacaattgaagatttgaatgttggactatgaaaatgaggtttcagcagtcacagtcatcacagggtgagaatagattagatagtgttgccaggttttagaagacagagtattagaacctagtatcagtaaggaggaacacaggaatatagagaagaccatttttgagttttagattttatagaatttttagacagttttgcaggtatatatcaagagagggggagggaaaggaatgcgtttgaatttattctgcaggtgcctgcagttattaatgtgctctataattgtgtcatgccagaaggtgacttaatttgaaagtaagctaacatggaacagacttgactacctgggggagctgctcttagaagaaaagagataaagtttaatataaacagtacaaaatcacctatccagtggggaaataacttttgagtttggagaacattgtatctaaggaacagttgccaaagcagatattacagtgaaaggtgagatcaatagacttaacgtgacctgatcttattagttgataagaaaaagttttggaagtacataaatacaaacacacattttttaagggtgaaacagaaattatatttttcatgttactttaggtaaaactgttttgttgggctgtactactatgatgatcaaatataaccttaattgaaaatttttatagagcttattttttcagaaatattttatcccagtacatttaggaaattacaaaaaaaaatacaaaaaaaacaaaaaactaggatccatactgggtgcatttttgtgaattaaaacctgaaataattgtttaatagtttccatatttgtgttgtattttctgtgttttgtgtggagtatcaataatcaggccaggtacggtggctcatgc

SEQ ID NO: 59408 - DNA, 1051 bp, Homo sapiens
tgccatcacatggtattaaatattaaacattattttatgctgttagcgggtcacaagtttcagtgtgtaatgaagaaaatattatctgtttgatgacttctgtgctctgtgatagaactgtgtgtatttatttaccatagtaacaggctttgttctgttagtgaatacttaaatgtgattattaagtgttatgtgaatataactatttcagacatagtctataactgctatacacaaattctataggttttgggaaataataataatgaaaagatgcctctgcctcatatataacagtccctacagtaatcaggacagacgtctttagaaccaggtggtttgtacccagtgataagttaatatgtaataaagtcttgctataagtgaatctgagaaaaaagctacttttaataaatacatggatttttttttaaacagaaacctttaacagaataaatttataatattttagagtcagtgcagttatacatatgtttcttcatactgcttactgtctatgtgaccttgggcaaattcactcatctccgtgtgctttagtgtttttatctgtcaaatggttataataacagtttctatctggtacggtacctgtagttgtacctggcacttagcaaacactgtgttatcttttattatcattgtgtatacgccattcagagtacgtgggcacagtgtttgaggcacctactaaagccgggcacagtgtccgaggcacctactaaagccgggcgcagtgtccgcggcacctactaaagccgggcacagtgtccgaggcacctactaaagccgggcacagtgtccgcggcacctactaaagccgggcacagtgtccgaggcacctactaaagccgggcacagtgtccgaggcacctactaaagccgggcacagtgtccgcggcacctactaaagccgggcacagtgtccgaggcacctactaaagccgggcacagtgtccgaggcacctactaaagccgggcacagtgtccgcggcacctactaaagccgggcacagtgtccgaggcacctact

SEQ ID NO: 59409 - DNA, 3536 bp, Homo sapiens
aagaaaagctagcaggattatttcattagcatgcttctcttcatatgcacctttgatttaaaaatcactctcctgtagttttttatttcttcacaattatcagttggaaactaaatttgttcatctcgtaataagactgattctgtatgcatcatagaattgcaaacattaagtaacaaagtccatgtaaagtgtttagaacatagcacttagtaaatagtggttattattgttgtcactatccccactgtctttctttgtagatatttactttcaccttttcttctatagcagagccactaacaggtaatagagaagtaactagttagatcttaggaatttaagaagcacttcaagatgtggacagaaaaggatttggttcagattgcatactcttaggctatggagatggtacctgcaattcccatagaatgtgtataaagcactgtattgcattagaggccatgggattacaaaagctattctttgtaagacatcttagaatgttgttgatgtgtgagaataaaatcatattgaaaaaatatagaaaagttaccgtctttcatcagttctaagatgcagggtctcaccatcttgcccaggctggtcgtgaacttctgggctgaagccatcctcctaccttggcttcccaaaatgctgggattataggtatgagccattgcacccagctaattgtttttgttttaatcaattaccatatttttagcactgctgtggcttatgctttgttcctttttactactacttgctttgaatgatgcttaaaatggacccttaggaagatgactgtattgaattattatattcagaacaattgatatactaatttaaaaagaatatacagtcccaagtgatagaataaacaagagttactgcttagtatacaataaattttgtattcatttgatttccctcagaagtctgtattcgaaatctgagtttccttctatttatatgtaggttacaaagtttttaaaaaggcaacaaaaaaaaaaacatttatttctgctcttcttaggcaatatggccttttggctagaactcagaaattaaaagcttgatttgttggttgtgtaggcatcttatatctaaggaattattttggcttaatttggggataaaatattaattacacctaataagcagaaatgtaattatttaagacagttactgtcttacacatttttcacttaagatatgaagaagtggttaacgtaatttcttcttctgggacttaaaagaaatgttcaaattaaccactatttaggtttgatcatgcctttggaaggaattggtattatcctttgaaaatgaaaaggcataatttgttgaaggtacatagaattgtacaaaaagaaatcagtaattttcccatttttactattaagttatatcataagcagctattttgaatgacagtatgaaaaagtatgtttgtgttttaaggaggctgtttttgaattaggaaagataaatacgctggtatgaagatcagctcattcaggagcaggcattttcctgcatactaaggagctttaaaggttagacagtaaaaagaaggtgatcattatgtagtctgctccacctcatgcctaccagaaaatttatttcccagcctccctaacttttctacttcaatatacagctaactgttaatgagccctaactctgacctgggtatgtgcccaggtcacatacatcctgtcatttagtcctcaccataatctctgagtgcacagtagatgctgttagaattatctgtattttatagtacagaaacagcctcagaaaagtgaaataacttccctcaaaataaggtagctagtaaatggcagagctaacattcaaccttatccatgtctgactacaaagtaatccatccattacttaccttttttcatggtaagcttttgctttttggtcaacactatgcattgtgccttgagtacatgtaccaacattggaagaccattcccatgtgatatttgtaatagaattaggtattcaaatcacgcattcttgagacaattaaagaatgtaggatttatttacatacaaagttgagagaatgtgcatcatgctgtgtcaggcttcctttccatgattctgttagttttcagtgcaggtatttgccacctgacttgggtttcctagatgtctataatcaatgaaatattttctcttttgaaaaactatttttaaaatacatgttttaacagtgttgaattacaagatgttttaagataatataaacctggacccaaatttctatgtaaatgtttattttatagagacaagtaaattaaccaaataattcagtgaatcttcattgagaacctaatatgacctaggtactgtgctaggtgtcagagaccggctatatggtttagtagaaagagaaatggtagacgctgtgccaagcatagtgcctggaacaagcagaaagtccataagaaatatatgttaactgaaaggaagaacaaaatggaaactgtgtctgtctgagtcacccaaattagtaatgtctgtgagtttatttcctcatctgaaatgaagggtaataaaacctacctcagaaggattgttgtcaagattaaacgagttaagatatgggaatatgtccagaactgtgtttggtacatattagatgtttaataattgttagtcatagtgcgaaaaataagtaacacattattcccattctcaagcaatgtcaagatttaaaatcggattcttatccaccatatcgttagacttcagttgccttgttcttctatttgctttattctgcctgagcttcactaacaatccacagggcttttggactctacaaagaaaacacacacacaaaaatatcatacactcttctatatctactcacatctgcactcaaatttaattctgttctgtgaaaaagaaaatcggcacaaagttattgcttaatactgtcaaatactttttaaaattagttgccctctgtaacaataggagagcatggaagaataaacaagcagcagaatgatgtcagagaaactttggccacagaaggagatcagtaggtattggaatttgaacagcttatttttcacttacttctatacacaatatggatcttacagatttattgtaacttttttctccgatttaagaattgccagaaataaagctgagtgacaagaaaaggatgtgtgtacatgagacagagggcgctgtttatgcccatctgtacagaatgtcattcgttttaaatatgattttcctctttttcctcacagaaagagaaaatggtatatttctccttctatgcaacagagaactgattttttttttaaattcttattactgtttttttttgaagtataatagaaacaaagcagtgtttttctttgttaaggtcagttcatgttttagtaatgtgtcttgagctttctgtattttctgagctaaccatttaaaaaattttgacttctacaccaattattttatgtgtgattgtttaaattctatgggtcttg

SEQ ID NO: 59410 - DNA, 1151 bp, Homo sapiens
tgaggcctgtcctctctcaggctcataggaaaagacagaaatgatcttgcttctttagggattgacagaacaaagacaaaggaccctagactttgggaatagaaatctgttgaaatgagctggaattggtaaaataattgattttgtttatgaattgataaaagcctactttcaattcatcaaatattgttgagcatgcaacagtatgctcccgtacctaaggtgcagtctctgccttagagttgtaatccaggaaggggctgcaagagagactcagaagatgtggtctgacaatatataagcacaatgtctgacccttaaagaatgacaggatttcaacaggcagacaggagaggaggaggaattctaagcaaaggctttcacatgtaaacggtgaattcttagataagatctgttttctatataccaggaacagtttgctggcatttgaggacgaggagtaagttcaaatgaaaactttaaaatgtttccccaaagtgttcatatgaaattttaaggatgtgcctatggactgggaataatcaaataacataaaataaacataaataacataaaccataaaataataccattttttttctacttttaaaattgggcccagaatatagcttgcagtgttttcttaattgataaaacttcagttcatcaccttcaattaatatgttaatgcatgaccatttgctttgtatatatctaggctatatttataattgtggtctgtcttctttggccaagtatgtatgtattccgttatctcttagctcctttgtattcaggctatgcacatttattataatattgctctattccatctttaattaggcaagcaaatattctaataaaaagtttcaaagtgaattttgcattatccagtactagatacatattctgtaactttggggcaagatatttgccaggcttataaaactagatataactatccataaataaaattgcctcaataagatttaatggaagagaattaagaagctgtggaaaatgaataagaaaaggaaaaaaatattattttcgcagtttacttttttttttacttgggatcatattcttttctgaggttttactcgaaaaagtattttctctgtcattactttctttctctctctatcttt

SEQ ID NO: 59411 - DNA, 5392 bp, Homo sapiens
atgtttttggcttaacatttatagggcattatttgaaaaactgaattctgatccaagcagagatgaggggaacaaggctgagaccttaattactggctctctcttgtcagagaaaggtgctttttgtcatattcccatgggatttgattgaccttcggacggcctgtgtctgttaggaggcatttctatttctcaggtttgagggctagtcagtaaaatttggatgaatttggactggatagagggactcaacctgaattgtgaaaatcctgagttacagaatttttaaaagttctatgttgtagttatatataataatttagctattttaaagcacaaaacaaatacgtgcacttggagaatggagtccacagcattcagcaacagtggcctgaagcagagccccagataaaacactgggttgaatgtcagtgtgctgacatcagtgttttttattatatgactgtgttctttctataaaaatcaggcattgtgagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggattattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagtggccgggcgcagtggttcacgcctgtaatcccagcacttaaggaggccggtggaccacgaggccaggagttcgagaccagcctggccaacatggtgaaaccctgtctctactaaaaatacaaaaattagcagggtgtgatagtgggcaccagtaattccagctactcaggaggctgaggcaggagaatcgcttgaacctgggaggcagaggttgcagtgagccgagatcgtgccactgcactcccacctgggcgacaagaccaacactctgtctttaaaaaaaaaaaaaaaaaaaaaaaaagattagtgaaaccaaaagctgcgttcttgaaaagattaacaaaattgtcaaacttgtagatagatggactaagaaaaaagaagattccaattgctaaaataaaaaatgacaatggggacattactgggccgggcgtggtggctcatgcctgtaatcccagcactttgggaggccgaggtgggtgggtcacttgaggtcaggagtttcagatcagtctggccaacatggtgaaaccccgtctttaccaaaaatacaaaaattagctgggcacggtggcgggcacctgtaatcccagctgctcaggaggccgaggcaggagaatcacttgaacccgggaggcggaggctgtagtgagccgaggttgtgcctctgcactccagcctgggaaacagagcaagactctgtcccccccccaaaaaaaagaaaaaaaaaaaaaaaaagaaaacagggacattattatgaatcatacagaatgaaaaaggattataggagggcattaggaagagttgtatgacaacaaattgaataccctagatgaaagggacaaacttctggaaatataaaaaactgtgaaagacaaaaattatgaaaatctgaatggacctatacctagttaggagattgaatcagtaatcaataatctctcaacagagaaaagctgacttggagggcttcacaggtgaattctaccaaacatttatagagaagctgatactaatctttctcaaacttttccaaagtattgaagaggaagaaatacttcctaatgcttttattatgaggccaacattaccctgttaccaaagccagacaaagatattatgagaaaagaaaactacaaaccagtatcccttatgaacactgatgtaaaaattttcaacagaatactagcaaaccaaatttagcagcatattaaaaggattatacaccatgaccaaatggcatttattcccagactgcaagaatggttcaaaatgtgaaaatcaatcagtgtaatatatcatataaacagattgtagggggaaaaaaaccccacgtgatcatctgaatcgaagcagaaaaatcattttgacaaaattcaataccctttcatgacaaaaatcactgaacacataaggaataaaaagaaactacttcaacatagtaaaagccatatatgaaaaacccatagctaacatcttactggtgaaagaccaaaagcttttcctttaagattgaggatgagataaggatgcctgcttttcaccacttctattcaacatactactgaagttctagctagaccatttaggcaagaaaaagaaataaaaggcacacaaattggaaaggaagaggtaaaattatctctgttcatagatgatatgaccttgtagatagaaaatcctaaagatcccacaaaaaactatcaatgctaataactgaattaaacaaagtattggggcacaacgtgaatacacaaaaatccgttgcatttttatacacaaacaaacagtgaacaatctgaaaaggaaattacaaaaacaattccatccaaaagaataaaatacttaggaattaacaaggaggttaaaaacttaacaatgaaaagcagaaaaacattgctgaaagaaattaaaggcaacataaataagtggaaacatatcccatgtttgtgaactggaagatttaatattgttaagatgtcattacctacccaaaggcctctacagattcaatgcgttccctatcaaaatcgcaatgatgtttttttgcagaaaaggaaaaaaaaatctaaaatttatatggaatcttgagggactccaaatagctaaagttatcttgaaaaataacatagctggatgactcaatgtgctgatttcaaaatttgctaagaagctactgtgaccaaaacagtgtgttactggcataaagacagacatatagaccaatggaatcaacgggaaagtccagaagtaaaacctcacctatatggtcaaatgattttcgatgggggtgccaagacccttcaatggagaaagcacagtcaattcaacaaatggtgccaggacaactgggtatccatatgcaaaagaatgaagttggacctttatctaagtttgtatacaaaaatcaactcaaaatggatcaaagacctaaatgtaagaccccaaactataaaactcctagaaaacatagggcagaagcttcatgacattggatttgtcagtggtatcttgggaatgacaccaaaggaacaggcagctaaagaaaaaaaataaacaaattgttctttatgaaaatttaaaaaatttggtgcatcaaaagacagtatcaacagttaaaaggtaacccagagtatgggagaagatatttgcaaaccttatatctgataatggatcaatatcaaaatatataattaagaactcaacaatagaaaagcaacatgattttaaaatgggcaaaggacttaagtagacatttttccaaagaagatacgccaataagcacatgaaaagatgcttagcatcactaatcatgacggaaatgcaaatcaaaactacagtgagataccacttcacacaaattaggatgactgctatttaaaaaaccccagaaaataagtgttggggaggatgtggggaaattggaagccttgtgcactgcgtggacgtgtaaaactgtatagccactgtggcaaacagtatggcggcaactcaaaaatttaaaaatagaattactgtatgatccagcaattccatttatgtgtatgtacccaaaagaattgaaagcaggatctcaaagagatgtttgtatgccagtgttcatagcagcactattcacaatgactaaaatgtagaagcaaccctcatgtcatttatctgaaaacaaaatgtggtacatacatacatatcataaaatgtcattcagcattaaaaaggagggaaatgaagacacatgctacaacatggttgaaccttgaggacattatgctaagtgaaataagccagccacattaaagacaaatactatatgactccacttttatgagatacttagaggagtcaaaatcttagagccagaaagtagaatggtgattgccagaggctagaaagaaggagggaactggagttactgtttaatgaatttagagtttcagttctgcaagatgaaaagagttacagagatggatggtggtgatggtgcacaacattatgaatggatttagtaacactaaagtgtatacttaactatggttaagatagtaaattttttatgcatattttattgcaataaaaaatgaaaacagtttcaatctaggaggattttggatgcatctatgccttgagaaatgaatggtttgatgtaaatgcatggtagcaagaataaataattatgttaattcatataatatgttatatatagttttaaagaaaattctatcactgtcttcctatgggtagggctataatgtccagttctttcagggattaagagggtagggtctgaagttaatccttgtttgtcgtaatgttattaatttattcaaccaagacttaattgagaatgacctagcaaaagagacaatctgttcaaattaaccaacttgagtaccatttcaatttgaaaactctgtctctggtgttggaggtcattcttcaggaaccaacatggttcttgggaaggtaaacctcatgtacaaagtcactcaggaataatacttgaccgctgggtgtggtggtacacgcccggaatcccagcactttgggaggctgaggcaggaatatcacttgagtccaagagtttgagaccagcctgggcaacgtaggaagacagcttctctacaaaaaagattttttttaaaatgagccaggcaagatggcatgtgcctgtagtcccggctgcttacggctgaggtgggaggattgcttgggctcgggaggttgaggttgcggtgagctgtgattgcaccactgcactgtagcctgggcaacagaacaagagcctgcctcaaaaaacaaaacaaaacaaaacaacaaaaacaaaaaaaaaaaagaaaaaaaaagaaacagaaagaaaacaataatatttgacagaataaattccagggtcatactggaatatgggggaagagta

SEQ ID NO: 59412 - DNA, 4599 bp, Homo sapiens
tacattctttcaataatattttcatttgtatgttttgcagatgtttttagagtgcctactatgtgcctttactgaggtatatgaggttctgaggatacagagatgacaataacgtaatttcctgtgcttaaggtgtttgctgttgtttagaggagaaacatctctttaaaggaaaaacattgcggtatgatatgatcagtattctcacagagctttactcacccatgatacaagcttgagcataaaatcacctatctcacagagttactgagtagggtaaatgtgatagtgtgtggaaagcacctaactgtagtagtctctggcacatagtaggttgccaatcaatggcagccattataattcataaagcacagtgagttcacaaagaaggaagagaacacattgtcctgggccatttcagtaacgaatctcaagtgacctggcaccagtgaggcaggctctaccacgggctgaatggggaccccacttccttctcacctgtgtggtgtccaatgatatgctagaattgaattctcagatgtatcttttcaatgactcataaatgcctgtaagtacctggagggcaggtgctgtgattagaaaaatctttatttcccggcagtctttgagaaatctgtaaatgtctattgagtgcattaggttttagaataaattcataggctataggagatacttctttggaatattagtgtgattttaattgctaggtttttgcaaataaaatagacaaaggtctgaggaaggcatccttccatttggaatttggtacaactagccatctttgtcccacgttttgtttttgaggtggcagcctgatcaaatataggttgaactatagaatgcagttagctcttgaagcatctgataaatgcagaaacagaaaagatgaggccagcaggggtcagtttaataccagtttaagttgcaagcacagtgtttttttaattctctgtaaagtggaatgataatagaaactgacatgcacagtctaaatgtaagctttaacatttcaagctacagtaggagattgccaaaaattgaggtagatgtctttaacattcttttaaagagagaaatggagatttcactgtgttgcactggctggactcgaacgcctgggctcaagcaatcctcctgcctcagcctcccaagtagctactgtgcccagcttctctaagatttttaagtagatgatggagattattagtgacagaaggtaaactatggaatgtggatagtttagctctcttttctgtcgcatggcagcataggactttcagccaaaccgatttactccactaactggcttgtactgacaagtgctagaaaaagcctgactatatcatgtgcatttctttgatgttcgttacttggtagactttataaaataatactttgtgcctatttttttcctagctggttataaagaaaagttagttttagttatagcttgcatatgaaatgtcaatatttccaagttacagttataagaaactgagcatggaatgattacttgaggacattaaactttaaataaaatcacctcatgctactatatatattcctttgttatcttcgtggatatgaatggccttttctttgcaacctaatgtatggcattcacatttataagactaggctcccaaatcctaagaacatcgtgtgtgctaaactcagaattctgcatactaatcttacttactacgagtaagtactcttagcagataaaattgttttcttgatgccttagtacactttccccccaagatactataattgttcaactaaagatttttatataatgtagaatgatagactcttagacctggaagacgccttaaggatcataaagccttgttttatagagaagttgtgtgatgcgtcacaggcagggctgtccctggcagagcaattcacacttcttggactgttcttccccatggtactacactatcgtcttttctctccctactctattcttccctgttcaatagtctgcatatttgagcttcctgctaaatatgttatagaggttaaataactgcctttgtcttgcatcccacttcctctttagctgtagagtagaaccccatgcacataaccattggtctcaacaatctttttttttgtttttgtttttgttttgagaaggagtcttactctgtcgccaggctggagtgcaatgacatgatcttggctcattgcaacctccgcctcccgggttcaagtgattctcctgcctcagcctcccaagtagctgggattacaggcacgcgccaccatgcccagctaatttttgtgtttttagtagagatggggtttcgccatgttggccaggctggtctggaactcctgacctcaggtgatccacccgcctcagcctcccagagtgctgggattacaggtgtgagccaccgcgcccggctggtctcaacaatcttacattgtagcttaagtggctctttgggattgttgtgtcatgtccactggggccacttagagccaaggggtgtgtgtctccacagaagggagtaaggccctggctttaaaggacagtaggtactgttctccagtgctcttagaactgttgtgaagtctgtgagtcacatgtagtagcactttagggcctagaggatgctggacttgagtggttgctcctgtcatggtgtcaggaaggaacacagggcagcatgacttgttaaagaagttgctgcatgatcctgacaacagtcaggcagctctgcctagcgcttgtgttctgaaaatgccgactttattgggtgtattgttttttctttttaaccatttaggtatcttctcctctgtttatattttttattttgtataatgaattatcacatactttgtggcctaaagcagcatatattttttaatcgtatggtttctgtgggtcaggtgtccacacacacctggatcctccatgtagggtctcataaagctctcgtcaaggtgtcagctgggctgtgttctcgtatggaaatccggggaagaagccacttcccagctcgcttgggccactgaaagaatttatctccttgcatcagtaggactcagggccctggcttcttgccggctcttggctgaagtctacccacagttcctggagaccacccacagttccttctcaggtagggctttccccacatgaccatgtactttattaagtcagcaagaagagcttctagtgaagatctgatggcaagatggagttttatgaaatgtaattggcaggagtgacatatacctttgccatattctgttagaagcaagtcacagatcatgcccatacataaggggcaaggcgaggggattgtacaaaggcctgcacaccccaaggaggtagctaggtgtcttaggggaggggccaacttaaagtttgtcttctcagcttttttttttttcttaaacagaggggagacggaaagggacatcgacatacatgagagtaacccaggagatttgttcctgggtttcacattcacagcacttgtgggcctccaggccgacctgaggcattgaaaatcccagttgttggtttggtctgtgctgagctccttactcaccttttaaagttggctgtttgcagttgtactcccttcctcatttctgttttctttgtacctttttatttaaataaactttaagtatatactttgggtattaacaaatatgtatgccatgaatataatatacgatgattatcatggcaatgaagatacagaactttccgtgaccccaaaagttgccatatgtccctttggtatcaatcctcctacacgtctggctgcagcaaccactgatctgctttgtatctatagatgacttttgtctgttttgaattttgaagaaatggaactgtacgttatagactgtggtctgactcttttcacttagcataatgattctgaggttcatccatgtcgtttgtgtcagtagtttgttcctctttattactgagcggtggtctgtattgggataacacaatttgtttatccattcacctgctgatgaacatctgtgttgtctcccctgattaggtattgtgaataaagctgctgtgaatattcatgtatgagtctttgggtggacatgtggtttatttcccttggataaataccagtagtgagattgctgggtcatataagagcatttttgttgttgttgttggtggtggtggtggtggtgtttgcttgtttttacatgttaaaataagatacagccaaactattttccaaagtgatgatgcattccagtcagcagttgctccgcaccttcaccagcatttgatgtagtctctttttaattttagccattgtaacagtgtgcaaggacgttatattgtggttttagttggcatttccttgataaatgatgttgagcgttttatatataggcttattggtcatttgtacatcttcttttctgaaaccttgcactttttttttttgaaacaaggttgcctaagctgaatgcattatttcaactatttacaagttcacaaaataacacctttttaatgtatatttgctcacatattaatgtagtaaacatattatt

SEQ ID NO: 59413 - DNA, 2266 bp, Homo sapiens
gaaaagaattagaaacctcagagaatggaaattttgctcatgtttcatggtattgagagaattcacgttgctgacctggtaaccctgaagtgtttaagtgctgcagatggtcaaaggaaagctgaaagatttcggagcctgctgctttctttgttctgcgtttgcaacacattaccagatgctagatgcagaagtactgcagcacttgcctgttgggaaagcttaatctaactgctcaagtagctgatatgcagcatctgacagcctgctatgccgttttgcagcatactcaccggtgcttttgatattggctctgaggaagtacttttggttgcaagtgacatggcatgtacctctccagcaagacttcgtttctgagaaattcatgtagttcttctttcatgagtaatttaccttgtttgatttttctactggttgatatgctattttagtcaaatattaatgtgctacatttaaatgcttgacttccttttgttattttgaaatcagttattagggtgaatggtgtacctgaaggttgtgtgtaactcacagttgtcatgggctgtgaaagctggcaagtgctgcagtttttgtttatgactcggttgtgtcagtgggagacagaaattctaaaagatactgcaagcagatcctggtcgatttctgtgagtgctataagttctgggagaaatgatcttgggctttagatgttatcgctgtggcaattatatttcttctggtctcacagaagcaagtgtcattaagagctttaaatatttgaaattagaaccatatgagttattttgagacctctagttactgtaattaaacatacacaggtatatatgaatgaggacgttatttatgcatgagcaagggaagcttttccatggctctgattattggcaggcaggggtggtgaggaaggaaagcaagatggacacatctgacacatttaaagcccagtttagccagagtaaggattttgaggtcctttctctttgttcagattgcgagtcgatggtaggactttgggagggatgtagcaaaggggatgtaataatggcaatagctcatgctcatgaaacacataggttccaggtaaaatgctaagctctgtgcatatgatcactcactgttacactcttggcaatgttattatctctggcttaggaaagtagatgacatgcccaagattacatttgtagaactgtggtgtgaacccaagccaccctgagtccagatcccaaaagcttgaccactgttttattttctatggggggttacatgctccctcagtaagttttagatttttaaggtgccattgttgagcagaagaacctttagagctccttatttcttttgtggcttttcctgtctcagggaaggtgcaggcagaggaagttaaattccgatcactctgaaggaagaagtttgcagcagtggtaggatgatatagaaagtattgacagtgctgagaatctgggattatttattcttgtttggagtgagagactggatcttcagtttactttagataattaacaactgcaacaaaccaggttgatttattacattttctagttagattttgttgactgttcagttattctagtcatgaataaatttttatcatttttccccataacatatgttgaagcagaagtctcatctgctagaagcaacatttaaagtgcttgcataacaatattgttgatacagaagattttttgtatccaaacaaagaagttaactactgtgcttcatttatcttcatctgtctgaagtaccaagaaaagagatgtggaaaaataatgataggtaagcaaaagaaaagaaaaatacatgcagctttttttttttggaacaaataattttattttttaaaattattattaatttttttgagacagggtcttgccctgttgcctaggctgcagcacagtgacgccaccttggcccacagctcactgcagccccgacctcctgggatcaagcgatccttccatctcagccttttgagtagctgggcctacaggtgggcaacaccacccccagctaatttttttgctttttttttttttttttttttttttttttttttttgtagagatgagggtcttgccatgttgcccaggctggtctcaaactcctgggctcaagcagtcctcctggcttggcctcccaaagtgctaggattacgggcatgaaccactgcacctgaccaggaaacaatttttagacctctacattatatttgttt

SEQ ID NO: 59414 - DNA, 1026 bp, Homo sapiens
ctggccaacatggtgaaaccctgtctttactaaaaatacaaaaaattagccggtcctggtggcgcacaactgtaatcccagctactcgggaggctgagacatgagaactgcttgaacctagggggcggaggttgcaatagccgagattccgtcactgcactccaacatggatgatagagcaagactgtctcaaaaaaaaaaacaaaaaaaaagatttttttattatatcttgaggtcatatattttccaaagatataccactacagttttataatgatggtcaatggagaaaatttctccacttgaaatttagaattcaaaagtctgattatcaaatatttgagaggcagcagacctacgtactctttagttaataaatattgagtgtctggtatgtgccatgccctatactaggtggatatacaaagatgaacaaaaacagtgtctctgtattacatttatattggcaagtcattactacatacaaatttctaaaaatttttaaaaagaccttcagggagtctgtagaaaactagcactaattttctgagagtttgagtacagaactaatgtcagtcttgtgttatactcaggaattttcattgagtgaaaacttgaggaaataatttgtatgatgaattttaaagaaattgggacttccctaagacagtggaaaatatttgtttttaagaggcattgatgggagctgtgtggtgatttgtgatttgtcagattaaaaaaaaagtgctgtgtttacctatgtaacaaatctgcacatcctgcgcatgtatcctggaacttaaaaacaaaaatttaaacaaaagtgctggcaaagcaaggttttgttattatcctttattaagctttttgtgggatggaggttttactttagaatcagaaacctcaagtgtctttctcatataatgacttcttttcctctgggtagataccgagtagtgggattgctggatggtagttctactttagttctttaaggaatctccacactgttttccatagtggttg

SEQ ID NO: 59415 - DNA, 1967 bp, Homo sapiens
acagatacatttacccaccaaatatggtggtttggaatgattctttgtgatcttccttgatttcatcagcaatttttcccaacccatgtttcagttttcagtcttaatacttagcattaactaaaattatgttcttgaacatggctatatgttgaccctttccttatgttttttcagtgtctgccatgctccctgcctaagcttcctgttgtttgctcagccctttgtgttccttttgcagagactccaatttcagcatgactcttttgcccccaaatgctctcaagtaataggttggcaatacgtgttcatggtcttctgtttaagggaagcttgtaatgtgtcattccttttactgtgtcacatggtttactgcagcatatccctacaaaatttatattgtgctgtgctggagtgactggtatgttggagtggatttttattagcaatatatttatccatatagtgatcatatctgctttaatacttgacagtgatagtaagtctaagatactggtgtattggatagtaagtctaaggtactggtgtattggatagtaagtctaagatgctggtgtgttggatagtaagtctaaggtactggtgtgttggatagtaagtctaagatgctggtgtgtaggatagtaagtctaagatgctggtgtgttggatagtaagtctaatgtactggtgtattggatagtaagtctaagatgctggtgtgttggatagtaagtctaaggtactggtgtgttggatagtaagtctaaggcactggtgttttggatagtaagtctaagatgctggtgtgttggatagtaagtctaagatgctggtgtgttggatagtaagtctaagatgctggtgtgttggatagtaagtctaagatgctggtgtgttggatagtaagtctaagatgcttgtgtgttggatagtaagtctaagatgctggtgtgttggatagtaagtctaatgtactggtgtgttggatagtaagtctaaggtactggtgtgttggatagtaagtctaagatgctggtgtgttggatagtaagtctaagatgctggtgtgttggatagtaagtctaagatgctggtgtattggatagtaagtctaagatgctggtgtgttggatagtaagtctaagatgctggtgtattgcattggtcatgggaggtagaaatggctcctttactacctacctgtgtgatcgtcaaattcatattttcccaaggctaatattttcttctttctactgtaattagcttcctcattctgcaagttaactatgattataaatactgaatacctggcatgttttctcaagtatgaaaataaaagcttatacttaatgtgtaaattacagttgaacataggtccagacatatggttattagtgttgcttaaattactggtttttcttgtcattgctattgcaagtgttctcaaagtgacggcaaatcacttcctttcctgtactgtgtaagtaaaataaatatattttaaaatgtatgaatgtgtaatgtagatattactctatttgaccttttatttggaggttaacatataaataaatagcaacaactagtattgagaagtccagatgcactgggcttgcttaggtgcctcgtggtctccataaacatttggtctagtgtttctggctaaaagccagcagcaaattatactttccatgcaactcttagctcactctcttccttctcagagcatgatctgcaaaatgcactcataagacatcaaatttgaattgcaaatttgtatgcgaatattattttacaagtagtcgggaaagaaaccagaggggaacgtttccctaatttgttagcaagctgtatacataatttgtaactgatgcttgtcttgaccatctagtcatcagtattctgtaggttatggaaataccaatgttttcaaatctttgctttgtttttatcaagactacttt

SEQ ID NO: 59416 - DNA, 1501 bp, Homo sapiens
cctgtctagaatcagttcattttcaatatgtccttctaacattttctagatgaaagcagcaagttaaaaacatccaagaatgtcctggagtgcaaaacctacctccgcatgcatacatgcatacatacaacagcagaacaaaacacccaaatcaaacctttgaattttctgtgagaaatttagtctttataattcatacctcccttggggattgattttgttctccttctgatgaattttgactttcttgtcccatgcctgtcatctcaattgtttaacgatttatttttcttgctcagaggattcagatttccagatcatatggctatagcttgtactggtgtcaaggtcaaaatcttttaattttattgatggaactggtattgtaacctgagggtctcttgctgtatatttaaatcctgtcatattgcctaaaaacagtcatatcttggttttggtccaacagatacttttattaaattccttggctacatctagtttactttttccttgagagaaatataacagaataccaccagcatcttgattgcaaatagattgttaccgtggcaacctgacagtttttaatattagaatcttcttgttaaatcaaaacttatgaaattggagacctttccctgactgaaaacattatgctgcctcttatagttggaattacactgtgtccaagcagaaaactgtttttctttattaagaaaacaaacactttgtttgctcatcaactcctcggctactatcttaggacctttggcttctcaactgtagacccttttctgggtaggatcttttatgctgctgggcagcagtgggatctgtaagagatactaagtaaagagaatcacagtttggtctctgacactaaagaacgttaccacctagggactgcgtgagtgggcttggggagattgcttaggttctggtgctgctattagaatactaatagaattagtattctgagtgggaatactaattcctgccttaacttgtcttataagcttgttttaacaaaggagtacataaaatatttattattacatattattcacagtgaataacagacataagtaatatgcaacatattagatttatgtattatctcatgtaacctccacagtaaccctgtaaaatagatatattattctcaccttatatatgaagacatttgtaggcagaaaggctaattgggtcgggcacgatggctcatgcctgtaatcccaacactttgggaggctgaggtgggcagatcacttgaggtcaggagttccagaccagcttggccaacatggtgaaaccatgtctctactaaaaatacaaaaattagctgggcgaggtggtgggtgcctgtaattccagttacttgggagactgaggcaggagaatcatgtgaacctgggaggtggaggttgcagtgagccgagattgcaccactgcacgccaacatgggcaacagagtaagactctgtcttaaaaaaaaaaagga

SEQ ID NO: 59417 - DNA, 1055 bp, Homo sapiens
ataattcataaataacattggcaattaaattcaagatgtcctgttaacagaaaccaaagagtaaagctgtctacctctaaaatatgaagatcattgtcctatgagacaaggatgaatggagataacacatatttagaactgaaatggaagtcttagaaggaaaaattgcttaatttaattgaaaagtattgtgaatcttgggtagattcatagcattctctggtcaatacagtgaatctctggtatttatacatcagaataattgaatatttgacatttgatgcatcagaaaaatattctagtcaagaaatttattcttgtttagggttaaaaacgttttcattacaagccagtaatttcaggttctgtccttattgaacaaatgctcttgtccttttaacttaggaagggttatgatgtaagcctgaatcacttacctttgttcgttgagggttcttgatcttagaatataagacaaattcttggatgcgttgtttccctgctaactcattaacccattgtaggctagctgctgcctctactaccgtactgaagtgaattcactcacgtaactagttacatcctaaatgttgaatacagtattttgttctctttctgtgtcctgtttgactcctctgaggcatatattgttgactgtttccttaatgaaactcctcttttatgactttgaagatacctctgtcaccttgtttgtttcacctccatggatctttaaatgttggcatctctcaaagatggtccttgtttctctttcttactttctttttcacattgtttttctaaatagattcaactattacttaattgtgaatgagtaaatttttgtctctgtgtcagagccccctcctgagttccaactctatttctaactgctggccatttatgtccctgaatcattgcccaaactatttaaagtctggatgattatctagcactttcctcaaatctctatcactcatgagtttcctttattgtattcatcgattgttagcttcctctacctaagttcctcaacctagaagcattttcagaat

SEQ ID NO: 59418 - DNA, 1024 bp, Homo sapiens
gcttgcttactcacagccttgctagtacgggatactgttactctttttcatccttgccaatcttaaaagtgatataagtaatgcctctttgtaattttcattttcattttttagttatttgattctggtgggtttgaaatcatgaagttttgcataataaaaccatgagactttgactcttttttttccccatgaaatttttaaggccatgacagttctaggcagacctagacattttctctggcttttaaaagtagagctgttccttctttatatgatgaagtataatatacagggagtgttgcatattcttgatggtccagtcatcatcattatataaagatagcttttggtacaatcttatttttaaagctgttaggtccagaaagtttttacctggtggaagtataccttttactttattagtacaaaacctccatcttgtctctgatattttatgaagggatacttgggaacaaatgtggcagctcctataataacacttaaattgtattgaaaacacaagatagcctctttatattcagctttcttttacattcatgtactttgaacttaaatgagttcattaggcattaggttgggtttgtaagctttaatatgattttggtcatagaaaaaaattaatattcagtatttagattatttcaatttgccacctttgtagttcttgatattagtatgcacttatgttttattctttttttcctgctgtaatagcttctatttattattattatttttttacctcagtgtgctcttgctctttatgaatgtttccccttctgaagttcttttcttatttctctttagctgttgacaagtggcactgtctgtgaacctgcaggtttatatagacaaaggaaaaagcttatgttgtttattgtctttccagaagagggtgtagcaagagaggaaaagagcagctagactgtcccatcccccttcattttaagcatctcataaaaattaaagatgatggaatattcatcatactgaaaagcac

SEQ ID NO: 59419 - DNA, 3512 bp, Homo sapiens
gcactcatttattatacagagtgtgtactccaggggtgcaggaatcttggggccaccttaaaattctgccaaccacaataagtatcaactcatgcactcctcacagcaactctgtgaagcaggcactattattagcagaattttatacttgaggacacttggtcaaaggagtcacagaacaacaaagtaggagagcctgggtaggaactcaggcagcctgacttgagagcatagactctgtctgctcttcagctattgttgtgttaggagctcagtgctgtagctattcattccattgctttttctgtatatccgcaattctctcttctttctcttgtcatatagtgttccgtagaagacccacatatttgtggtgtttaggaaacctttacttgggtccacataccttttgtatggatttgattttactttcttggccatttaagtaacctctgagtcacaaagctaactgctggatcctgcctcatagacttgcttattggttctgtatgttgctataaactcattcttttgctattaactcctgccagttcttgtaaagtctagattgagctttttgttggaaaattgggagttgtggccatattgggtcagtttccacatcgcagtaattttcttgagctgggtagcagccaccccttcgtgaagcatgaactgtccaatttgctatactcagcctacttagctaaccctaacccattctattcagtcttcatctgaacttaaacttgaaatatatatatataaatcattgtaacagaagtagtcttctgttttcttacttcacttattgtttatacagtttttttcacctgaattccttctgtatttaaaaacccactgcagttttcagtgatgaaatctaattcagtcttttcatgaaaacagtttcacatgacagaaaaatccagcccacattgaatgaagcacaaaaggaatttgttggctatgactgaaaaatgcttccttttagcattgctaaggccaggggctcaaacaacattattagggtctggtctccccccattgctaggctttccttctgtgagttgcttcgattctctgatagcctttcttcttagggtggcaagacagtggccaaaagttctaggttttcatcctctcagctccaaattcaacaggaaaagtaacttattattttgttgcttaagcataatccccaagattagtggtgattgtatttcactggtggggcttggggcaggtatgcactcttgaagcaattgctataaccagggaaacgcggtatttctatgtgcttgccttagctcgcatgtcctccctgggagtctgttccaaggaatcacagagacagataatgaggaagggatgattttcagaggaatatgaggagtgagtgctagatgacagaaatagtgcagcttccttgcttactttctgtccctctcttaaacttctctaatacggattatcagtgacacgtataatattctgctttgtattatagtcacttatttatttattcatttgccagacatttagtgccagtgatgttgcagggattgtgcaagaggatgggaatagaaagataaaaaagacacatcagttgcccttggggaattcacaatacaatatgcataatttgctccccagctggattgtaaagcttaggagatgtcagaaatgttattgtgttcccttatagcacgtaacattatatttcttataaaacagactctcaatagacagtataaaatgtgtgcatgcagtttattaaaacatattctcattacttcagacttgctaggtgaatcaatcttaatttgtggccatcttgtttgtactcatacctgaaaaccattcccactgtagctttattgttttcccttgtccctgcaggaagtgtactacctccctttcgggcacctatggaatttttccagcactcatctcatcctgtcttttatcacagttacttattggtttgtcttggctcctgcacgagaattgaacattcttgagagcagtgaattgcttaataaatgtttgctgatttgaatctgtcgaatggtggaagtgtcctggggactagtttcaatatttttttcattgtctatttatattttatttgttcattagactttgttcagattttcccttaagttcccatttatgcttaataggcagatttgggttttgctcttcattagtcttccatgtgcacatttggtactggtagtattttaatacttttcacacagtcagagggttggtattgataatcagtgacgacttctatctctacaaagctgaactacccttaggacgggtagcattattctagaaagaaaatgaacttcactgacaggctgggtgttttctattatctgatctgaagttaatatcccttgtttctattttgcttgcaataaaatccagactttgatttcctgaggtctttgtaatcagtaatgaaaaagcaaacttgatgtgctttgagaaggataagagccaacattgaatactggctgtattccaggcactgtggcttgcatatattatattttaaatcttcacaacagttctatgggggtacgtactattattatccctgtattccaggagacaagactgaggcctaggaagatgaaggaacttgcccagagccacatagctagtcagtggtagaactgatccttaacctaggtgtctgtaattttagagttcatgtttttagtacctggaaagcacagaggcatttgaaaattccagattcataccttggcgtcccacaccaccacaaagatcaatagcattctcattcaggtaatactttaaacattgctggccgctttcctcacccgtacacctaagaaggcaattttgggtattttagaaatctctttggtaataacaacagcagactatagacagccatcacattacctttaatacatctaagtccccttgatccttcaacacaacaaaagccattgtctataatacatgcaaatgtgcattttcaactgtgctaatacattttatcactcatttgaaatgtttattggggtctataaaaaaactatgtgcattatgaaaagttaaagtaagtaaaagcacaaatgagaaatccaagtaccctagaaaccttacttcttagagaccaacactgttaacagttgggtccacatttatatctttatttagtatatacacagctacatgcataccacgtataattttttaatggttgtatactattccattgtatgaacatgttaaactttgttaactttttttttttttaaactttaattttaagttcaggggtacatgtgcaggactgttttataggtaaactcgtatcatgagggtttgtcgtacagattattttgtcaccaggtgttaagcctagtacctagtagtcatttttcagcctagtacccagtagtcgtttttcctgatcctctccctcctcccatcctccaccttcaagtgcgccccagtgt

SEQ ID NO: 59420 - DNA, 2870 bp, Homo sapiens
ccaccacgccctgctaatttttgtattttcagtagagataggatttcgtcatgttgtcctggctggtctcaaactcctgacctcaagtgatccgcctcccaatgtgctgggatcctgttgaatatttttaatgcagcttaaatttgtataagccttcaattttgatttgtaatgaagacaggagcagaaatatattttgtggtgccaccaagagagttcagcaaatccactgtaagttgtgtgagtacatggctcacctatcaacaatagctctttctaaacttgaaggtgagaactttagtaattttgctttgtcatggttgaacgctgccattagacatcaagagcaaattaaagaggagagttgggctgttaaatatcatactcatttattaagataagataatgactgaaaattgtaggacaagctaactttgtgtactttttgaagaaaggaaccttaaaatgtttttttattccttcatgttagattttgtaattaagaattctgtggtaattaatacaaagtctgactttagttagaatgtttctctaaatatgactatggaagcccatgtgttatttcaaataatcttcttcaaatagctatatttcctttatcatccttatttgtttatttgacatggtgtcacgttatccctctttaatattcatttttaagcagatttatgagaaaataccccttatctgtacattataaaatggatgcagcctgaattgaccattaacttttttttctaatgtaacaaagctgtgaaattagcatgattcctaatattttatgttaaaaagatgatttgtgttacattgaagataacaaggaagctcttctgctgaggcttgtgttgaaatgagattttctataattctattaaattgttgttggagttcaacatttttctggaagcgattctgtatcttcttgtaagattttagaataaaatatgaaacagaatctttaatcattgtttcactgaatgaggtctgtgctcctcaaaatgagtgctccgaaccctttcggattcagcattactgtgagagatttaggacaccttctcatgtaagcttatggcaacctcaggaaaagggacttatgttaggcaatagattgtaaagtaacacatgctccttattccaagtaatcgtatgagaatttagcttctatcttctgtgcctgttgcagggtgtaagaccaagcaggtatatgttagttgttcctggtgggctgtagcaagcaaggctgctcttaatgatggagtgcaggaacataaaaaatctcaacaaagatgaaagtttcatgtctcattggtagtttttaaaaacaaacaagccgcagcccacagaggtttatcatggggcttttcctctttacatatgaagttattaatttgtagcctatggctcagaaagcagcagaggcattgacagaacattaagttcaaacttaatgtcaagagttgtacagcgattaggctgcagggggtgtattttaaagataatggtgactgtgtggctaatgggataaatgcttgggataaagagaaaactccaaactctagcagtgctagtaagtggattttcatgctttgggcttgctttacttggctttgaggctaaacatcaaaatctttatgatacctttttcctctctattttttttcctgcttatgtattcattgaagtctatttttatcatattttcagttgctggtcatttactaatgttcagagaaatatgtacttttatggcatatgtacacattacattgaaagtctttcatgtttattatttttacaatgtgctttgaactagttttttaaactgaaataaatttctatatgtattatggctatgtccatgggaatgacttcaagttcattatattttgctgcctgctttatacagatttatactatttgttttgtacgtgtgctatataggagttcatgcaaatgtattttgtattatggcttgttttcttagttacgagcatctgaaatatagtatctttatttaatactatcacatacataaaactataatttcatttaccagtaaaattattatgctttgttctctgctaagtatttgttgacccaatatgtattacaaataactttgtgatgttatattttgtttttaggttagtagactatcattgaatatcctgaacttatttccaactggattccagtctaaagtagatgaacacaataattagtttccttctacaaaatcactttaaaatcactctcaatacacgtgttgtagaaagtattttttagtcaattgcctgccctagttctttgtatcactgggatgcatctgtctgcctgtgcatcttctgtgctagcaaacatgatatggacaaactgaatttttgtaattagaatgctattttaaatgtaccagaatgtacacttaaatagaatccaataataatagctgatatttattgagggcttcctatgtgtcaagctgtgttctaagtactttatcgctgtacacatttttctattgctgcataataaattactacagtcagccatctgtatctttgggttcttcatagattcaatcaccacaaataaaatatgtttgaaatgaaaaataacagtacaataaaaataatataaaatttaaaaaagagtataacaactaatttatatagtgtttacattatattaggtattataagtgtatagatttaaagtatacaggaggataggtacaggctatatgcacatagtatgccatgtaatctaagggacttgagcacctgtggattttggtatccacaggggtgctagagtcaatactgagggaggaatgtatgatcttagtggct

SEQ ID NO: 59421 - DNA, 1005 bp, Homo sapiens
gttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaa

SEQ ID NO: 59422 - DNA, 1419 bp, Homo sapiens
gtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccat

SEQ ID NO: 59423 - DNA, 1597 bp, Homo sapiens
gactgcaagcagcttgagggtcgtaaccattttcctagcacctggtgtagtgacaagtagattgcggagattcagtgagtgtatgcttttcctccatggcttgcattatgctttcagtccttcccattgttgcattgcctttatgcctccattccttcacgttgcattgtcacttacattacgttttagctccttcccattgttgcattgccagtgtgtttcttcaagccaccaaagcttgacgatgcctgccgcactgttgctatgacattagcaaactaatgtccatagggtatttctctagatatagatgtctgtagggtatttttctagatagggaattatttttgaaaggctgggtatttttgaaccaattcgtaaagctgctcatatacacgaaggagggtcatgaaagcaaatgacaattcagcaaggcctagttatggctggggtgtgtgtgcgtgtgtgtgcgcgcgtgcgcgtgtgtgtatgcgtgtcacgcgtgtgcgtgtgcgtgtgagtgttcaaggagggtggttcctaaggctaatgagcttctacctgtaagttattctgatttggtagaaatgtagctttgaataataatcattagcagtagctgagtgggcttgtgctttgtcaacactgctgagtttgataattagatgattacaaggatgtgatgacattttgtaaatcctttcctggagatatctatatgagtttgctaatcattatggcaggcttctagcttttctttagagcaatgatgatgctacaaagattttttttgtgctgaaaatattttccttgtatcagtaagatttggatgatatttgtcactttctgccacctcagagtcagcaaggagaatcttgcaaagtatttagcattttgtggaaacaagacattatgttctgtatagttaaaaattatcttttagtttattggagtggaagggcattttctccatgacaaggaaggtttaaacttgcatcatcttggtatttaaaagttcttttgaaaacaactcatgttttcaattacaaaataatatagagctctcagtcagtgtgatcattctatagagtgtgatcattccataggtcacatatttactaacagtcttcagtattagttgagtaggctctttaaagccttactgttaggccaggtgtggtgggtcacgcctgtaatcccagcactttgggaggccgaggtgggtggatcacgaggtcaggagttcgagaccagcctggccaacatggtgaaaccccgtctctactaaaaatacaaaagtcagccaggcgtggtggcacatgcctgtagacccagctactcgggagactgagacaggagaattgcttgaacttgggaggcagaggttgcagtgagccaagatcgcgccactgcactccagcctgggtgacagaggtagactccctctcagaaaaaaaaaaaaaaaaaaaaaaaagccttactctttgtcctttcccctaaaactcaggattccttttcttcttccaagctttgctcgtacagtttcttcagctctgcctggcaaatttcgtttaaacatggtgccttttctaggaaa

SEQ ID NO: 59424 - DNA, 4319 bp, Homo sapiens
caaaaaaaaaaaaaaaaaaaaccaaaacaacaaaaattagctgggcgtggtggctcatgcctgtaatcccagctactcagaatgctgaggcatgagactcccttgaacctgggagggggaggttgcagcgagctgagattgtgccattgcactccagcctgggcgacaagagtgaaactctctcaaaaaaaaaaaaaaaaacccatgaagacagggtcttagtatgttgcccaggctgacctcaaactcctgggctcaagcaatcttcctgcctcagtctcctgagtagctgagactacagacatgtgctatcatgcttttggttcttaattaaaggtgttatattttgttattttgttttgaaatgaaacataaagataaaattttctattagaaatattgtggttatgtaactcaggttcaaagtttttgtttgatttttcttagattgtggattattgccctcaaactttaaattatgatttggctgtttctattgcaaataagaaggacctttcatgggaggaaaaaacaaatatgttttagagatataatattaagagtgatgaaaaactgtgataaactgctctattaaattttgtaataggcagaaacagagtgttttttttaggggcaaaaatcagacattgccatttgatgtggaaaataagatgacttggtatatcataaaggtaagcaggcgagtttggggatggcttcgccaaaccagattcttttaaagcatcttaatcaaagaggaagagtcttccttctatcttcaaaagttgattttcattacagtttctgtgtttagtacctaatgttacatgtttaaagagacatattcaaataaatgtctatttacaaagcatgatgaagaaaggacaaaaatactgttttattatctagaagagctttataaccagagcgttccaacaacgtatcagcgtgtcctggtacagctggaagctacttcttcctggaagagtttcactgaggattagaattacgtgtcaggatgggttgtctctataaggtaggcctagatgatatgtaaactgctctttgaatttgtgagtttgtgatatttctggtgcatcatggaagggtgtagtttatcttccctcgccctctctattgaggtcctgcttattcttaaggtttctactcagatctttggtgaaatctacttggttaggattgagctttcccttttgtaaaatcagtagtcactgttattttctatgccaagcatttgacaactgtgactatcccctactttctaagttgtctgtccttttttcttaggttcccacttagactataaatttcatgaaaataggtcatgtgtccccattttcttccttaagcaaaataaaattatacaactttagggctgaagagatcacagaaactctctgataccatagccttcccattttttctcctctccctttctccagaatacatcagttgtggcttagagagggggaagtagtcacccagtgacaggaagaaagctagaactgaagtcttctgagttctgtctaatgccctttctgttagttgatgcccaagtgctcaagaacttagctgctaagttgaagtgaaaatgtgatacagcaaacagaagttaaattacagacaacctttcagcaatatctgtttcttatattgaagcctatctgtgtaaaggcagaaaattaaaaataagttacagaatagtatcgttcgacatttgaaactagattagcttgtctaatgatgagtttcaattcagagattctgtatgtccgtgtttaaatgattttggcttcccaaaccagctgtctgccttcccttcagataactcagttataaacagaactgctgtattacatatttgagtatgtggatttgtcttgtatttcccattttttggcccatactttccaggaagcaaatgagtattagacactggtacctgtcttacatcaacagatcaagggacaattggcggattgatcacaagtttcctagtgccgcactcctttgttttaattttttattctaccaagtactttaatgtgtactttcacattatcttctatagtagccctctgagttatgggtatcgtgcctttgtagatgagaaagtgcgtaaggtcacactatatttaagtaaaagagacagagctttaacatggctttcttcattccagagttcttattttctgcattccaccatactgcattctgtgttatattagttctctgttagagccctaattatggaccattataagccttagcaaaatccagaatgatggaaataagaatatttgataatattctctaatactaaagtattgctctaggcaaaactgtaaattatttaatcaggatttctgctatttttatccaggtggtacatcatgccttacatacctctgtccttcatatattcaaatctaaataaatgctggtagtttgagtgggaggagggtggattattcatgtcaaatgattctgtgctgatgttgccacaactgtatgtgaaaataaagataattgacatggaatttgcatggagttaaggtaccttttgaaatctgcattctacaatcttttagtactgcatattaaaacattaattattcaggagccctccagattgagtctttatcattttcaagccattattgggtgtgcttttccctatgattctatagatacatgcatttatagatttaaacattttctatgctataaactatatatgcagtgtataagaaaatactctttggccttattaacacctctttttcttttagtgatatttatttgaccttaacatttatacttgatattaatgacataggcaaataattttaaaatgttgtttttgaataaatacttgtcaagtaaaagaaaagcattagagctacatgtgaccagacttggcagtcatgggcgctatttcaagttttgattgacatttggttttcgttttgatgcttataggaaaaatttatcaagacactgtttatgcagagctgtttaattaggatcacctgaattaggatcagaattaaaaatatccttaatagaatttcctttccttccccgatgggtggcagcattttcttcagccaatacagcatctgcagaggcgtgtgtgacttgctggttggtgtcctagggtctgtttttcctccttcacaatcattcagtggctgtgggtctttcaggttagagcagaagttggtaaggtatattgtttgggggcctcaaaagtcttctgtaataagaagtgactatactgtgggttttcttgtttcccatttggccaagattttatggaacaatacccactttgcccaggtgcagtggctcacacatgtaatcccagtcctttgggaggccgaggtgggcagatcgcttgagctcaggagttggagaccagcctgggcaacatgacaaaacccatctctacaaaaaatacaaaaattgtggtggctcatgcctgtggtcccagctacttgggaggctgaggtgggaggatcgctcgagcctgggaggtagaggttgcagtgagccgagaacgtgccactgcattgcagcctgggtaatagagcgagactcggtctcaaaaaaacgaaaaacaaacaaaccaaaaccaacaatacccacttaaatctcaaggtatgcagatttgaggtgtgatagtgtttaaccttcggaagtcttttaacctgctcatcattgtccttctgcctgtctcaccagtttgttttaaaagttatttgctgatttgtctctggttacctgttgaatgacaatatggtgctgccatggctttacttgcctgcctgtgtttctgagctcatcccatattttctatataccaacaaaaatcttcatctatgtgacctggttttacttcagattcgtcgtgtgcagtgcctaaactctgccttttcttccgcacagcatactgcttctccacctttgctgtcttctctcttgacgttgcaatctcctgagccagccgtgccaggaatatcaggaatacctctgattcttcccccaaacttctgtatgccctgcttatgctgcttttaaagatctcttgactctattgttttatttttatattgttttgtcactgtcccagttattattaaaatccttccgatctcacctaaatggcctctaactcatatccttgcctctcactgtttccctgagtctcaattcatttttatattttgccattagagataattgaaaaaaaacccagatttgatcatttaatctcttgcaaaaagatgtctgtt

SEQ ID NO: 59425 - DNA, 1107 bp, Homo sapiens
ctcctaccttggcctcccagagggctaggatgacagacatgagccactacagctggcccagataatgtatttttaaaaattaatacataatataaatatatgagacttgacaaaaagaaacactaatatcatgataagattcaagaaatctagtaattacttgatagctctgactcatagagactgccattatactaagttcttcaaggaatgatgaataactatattaattattccaggtttgaagaacatttttctctaaaagctcacattgtaaatatttaggctttccaggcaggagacaaaagtgagtcacaactgcctcatgacaatttgtagtgtgtaaagagagtgctacttatggtctctgtggtagctgcttctttaaaaaaattattttaaattggcaaataaaaattatatatatcatgtacaacatgattttttgaaatacgtatatattgtggagtggctaaatggagcaaattaacatatgcattacctcacatgcttatcgtggcaactcaactctgccattgtagcctgaaaggccccgtgtacaatacgtgaatgaatgggtgtggctgtataccaaagaaacattgacactgaacactgatttttcatgtaattttcacatattcaaaaatactctttctatttctccccaaccatttaaaaatgtaagaaaacatccttagcttgcagactgagcaggtggtgggccagatttggcctctgggcctttatttgccaacccctgaattaacatttgtaagctggaaggttttttgcacacaattggaaataggatgtgctgggagaaaattctctacttaaaaaaggatcggaaatactttgttattttctaaaaagccattggttctgtcggtttacattgctggtcacatttctgagcacagtacacacacagtaattgttttttgagtcaatttttgttttactctaaagccaatttaattcaataatttaaaaatgttttatctcaatggtatagtaagaaaactgcaattattttactaaagagagaaagaaattataaaatagaaaaagcagggactttattgtcttaatattttaaactgt

SEQ ID NO: 59426 - DNA, 2613 bp, Homo sapiens
gagaagaaattttgcaaacaggcaatggtgtcttttcttgaggcttagtttcagtcatagccattgtggacagaaatcatgtactgttgccaacattcttagaaactccatggtatcaaagtagtttcttggaatttcacgtgggaaatgtaaaagtaggcttcccttgatgatggaaatctttctcacacatgcatcttaaaaggatggaattaagcgtgcttcagttgtcatgttctaattaattgaaacgccatggaatgtattgtatttctctattctatcccttaaaatgtccattgataattattggcaatggttattgatagtctcaacgtaatttcagtagaatttgttttgagattttttttatgcacataaaagatttctttagggattattgtacagagttctagaaaaatatataatttttttttctgggcttataactttcttttctaaaaatttatttggcagcctgattagaaatgtggtaaaatctgaacaataaaatagaaaatagactagttgcatagaatgtttcaaaaacaggcattagattggcggcaacaagaataaaagtgaccttcctgaccacagaacatatgccattgttagtgtttccggagctctgcaaagtactgctgaactttataatgttgtgcaactgccacagaatttttttgattagaaattccacatctgtttgagaagatgttctctccttctttctttcaaattaataattctcctggtagcatgttatttttgttctttagggcacgtatgtgacctccggagcttgcttttccaaaatctaatttttaattatattagctgtagctggttttgcaatatgtactggttgcatagattggaaagtgagtattttagagggtgtttttggtactatgatatttaaattttacagtttcattctgagtaaattattttttattggaggattcttttttttttaaattggagaagctgtgaaggtgttaaaacgagaatcttaccaattcacaatacgataagaaatcgcgatttaatattttgtggtatgttagaaataaagcaagagaaaatcgtgatactatattcaagattacatgcttgtgtttggccggtatgtgcctttacatttagagtgatcataaataatggatgtgatattctgctataacctccctcataattttagtgaagtatataaatcagcatggagggaaaattactaaatgacttttttgtgtatccttttcatcctctggtgaacagtgtacctcaataaaaagcgagaacaaagttgatcatgttatattcagcttttaagcttaaattttcagttctgttaaccatctcattctggatacactggtgctctgttacttcattgttgttggtgggctaatttgtgggaagagtattacctctgttgttttgaaaggtcaggagtgtgtatatgtttgtcacttgagggtttcaagttcatgtaggaccagattttagagccttttttgttgatgagctctgttgggtttcactgctgtagcctgctataaggtagtaaagaaagcaatcttttgaattaataaagtgatggattatctaattacaaagttgatgtgaaatggcagtatgataactttgactgcattactaaatgatcccagtgactgatcagatgtgcctgggttccattaaggaaaaatatgccattaaatatttaacactaaaagcgagcaggcacaccaggattgctaacctccagtcaccggggtgcttgtgtgtttacgtgtggtggtgactgctacatgccacatctctctactctgctcacaacagctgctagaatacttagctgttgggattatacttctcttctggtgttaagtaaagcaggcaaacagctaggatgcttaactgcatgcagatcctggcattctaattatgaaacggtgtcatgcatctatgatttatatatgttgtctttattacaacagattgaatctcgaagttgattcaggagacaattattctcagaaatatttctctaccttcaaataaagtgatgtttgtaggacacttgggctttcaaagaaaacaactcattgtttggatttttaatgatgatatttgtttatcgtgttcttcattcgtagccatttggttaaatatttcttttcacttatgtgttaataacctatgatgagttggtgtatatttatcatagttaaaaaccagatgccagctaaacttctgaagttgggaaggataattagtaagttcttaatcagcatttttgtttatacccgtgttggtcaaggttaattgcttatgtaaggctaatgctttgcttgaaagtattgatggataaatgtgtttgtcaagccttgttgctttatctatttaagtgtataacttgccattaatgcagacagaggtgatattttttaaatgtctgtatgacattatgaaatggcaaaggttactgtcattgctttggcttttcctttagtgacaacaatctactggaatactgtgtctctctactagaatgcaattacgtggagccaggaattacatcttatttattttgaattcctagca

SEQ ID NO: 59427 - DNA, 1449 bp, Homo sapiens
gaaagggctcagggaggatgagaaagttcttaatcccgagagcatatttcgtcgtctggtgagctgatggctttttctaatggaagctcatgattattgcctgaaaagttggcagtttgtattttgaacactggagtttctggcggaaaaatggtgtgtctttcctgtcggaccgggttctcaatgctgaacgtgcatctgctgcgtaagccttaattttacctggaaaatttcttctgttacttgtaattttcccggtcatattcccagatattcctccttttcaccccacttcttagcaccagtgttagtctgactctgactcttagcaccagtgttaatacacacacaccctaatagcaattggagtttgattgtggagttttctatatagatatatcctgtccacttatgaatttgttgcctggctgtaaaaactgagtaacatgagccataggaaggaggaatttttctaggggtgggtgtcaaggaggacctcatatcagaagtggaaactgacgtaaatttcaaaagcgaggctggtgttgggaaacagtgatatacagtggtctagaaatgctgttggggagtgagggtgttgattcctccaacctcctgagggaaatatatcaacctcctccggagaaggttttcaaaggaagttgttacctgtggaatacagatttcagttatatttagtaattacagtagagttagaataagagcttgatgtttaaaatgtttgttttgcactaaatgtaatagaaagtgagggtagggatactcccagaatttctctagaggaggggatgctgagtgataatctgttggatggagaggctagagcaaattacttgcagctttatttggatagttttgttttttttaaaaaacttagattgtatgttccctggggagtgtgtggctgaacggagataaaagtgtaaagtgtgagcaatgaaaggtgttaatttccacagacagcaatgaaggtgttgaaaggataggaagtgcaccggggatatacagatgaacacaggagatgtgattatttatatgcatataaaaaataaaggccaatttcatctctgctggctctttttcacattgtttagagaagagaagatgtatgtctccatctctacaagctgtttctcctctctaccacacacttttttttttttttaaatctccacttccattttcaaacaaaatttcctttgagatttttttccccctctttgggaatagggtctcaccctgttgcccaggctggagtgcagtagcgtgatctcggctcactgcacctctgcctcctggctttcaagttgagtcttgtgcctcagcctcctgagtagctgggattacaggcatgcgccaccacaccgggctaatttttgtatttttagtagagatgggcttttgtcatgttggccaggctggtctcaa

SEQ ID NO: 59428 - DNA, 1077 bp, Homo sapiens
aggcgcgaactgccacgcccggcctcctgaagtattttttttttttttaaatgattccgagggtttatcttggcctagggaggaagagtgcgatgattgatttttttttttcttcactagcccataggcatgaaatgattgcttcttgatatttaccctgggatagggatgacagaaacaccccctcactgctatggatctgctgtcctcgctttctcacattgtgtgtttgcatttgttttaatgttgatcacaatttaataacaagtaaaactttacttttgacaattttgccacttattttgtaatttgtaagcacacgtttgaagatatatttatgccattaatattttaaggcatgttttaaaatttactgttttctgaaaaattaaatgtaattggtttgattgctggagatttattccagtttttctcaaatgtatttttattctgtatggtacatttttatgattttctgattaatgtcatcttagcattatattctggttatctataatttaaaattgatttcaaaatttactgatttcttacagtgcatctgaaaactttctcatctatttcatatgcttctgaaaattataacctgtagtagtatcgtgtgccgtgcccaaggctgttttcatgttcaacactataaacacgaacacctactgaaagataaaaatataccttatgatgattattacctcattcctagtgttaagtttgtggctattctgtggtaattatttctattgttggaaaatgttccagtgataattactgatgttattaatatccatgaaaaatattttaaaatactttctgttgctacatgtaaaatgtgaattactatcctagttcttctttctttctgaagattttagtctcatgtattttataatgaaattatctccatgttgtatagggggaaaattctgttgctatgattaagtgtaccaatttttaatataatgcttacccttctccccacataatatttgttattgctagaaaatacacagttttgagatttttgggcataattggccttagtgtgtcacttctgcattaaaa

SEQ ID NO: 59429 - DNA, 1048 bp, Homo sapiens
tttactgacttaataagaactgataattgtttgtatgtgtgtacagaatgatgtagaaaatctggtaacacacaatctcagtgattttggttttaatgctttttcatatatgtgcgtacttatgttttgataggtgtttgatcttacattgcagacaaaatttggcagaatttaattgataacatatgcatcatatttagttgtcaaaagataaaacaatatgtatttgctctttgtcaaaatccaatgtaaggtaggaaatatctggtttaacagccagcattgaacacttgaaaattatccttcagaagtttactttgagattgtgctatttattttctctttaaaaaagatattaacaaactgactgaagataagaaagagggcctcaggcaactcgtaatgacatttcaacatttcatgagagaagaaatacaggatgcctctcagctgccacctgcctttgacctttttgaagcctttgcaaaagtaagtgttaagtttgctctttgctaattccatacatcaaccatttgctccttattttgttgttagttacaaaaatgtcgagaatcttgacaggaaattcaagacccttaatgccttatattacttccttatcatagtgagtagagcatgagagaatgtattgtgtgcattgagaagggtatgaatttttctgtttgattaatattcttgttattgcctgagtatgttcattgtgaattctcaaagtgtacccttggaagaaagagtatgctttcttttctcagaagaaaatagcatatcccattattttttgtgaatggacttgtttgccgttgcattgcattcattgagttttatggtggttgtttaagcatagagcctgtctttgaaatgaaaaatttattgaaatccatttcttttcttttcttttttgtttttagacagagtctcgttctgtcacccaggcttgagtgtagtggtgcgatctcggctcactgcaatctccgcctcccagaatcaagcgagtctcatgcctcagcattctgagtagctgggatta

SEQ ID NO: 59430 - DNA, 1034 bp, Homo sapiens
atgtagcacgaattagaacgtacatgaatttgaattttacataaatgtaaaaatgtaaaatgaattttacctatgagccatatatttttggaaccctgcagtagatgatgattgacttactttgggggcactgttgttattattgtctcatattataggttcctcacttaacaggagaccgtaattcccatttgcccaagaaatggtcatttattcacgttctttttttcctcttgtcaaccttatgccctaagaccattttcatggcacattccttctttatatttagctctattcatctaatttgattaagactagtgagaagatgctcttgctctacatttgatacagcattcagtaagcttttaaagtgagaagtctcatatctatcactaatctctagtgtgctctaaagagatttttttgcaagatcttaatcaatacctgtcagtcaactgtagctgttagacaacctgcttagccttccagttttcttttcccagattccagcttttcagatctgcctgcatctgacaatctgtaattcaatattggactacatttcaaggataaaggaggaggcattatttatttgctatcaagcaaactggatgtaaatggaaaactgtcgagtatcttttatttcctgcaagttgcgtggcagctcaactatcctaagttttgcccataggaaacctctgtagatgattgtttgtgagtggagtaagtcctgaatatgtaggaaaaaaatcactgtgatatttcacgtagaagatgtttagttaatattatatgaaactgttgaataagtgggctcaaaaaattcattttcttttctatatttttaaagacagcttcttcatccttaatgaccaaatagctgaggaaaatactgttgcaaattttcaatgattgtaagcctaacccaagcaggtttcaaacctattttgacataattcagatatttgttaggaatggatgttacagactcagaattttatcattggaagactgccttgcagatctttgaatct

SEQ ID NO: 59431 - DNA, 1047 bp, Homo sapiens
ctttctaattaaaataggataggaaatttcaaaacaataatattatttctacctcattttttaaacaaaagttttgtcgaagctagaaagatccctgatttatgtaagattgttaccaacaagagtaactaaaagcaaaaagtgaaacattaatactgctttttatacagtattcgttccagaaagcttggtttatggtgatgttctaggtgttttattcacgtgaagctcagctatttgtttctaggaacttcagattaaacagagtacatagagaagcgacagattatcatattatttgacacaagtctaggcaaacttgctttctaatctcaatgacctaaacagtttattaataaaacacttaataaacagtttacttaataaaacatttttttcccctgttttgtgactatttttcctctagtgccacatcatccttttgtagtacactcagggaagagaaaagccattatctgattagaatgagtagcaggagtttggtgggtgggtatgtcattttgattacctgtagtgcatgtgtttttactacatatattagctgtttactgtggcatcaataacaatgtcactgtcagatatactgtggaaggtaacaggaaaacagctagcaagatgaaggatatatgtaataacagctagagtatgtgtttgtgtgtgtggagggggagttaaagattggccagaacatatgcgtttaaactgctgtgtttatctcaaccttaaaatacaacattaaacattgtaattattgtggatacccacaaaactacgcaaaattaaatgacatactgaactgtgaacagtgatgaacagaacgcaaaagcacttggaatggaaattgaaacagaggatgtaaatctgtagtataaaatccataatatgtataccccagggggacatgattttggttcactagcttagcatttgatgtgtgggaccatggcatcaagttgtctgagagaggctattggggtattgcaggtgtaacatgtaccttgtgcccacaggatggtgtcagtgcta

SEQ ID NO: 59432 - DNA, 1011 bp, Homo sapiens
ttattcaagtactctgaattatcttgttagttagtttaccaaacttctgtgtcaacatttattatagcgtttttttggtagctatgggagggaggaggaaatgaaggattgatatttgctaggtgttcatcacctgagcttcttaggtatcttgattctgctcgttattttttaaaatcaagaacaaacattttgtatgtacttgtggatctttatttttagccaacagacatagcctctgattaacttagacaagagagagggaagtgagaaaatctgaggagccaggtctagggaaggcagggttcagagcagccctggggaattcatcttaaagaggtttgctaaagaaagaaccctctcccagttttggctgcggttctcagattggcttggcattctatgctggacagcttttggcgatttggggcctccttgtttacaggtctgttggaagttaagttgccttgtttcctacaataaagatactgatttaattctgctctcagaaccactcatagttttttccacccagtcatattttgaggtttgttattgatgttttccagggtggggagtggtgattaggttttactgtcctactttttttttatggggagagtcgaggagattaaaaaattacatcactgccatcatttccccagaattcccttgtttttaacccgactgaatcttgagtaatattcttatattcctaattttttttttttttttttttttttagacagggtctcactctgttgctcaggctggagtgcagtggtgtgatcacagctcactgtagcctcagtctctcgggctcaagccatcctcccacctcagcctcccaagtagctgggaccacaggcttgtgacaccatgcctggctaattttttaattttttttttttttgtagaaatgagggctcactatgttgcccagactggtcttattcttatcttctttatctacttattctttatcttctagatctatgaatttctgaaaga

SEQ ID NO: 59433 - DNA, 1055 bp, Homo sapiens
tgtaatccagctacttggtaggctgaggcaggaggatatcttaaatctgaggggcagagtttgcagtgagccgagattgcaccactgcactccagcctgggccacagagcaagactgtgtctcaaaaaaaaaaaagtttaaatagagatggggtcttgctgtgttgcccaggctggtcttgaactcatgggctcaagagatactcctgccttggcctcccaaagtgctgagatttagaggtgtgagccaccatgcctgggccttattttttagagtttaatatcatcagcttttttccatttgaaagactctccttggttacctagaaattttattttagctttcataaaaagctttgctttgaaagtgatcactgaattaatctaaggaaatatgagtcttaagatactgtgatgatgttcagctgcctcgaatactttttaaaaagttagtatagtgttcatgatgtatgaacagtttcttttgatttatgagcttcagattttgtgaattttatgaattttgagtgtgtctgaaaaagacagtggtaggaataaagtaatttctttccacatgaatctgtttttcagtgttttccgaagaaaacatatttgtatactgtataattcatagtggttttttttttatttgcctaggataatgaaataaagtacattgggtattttattacatggctgatattgtttctcttggctgctttgtttgttttgttttctcttagaaaaatatctcaagtcttgtatctcaactacagtagcctgaaaggggcaaggaattttctattggaaatggccaggaaactatactgcatcaaaagattgaagtcataaaatagcacaattaatgaccgataccaatcataatattgtttcttaaagttgtcttaacactgaaataattttaaaaaaatggttttggatccagacacagtggcatgtgccggtaatcccagttacttgggaggctcgggcgggaggactgcttgagcccaggagtttgagaccagcctgggcaacctaacaagacaccatttc

SEQ ID NO: 59434 - DNA, 1133 bp, Homo sapiens
atgagcagatcacttgagtccaggagtttgagaccagcctgggcaacatgttgaaaccccatctctgcaaaaaatataaaaattagccaggtgtggtcgtgcacacctgtagtcccagctacttgggaggctgaggtgggaggatgacttgagtctgggaggttgaggttgtagtgagccgtgattgcactattgcacttcagcctgagtgacaaagtaagatcccgtctaaaaaaagaatcatgctgtacctcataaatgtttacaattattatgagtcaatataataagagtaaaaaagtggattagtgtctaagtcaggactgcccaaagcactttctgtaatgaaagaaaggttttatacttgctctgtccaatatggtaatcagccagtagtcacatgtggttattgatcacttgaaatgtggctaatgtgaccgaggaagttgattttcaattttattgaattttcattaactagccaaatgtggccagtattggagagcacaagtctagatcacgtaaagagggcacagagatcaagtaaagaggacgcagagatcaagtgcttgcaggggctttctaaatgctgcagttttgttgacttagttctgtctctttaacttgcaaactcctcactgtactttttagcagaagcaggagtctgcaagcagatatagacataatacatatagatgatgggacttctgtctttttggatatggaggcctcgtggccatgtcttcatgtctgtctttgtctagcaggtgggtgccgtatgtgaagtcttctagtgtgctcacaggttatcagtctcagcatcctgggttcagctgaactgactcaaggaagctctaattattgcggcatatgtttcagttttcaggctggaggaaatgtgttcccttcagtctgaagtcagcacagatgggatcttgagccaaggcctcaacacacaaaaacaaaactgctaacctttcacagctgccgtggtgctgctgacctcagcagcggtggccaccagggtatgtgtaaagcttttataacgaaaagcaaaaaatttccacttacagctatcattgtgattcgaatttaagataggtcaatgaagggtgatatgctggctggcttta

SEQ ID NO: 59435 - DNA, 1105 bp, Homo sapiens
tccctgcaggccccacctccaaccctggggattacaattcagcgtgagatttggtggggacgtatattcaaactatatcatgcatcctcatgaacatagctattgttaaatcattctgttgggaatagcgctgttgtgatttcctcagtaatctttactgataaaaattagctatttactcattttttgcctggtggattttaattctatccgagagtgccgcctaatgattaagggcataggttctggagtcaggttcctggatttgaatataagctggactatttactgtgtgactttgggcaacctgactttctttctgtgcccaattttctcatttgtaaaatgaagctaaatttggtacctacgtcatagggttattataaagactaaatgagatacttagcacagttcttggtatgaagttagcactaattataattactgtagagtggtagcatgatgtaatagaattagacaaattgggttgtaatcctagcactggttgagggtgagggtggaggtgtctatacatgaccttgagcaaactgtttaacctctctgccttgatttcttcaacctataaattatgggtaaccttccttatcaggtaattaggaagatctggtacataccaacatttaaaaactgctactatattaatctcttctccctttcttcccacttctttttttttttttttttgagacggagtctcactcttgttgctgaggctggagtgcaatggtgcgatctcggctcacagcaacctccgcctcccgagttcaagccattctcctgcatcagcctcccaagtagctgggattacaggcaccggccaccacacccagctaattttttgtacttttagtagagatggagtttcacaatgttggccaggctggtcttgaactcctgacctcatgatccgcctgcctcggctgcccaaagtgtctctccacttcttacttcaatttaagaatgctgcaaattcaggaagctttttagtttactgaaaaaaaaaaatcaggtagtattctttttaacacattaaatagttgtcattcaatatgttttattggaatctatttttttcaatggctga

SEQ ID NO: 59436 - DNA, 1051 bp, Homo sapiens
tgtctggtcttggcaatgacttattatagattcttttcttctcaggttaatctttcctggtaatttaatgagatttctggggaggaggtttaagagaattgtatttcttaaggaaaaagtttccttagtctgataaggaaattccagagagagcccctctctgtgctttgggagttggagagatacaggagaaggttacagagtccttggttctgaggcagcttctaaggtcttctgtttttttaaaattcggaagtgcccagcatatgaaagcaccatacttcaggatatcattttctgagccccaataatagtcatagtaattttctgctgaaaacgtttgtatgattttcaatgcaaaaatgaattctttattttccccctttactttcattttatatgaccttagtaaaagttttttttttttttttttacttttcccagtggacactgttctaattgtgggcttgttgattcatgctgatgaatagtaatttcttgcaagttattctggcacatagggttcatttttcatgtgatctgcataaaaataatggtggtgaatactaatcaagtaagaatgcagatttgaatactaagcttcaaagaaaaaaacttaattagaacctttaagtcacagtagtggtccctctgcagggaaagtatgctttattagttctgtaatgtaaaacttttttcttgttccaacctataaattgattagtgacaccgcatgggtaagaaattgggagtgggttgggcagaactgctgtctcatatgatgttcttaaggattgtttattattaccagtagcatagtttaaactaaaactatttaccccaggataaaaatttatttgaacagttaaatcaagtttatttctcaaaaaatttatttgtgaatgcattgtactgtatgcaacataggagatattaattacttttaatggcaaaacccacagttccttttgcaccaacctaatacaaagaatataagttctctaagaacttccagtctagtgtacttacgtgtgggagtttctacgtacat

SEQ ID NO: 59437 - DNA, 1097 bp, Homo sapiens
taattcatgagcatggaatgtttttccacttgtttgtgacatctctgatttctttcagcagtgttttgtagttttccttgtagagatcttttacctctttgattagatgtattcctagatattggtgtgtgtgtctattgtaagtgagattgtgatcttaatttgaccctcagcttgaatgttataggggtatagaaatgctgatttttgtataccaattttgtatcctgaaactttactgaagtcatttatcagttccaggagtcttttggcagagtctttagggttttataggtatagaatcatattgtctgcaaagagagagagtttgacttcttttcctgtttggatgccttttatttcttcctcttgcctgattgctctggctaggacttccagaaatgcattcttaagcttatctattgatctaggatagatccattgaacctgctttggccaaaaattaagtatcaacttaaccttgattatttcttatcatattagtaattaatttgagggagtgatcatgataattcaaacactgaaaacttattaaaaaaagctttcggaatgttttgtaatgatgagtgtgactgtgaagtatacagcaagatcactgtaaaatagaaggctgcctttagagtaggaatatgctttagataatagtctgccatcagttaggcagtcaagaccaagcgagcgagtggagtcttacagtctgttacacagagaagtcttccagtatatttaaaactcaacctcacatcgtgaactgaagattttcttttaaagtgaacatgagtaaactcattaaagagaatctcctgctgtttcttgacactgtgcagattacatattttggatttttgataaactttatttcctggatgatctctctttctgggtgccctctaattaacttttataaagcaccaaacaccacctctccacctcctttaaaatctttttgtgagaacaagtggaatgattaactttctaattgatgtatggtggtgtagctatctaaaatactttcattaaagcaacttaattttttaaagatagccaagttaaatatgtaatcactctctagagta

SEQ ID NO: 59438 - DNA, 1071 bp, Homo sapiens
gttacctacgatctggcctttgaccatttgtttatttagtctctcagtagatatgttggggatgggtattccctgccaacaaattgattgtataacatattcaaagttctgttttcataggataatgacagttgacttttggaaagggaagagtagaggatgaggagaagagcatttattgaacagcagttttatcttagtctctgtgcgttggttctcaaagcgtggtctccagaatagtggcttcagcatcatgtattgtgatcatgtaagagattatgttattatttttttttgagacggagtctcgctctgtttccctagctggagtgcaatggcgcgatcttggctcaatgccgcctctgccttccgggttcaagcaattctcctgcctcagcctcccgagtagttggcattacaggcatgcgccaccacgcctggctaatttgattatgttattcttaataggaatcatatgccaaaggtcttagggatgagttaaaatgtatgcaacttattttcaaatggatgagcaaaagaacgtacagatacacatatgtagagaggaagcagacgtggaaagttgttaacaaatgttgaatctggggaagggtatattagtgcttgttgtattttgatctcctcacctcttctatttgaaaaaagtgggaggaaagcaattctcttaaaaagctggaagtgaaacagtagagctcagtaatccaagtgatgattacatggcaattaattccccagaggagatggggctgcttctaactgggagaaggtgtagaatgaagaactgactaagcatagagctgacctgcctactgtgatttatggtgtgtgtgtcctgctagctctccttatgtggatacttctgtagactataagactgaaaaagaaatattggaaagacaatcatttcttgtattgagataatcttttaagactggtgagacaacttcaggtgcgtggcctctgaatcagtcagtttctgtctcgtgtatttgtgagagaaacttctggaaattttgttttcaaatgtcaaatatatttcagtattttcat

SEQ ID NO: 59439 - DNA, 1080 bp, Homo sapiens
tcaagtgtattgcatacacctgatccaggtaggtggcgaaacggtgggcctttttaaggctggtttgctttcaaccctgtggcttttacttaggtgcctgaggagcattttaagtcagttcataccttttgaatacctcgcttttggtaaatttggagtttatgttcactgataaaccagcagggttgtaattttttattcaaataggaactatctacttatttttatttctagttattttaccttttttgtcagtagtgtaaatagcatctttttatagtatattttctaagtttttattgtttacatatagaagcatcgtagttttatgtgattttgtaatccaccactgtactaaattctcacttataacaatgtttcaacttttttctcccttgaattttgcaaatgtgtcatatcatctgcatatatggatacttccgcctccttcagtccgatatcgtgtttcatatagcatagtggtgagaagcaccggctctggaactatgactgcttgtgtgttaagcctgtttctactaacttgctagctatgtgactttgcgcaagctacttatgttctctgtgccttgctctctccctctgtaaaatgagataataatagtactgccttattattatgacgattatatgaattaaatgatttagtatttgtaaagtgttcagaacagtatctgacatatagtaagcactgtaaaaatgtgtggtaaataaataaaactcacataagattttttttcccttgcattggctagtatggtacttctagatgaatattaatctagaagcccaatggtgggctttctttattcctcccagacttcaacagaaatgcttgtgtgtgtcattgttttagtgtttcagtaatgtttccagtaaaacattagaaagttatagactgatatgaaatgtatttttccattatgttaaggaaatagtcatctattgctattttgctaagcgttaaaatcaggaacggtttaaaaatttcatcatgtctatttggcatctacttagatggtcatataacttttcttttttgacctacttatatggttgctt

SEQ ID NO: 59440 - DNA, 1041 bp, Homo sapiens
tagagacggggtttcaccatgttggccaggctggtctggaactcctgacctcatggaccttattttctaagagtcacctgagagtttccaatagaggagtgatgagggagaagatttattattttattttatgtttttattttttctctattcttacccttgaacattcacctctcgaaagatttattcttctgaaatataactctgtggtcagtgttagcctgaagtggccagagatgatcagtatggacatgaattaagatgctgttttaaaagtctatacaagaaaaggaaaaaaagtctactcaagagatggaaggctccatataaggctgtagaagtgaaagcacaaaggagaacttaaattcgatattctttggggaagtagactttacaggaccattttctttaacctagagccagatttggattagtctggtccattcggtgtactaggtggaatttaataaagctaagccctgggtacaccattcccatccccttgtgtcctccttcataactttgatcttgtgtctgcctgcttaatgataccttagccatgtctccagttttccaaccttgcaatgactccttagacctgattatagatatttgatttctctttggattttggctatcactcaccttctggtcccactcatttgtgggttcttcgcatattaaaacaaagcaggacaaagaaacagtcttatggggaaaatataagttataataaatggtgctaaatgcttcaacagaggcatagacagaatactgtggaagctaggtggaaggactgcctaatgctcctggggtcagttagggcagaggagaaaatgctttagcttggtgttggtggatgagtaggtatgttacatgggaaatttgaggtgcctgtgagatattcaggtggagctgaccagtccaggagatggctggagtgatggatctagaaaagcagtgggtctcgaccttgtgtgcctattagggaaactaaacaacaaattcatgccttggtcctattcgtagagatactgattt

SEQ ID NO: 59441 - DNA, 1787 bp, Homo sapiens
gtgatgtgttttcaggtgtaactagtgcagtggtttaggtattttggttgaagtgatgtgtttttaggtgtaactagtgcagtggtttaggtattttggttgaagtgatgtgtttttaggtgtaactagtgcagtggtttaggtattttggttgaagtgatgtgtttttaggtgtaactagtgcaatggtttaggtattttggttgaagtgatgtgtttttaggtgtaactagtgcaatggtttaggtattttggttgaagtgatgtgtttttaggtgtaactagtacaatggtttaggtattttggttgaagtgatgtgtttttaggtgtaactagtgcaatggtttaggtattttggttgaagtgatgtgtttttaggtgtaactagtacaatagtttaggtattttggttgaagtgatatgtttttaggtttcacatctaaggagttgggagtggcatctgttacaattgtgaaaaagcaatggtagatttattaaaatatggaacattatttggaattaaccacaaaatgacttggattgtatttagatttgctctccttttattggaaaggtcccaaaaagcagagaggatgagagaggagaaagaatgtgaatgctcattgctggtcatttttttttcctgtgctatgccatcttaattgttcatagctcttctcttttaagaaagcttatgtgagagccacaattgtatcagagaacattattacataattatacagccttccctttcccttaaatggtcctttaaggctttacatctgcaatagagatagcttagtgaatattcttccaaataagtttttttagtttcatttttagattagccttttgtatttgcgtaaaacagtgcttttggtaaatgttgtgtatttaaggggaagaacaggatacttctgggggctgaggtaagtgttttgatgttagtctcaagacatgttttcatgctataaatgataactggagctaaactgatactctgggtgtcttaatggttgttcttttcattgccattttagtatgactcattatgtaatgctctttaatgttttgcttgaattaatgtgaatgttttatgagaatgcctgatttcaaggacttatcaacagcttaactcttaatgttcaggcacatcaattgaaatatacatatcatcgagggggaagtcatcctttacctttaacttggtcacttaaaaaggaacatttttagaggagatcgtctgggtacagtagaaaattagttttgttgttatgaacagtaaatcctttctaagtctgcagctgggctttgtttaggttcaagagaggggcaatgagctcaacctggtgctgtaaggacatatggtctaagtcagaagaaacctgaaatttgggttaactagtttcatccccttgagagatctgcatataactgtagactctggggaatcagaggctccttggtctgcccttgtctgtggagcagtgtttgcctctttctatccccaactgctggtttcccaggatcttgttggacgtttcccctactgagaagtatatggccttgatttccctgtatctgaaactggagcactttgtgttttttatcgtatcttatgtttataaaacatatggaacttgttaccttagttttattggccaaaattatatgtcttttagttcaggggctggcccttctttagaagaaagcacttgactgagattgcctagctgtttatcccgctgtatgtgcagggaggtgtactggcacctctgagtgagag

SEQ ID NO: 59442 - DNA, 1015 bp, Homo sapiens
ttacattttctttctatagatgaacacattctttgattgtctcctggttgtttagggtggtgctcactctttcaggtactcagaacattgtatcttttatcacatttaccaccttgtattttaactttttttttttccagacagagtcttgctctgttgcccaggctggagtgcagtggtgcaatctcggctcactgcaacctccacctcctgggttcaagtgattctcttgccttagcctcctgagtagctgggacgagtagctgggattacaggtgcgcaccaccatgcctggctaatttttgtattttaagtagagatggggtttggctatattggccaggctggtttcaaactcctggcttcaagtgatccactcgcttggcctcccagagtgctgggattacaggcgtgagctaccatgcccaaccatatttcaactatttgaaccagtaattattaaatactttttttacctcctctggaagctcttggatgcaggtattgtgtcttgtaccgtcaatgtctacccattctgactgttcttatttaaacaaaattcttcagtatagttctagaccatattttctattagtataggtgggtaattttatttattttgttgtcttggagaccagtggatcttttgctttccttatatgtccatgggcctacctttttgaacagtgttatgctcctctaagtcttatctcctttctttaaatgttgtatattggagaactataccattgctttgatcatcaatgagaatgagtatgatgagtgaattagtttttttgggggtggtgagattactttttttgaagatcactttttaattagtattattcatctgtttgtctacatggtatactgaaaaataggactgtacttggagaagtaagtcttaggtttgagcgctgcttccatttgctagatttgtgaccttgggcaaatcacttaatctctttgattttcattttcttcatctacagaatgaatgaaatggggttat

SEQ ID NO: 59443 - DNA, 1045 bp, Homo sapiens
tttgtttctcgcttacctttttgccccagtactttcttgggtccctttctaccctatccatcgtttgtcctttttcctcctagtcaggagccatcggcgttctctgagataccggttcttagctttagctgcacactggaatcacctggggagcttggaaaaatcctgatgcctaggctacactcagtactgatcgaatcagagcctttggaggtgggacgcaggcatcattattttttaatctctaattacctactaaatatttttctgtcatcatcttttattcagtctgaaaaacatggactaatttaactagattaaataaaaatatagattttaaatattatagattagatttataatatttcagttggatgctatccactcaagcgatgtatgagtctcaactttttctcttgaattgcctactaacagttttttttattcttacttggaaatgtcacttatattgctttctttcttctattcctactgccaccatcctagaacaggctctagctttagttcctgccgtccagccagggagcacatcggtagttgaacagagttgcgttcagacatgattacagagtggtcttgttttcgttttgatccatcacggtcacagagtggccttgtctgaggtccatgttctgtgaaattgtgtatgttcaacagaaggacaccagtgcctccctgtgagggcctggccagcttggagcaacacctgcctacctgatagtatcggtcagttcctgcagctcctctctagaggaccgatggtatcagccaggggcagctcctctctagagctgtgtcttagttgattatatctgtttgcagatcctccctactgcaatctgttctatgaagtgttgccatattagtagtcttccttaaatatgcctttaatgactgattcttatttctctctcttttttttttttttttatttgagacgaagtttcgctcttgttgccgaggctggagtgcaatggtgcgatctcggctcactgccacctccacctcctgggttcaagcgatt

SEQ ID NO: 59444 - DNA, 1086 bp, Homo sapiens
aaatacctatgtggggttgtaccattttgcattcccactaatgatgtatgtgagtacttgtttcccttagctttgcagcctgaacttttgaatttttgctaagcttatgggtgagaagtgggatcttagtatagttttaatttgcatttaaattgcattatgggtgaagttaaacatcttttcatgtgtttaaaggccatatttatatctttttgtgatttgtctgtatttatcttttgctcatttttcttgttttttccttttctttttttttttcctctagagactggggtctccctgtgttacccaggctgtaatgcagtggtttgatcataggtcactgcagccttgaattcctgggctcaagtgatcctccctcctcagcctccagaattttctgagcagctgagaccacaggcgtgcaacatcatacccagctaattaaaagaaaatttttttttagagatgagatctccctaggaggctgtcctcccactcactttgagattcttttgggggttctctgatttgattttacatttaactgtatatgctaccatctgtagcacctcgtagatcaagtttcagatgattttccatttctatctgggagttccccattatctcttaatcagatgtgatgctccctctggtggacaatggagtaaaaagcatacaaatatttttcagaaaggcaacttattttttagccactaaaacactgtctctgagtggtctccttcatgaaccccctttccaaactgttcttagcctctgacatttgccattaactcttattttgaattagaccaaaaaagggcaaacaagttaaattttgtcataaatatctatataaaactcactaatgaaatttacatggtatagtggcttattgatgatgaccatgtttttcacaataagagtcgaaacctatgtttgaaactagtagttttacttggagttggtatgatctggagggaaaattgtgcttgttgatctccttacagtttattactacaagaagattctgtgtaaatgagtttttcccctagtttttgacataataattacttgttagtatagaaa

SEQ ID NO: 59445 - DNA, 1762 bp, Homo sapiens
aggtcgtaaggaaggtgatggccagtgaaatgtggccgaatcaatggattagaggtcctcatgtggtcagagaaatggtgagtggtcagataatgggttgacttgatatgtacatgcttagaagtagtgtgtgtcttgatacaacaggtacggggtgtggcagaatgtggccaaggtagggagtaagaaaagatttttggtcaggaaacccaaaggctgaggttagttgaattatctaaataatgaagttactaagaatgttagacattggcatgaatagtttcagcaaaggcagaattctcacattggctaaaataacccaaggtttaagggtcagtagagtagaagaggctagtggagacaaggaagcacttacctctgtgaaaataatgtaaaaagacgttactgggtttacggctgattttgtaaaatatggttagcaccaggcgtaagtgaattgctgcagtgttacagactcttccttggaggccctgaaggtcaagcaactagcaaaatcatttcaaagagcagaaccttgaacgatggcttgaagtaggatttgcaacttcctgggcagtggctaatgggtctaggatttgaaataaggtggaagaattgataataatgtggtttgggaaaggactttatggatgtgactacatttttctttttaagtgggagtcataattcctgtttcttctactgcttccttttcttctgtaacgaggtttgggaaagggctttatggctgagccctggtgaaaacatttggtccatgtgaatgccacagcagagggcgttcttaatcagacaggatgacctgctttgtggatagcagtaagttgttcttcagacagcctggtgcttgctcaaaaggctcaagaacagagcaaccatggggacggggatagaggctggtgcctggaactcaacaatacagacttcccctcatgatagccatgtggcttctgctggtacagagtgcccagtttgctgccagtagtaactggtcctgattccccaaatggcaacacatcttcaggaccagccagccaccttgtgtcgggttattatggtagaactttttgtcatggaggagtcagttggaatatcaatttttttcctgtacttggatttgtcttccctgtgtgtaataccaccatctctaagatccactgagaatctttgatagagctgtgatattccccacaaggttgcctctgaccttcccagaaagaattagagcaatgggctaatgcttgtggttttgactgtttatgtttgccgatttcctcattggaagactattggtgggatgtagaccaagtctgccttctatcgaaaaagccaaaaaggctaaataccttctcaacctcccttgcagctagggtgcgggcagtgacctaagttcggtcaatctaagatgctctctgaggactttgaataaaagccagtatcacaaagaagaatggttgagagaatcactctccagcaacaaccagtttcccaaggagcagcagcagcagcagggcccagtgtctgtggtgatggtagtgcagaatccagcattatcaggcaacagaagcgatacagtccccagccccagcccctgctcttaacatactctggcatttaaggcagctggtgttatagaccagtggttctcagaccttttagtctcaggacccctttatccttttacaaattatcaaaatggatttgatagggatttaaaaaacgttattgagagtgctgatgatgt

SEQ ID NO: 59446 - DNA, 1089 bp, Homo sapiens
gtccccggcctgaaatcacttatattgtccttctgccgttgcatgcatttttaatttgatggaggtagaacaggttggttgacaattgggtatgagttatgtgtatttcccgtttgctttggtgagtgcagcacataaaattccattgttatgattgtatttgtaaaccttctcactccctagtgtagtgctctaagtctaatcttttttatatccccagggcctaccacatgggagatgttaatcattcaaggattaatattttggggaacttgaagtcgctgtatgtttgtctttggttttctcaagttccaagttgcctgcagcttccatatcaagagttacttctggcaaactctaatgatagtttcttctgtagggtaaagagaatagctcatctggcattaaggctgagaatgaggcttagtgcctcccaggaggaaggaggatgacttggaagtagacgtgtcatccctttcagtcctggtggattgtgggcagcggggggacagaggtagggaaaacagattgtgagaaatatgtgttctgatctttcttggctggctaaagttctagggttagggtggggatgttaaatgggttgaggggacggtcagcagtagaaggccttttgctctgctccttatgtggaatcttgagaggagatgttatgcaggttagtgataggccaacacgggcctatagcacagcagtggtagaaggaagtggctagatagttgagtttgtggtaccaggggattctgaaatgctctcataccactgtgaaggaggtggaggagcttattggcctggtggaacagctggcgtcatgacaaaagactgtgtgactatagactgaatgtcaggatcacagactccagggatgagagccagcatgacatcctaaaagatgagatgggaccagttcagccataggacctgattacctccttgcagcagagaccagtgaggatccagagaaacaacacagatccaaggtcttcttgccactatttcttctaggatgtccgataagaccttggagggaaatctacccgaaagcagccatttaaaccagcccgggtaagg

SEQ ID NO: 59447 - DNA, 1051 bp, Homo sapiens
ctgccaagacttgactgggcatcggctgaaccaagttaggattgcactgcaaaagtagctggggctgggatctggggtgtatatcacttctgtcgcctgataatattggattctgcagtaggtaccacgaacaccatagacactggaccctggtgctgctgctgctgctgctccttgggaaactcactgttgctggagagtgattctctcaaccattcttctttgtgatactggcttttattcaaagtcctcagtgagtgtcttggattggctaaacttaggtcactgcctgcacccctagcgcgagggaggttgagacggtatttagcctttttggcttttaagatagaaggcaggctcactctacttcccaccgatagttatccagtggggaaatcagcaaacataaacatagaaaaagggatataagtaaatgctaagcatctaaacaaaacaagctaaacagattcttcataatgactgacaaatacttactagtattttacacagacacaaaatatttgcacttactttggattgccaggatacacagttcacttgtgttgtggtagtagttgctctgtttgaacactcccattttagtggttatagtgttccaaagagcctggttgggaatcactgcaacctgaaaatagtgttagggaaatgttagcgcattgtttgatgcagttttctgccactgttgaatgcctgtccttgagggataagtttctgtattacttgtcatcttgtaagtaaaatttgtttctctttattcactgtccattgtgaagtctttaagaatagtgcatctttcagtttttgtagccccagtgtctaacacatagtaagcccttagttttagtatgaatgtctggcagaattttcctcctaactgcccctgtccttctgctgccttccatctgaattaagtatggaatgaaaatgttagtttgtagcaattaacagttacatgggaaaggaaaaatcaaaatagaattaaaaaaacagatattgatgataattacagtcatgcactgcataacgacat

SEQ ID NO: 59448 - DNA, 1048 bp, Homo sapiens
ctcgccactgcactccagcctgggcgacagagcaagactccgtcctaaaacaaaaaaaagttacagtgcaaagtactagttgtgatgtcatgatgcctgcaactttgaaatagtttaacgacaatacgtgtatacatagctacaggtggggagagagtgacgagcagaaatggcaaagtgctaggttgtctgatttaggcggaggtatataggtgttcactgcactgttttcaactgttccgtatgcgttaaaatgatcgtaatacaatgttagagggagaaaaaaaaccccgcctgtcttctgcgcagtcgccatgggcacgagccgcacgcggagccttacgaccaccttcaggtcccacacactccactccagccgtccctccagactccatctgcgcatgctcttgccccaccgcgcccgccccgcccctcgggcgtacgtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggtgcgtaaggagcgccctcgcctacctgagtcgcgagctgtgtggggtgctggggaggggggggcgtcgggcggccggcagccgcgggactcctgctggatggggctgcacaggcagcttggcggtgctgcccctgacgcgcgtgtgcccgggggcgggtcgctgctgacaggccccgcccggacacccccctaggttgccgcagcggggctgggagggggcccaggctcagccactgccccccaacctgggctgcggtggaaatgggaaagccattgggcagacttgagggggaagcgttgtgccggggataattttgctgggagacgaaaagtctgtgtgct

SEQ ID NO: 59449 - DNA, 1063 bp, Homo sapiens
cagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccct

SEQ ID NO: 59450 - DNA, 1106 bp, Homo sapiens
aaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaactt

SEQ ID NO: 59451 - DNA, 1083 bp, Homo sapiens
ctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggaggg

SEQ ID NO: 59452 - DNA, 1064 bp, Homo sapiens
ctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggt

SEQ ID NO: 59453 - DNA, 1030 bp, Homo sapiens
caagtgaagatgggaggctagcactaagcagtagtcgcttatgaaatcacattggtagctgctctatggatccggaacaaaagagggtcttagaaacagcaatcatggttgttctgcccagaatggctcttttgagaggagcaggggaagtccagcctcctcacaatagaagaaatgcagtcttccaataatgtaagaggttttagaaacaatggttggcccagaatttatgtagatatctaaagagcgcccaaaggaaaacccaggaattacctgttttccaaatggcctcgtccttgccttttgtttttatcatgacctctacattttctaattaattaatgcttctcttgatagccatgtctcttgcgcaaagctctttttcttttcctttttaatcactcttttaatttatatttgtactgctcttcctggacttttgcagtagttacttaataagtttccctgtcccttgtttcatcttctcccctccaaattggtcttacgttagcactctataaacttggggtctcaaactggtacccaaggagccagtcaggtattagaagtcaatgaaatgagttaggtgtagagtgataggaagaaggtttccacgccttgtctggaagtatacagcttttttaaactccacagattaaaccaaccacagctgagggttcttgatcgaacacacggactgtgagtttaaactcctgctatgaaacacttttaaactatcattcctttcccacggctctctttacctgcaggataaaggctgtactactcgacattcaggactcctgtcatctggcccactctgtctccccaacgtcatcttctgtcctggggtctcagactataccgtagtcagactggccccctcgccacctcccagatacaccttgcatgtcgtcacgtttgctcttttccctctgtgtatgtcagctccaccctgaggtgagcaaccttctttccacatacctatctcttcccagccctccacatctaggtcatggctttttagcat

SEQ ID NO: 59454 - DNA, 1138 bp, Homo sapiens
ttaatcttgttttaattgtaatatatattatagcatatggcataaagcaacattttaatagtcatagaaaataagatattttcacattaaggaactggcaagaggtttgatactgaatttgttttcaaactctaccagctactggcactgcaagcttaagcaagttactcaagcccttgaagcttggcctcttcgtctgcaaaatggggctgataaggcttctaaaagagagttgtgaaaattaaatatgatatagtatgtaaatatcgttacataaaatgtacacatttactaaattatagttgttattatggaacccaacactaaagaagcgggcagagaatatcacttgtttctgtagttaggaatagtagcagtaaatttgacatgtgccactatagtgaaattgctggcacttaagttatttgtcatatactataataatatgatttatgaatgttaattctcaaatcagttggaagccaactgtgtgttcttgttcagaattgaccaacctagaggttctgaattgagtgaaacctatatcattaaaagaatgtgacttggtatctgttttcttctttaattttgtgaggaggcacttccaacagcagtgtgtctctgaatatttttcttgtcacattaggattcactattccagaagagttgcgaataattttgttttcacaactagttcattctgaaaatgctatttaaggtggtcactgatatttgaggggaagtgtgggaagaactatttatttgcaaatacagaagactgggccagatggaattttttttaattctgcatttattcatagagcaccacccgtaacaattacattaattatagctcagacattctttttggtctcaatagaagggcttggtatatttgtttgggtaagaatttggcaattgaagtgggaaactaaatttagttttaaggctttattttttgagatttaaaaattcttcaccttttaatactgacactatagttttaaaaacaatggaaatatttttaagaatagtctggggccgggcacagtggcgcaaatctgtaatcctggtgctttgggttgcttgagcccaggagttcgagaccagcctgggcaacacagcaaaaccctgtctc

SEQ ID NO: 59455 - DNA, 1193 bp, Homo sapiens
tctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattata

SEQ ID NO: 59456 - DNA, 1200 bp, Homo sapiens
cttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggctttt

SEQ ID NO: 59457 - DNA, 1037 bp, Homo sapiens
gcattcctcccaacagagtaaatggcagacgcaaaggctcagagcatggcaatggcaggcagatgaggagtgttcattgtgaatagccatgtgtgtattacaggtagtctctatgaaagatgaaatgtgggtaggaaacaatagtctctggttgtctacttcttagaaagtgagagcctggatctggacaaagggagtgggtacagaagggcagtagacagtggaaacattcaaaaataaaactgatgataacttggagattagttgaattgtaggaatgaggaataaagaacaggcctgcataactaaggtttctactaaaaggtatgagaaaaggagtcaattttgcatttggcgagtttgaattcatcagtgtttggctctagtattccttgtctcaggatagaagttttaaaattggattcgtgtttaatacttaaccttttaaaatgtttaacccatagaaagatgatgcacaatcagtagaaactctgggaaagccaaaagcgaaacgaatcaggacgtcaaaaacaaaacaagcaagcaagtatgactttctgttctgttcttgattgattgattgattgagacagtctcgctctgtccccaccctactatcctccttttattattttattttatttttatttattttttttgagacagagtctcggtctgtcaccaaggctggagtgcagtggtgtgatttcggctcactgcaacctctgcctcccaggttcaggtgattctcatgcctcagcctcccaagtagctgggactacaggtgcccaccaccacacctggctaatttttgtatttttagtagagacggcattttatcatgttggccaggctggtctcaaactcctggtctcaagtgatccgcctgccttggcctcccatagtgcttggatgacaggtgtgagccactgcacccagccttgttctgtaatttttatccatttttttctcaaaattagatttgagaagacccttaattttacgaaaaggaaattaagctcatcagaaaagattat

SEQ ID NO: 59458 - DNA, 2872 bp, Homo sapiens
gcaggagaggtactgaacttgaaagccttaggaatttcatggtttatgcagccccagcaaagggaagaggattgagtctagcccaagggagcttatgtaggtgaattgttcttcaaccttacggggatcgtgctatttagaaaagtgtggatagttaggtaatttggggaataccattaaaacacagtttgggggttgtttctgttttttccggttaattttttttcttgggtgagaatagaataagtccttaaatgttttcagaactgttagcatcataattttcaagcttttgttgactgtctttttagctagggaaatgtagaatttctagttaaatttcagtcataatctcaaaatgtagttattttgactgaatgagaaagtctgattgcttaaagggataattttgtaaagtaaacccataagtatatgccatattaaatataatttatgttttaaaaggcacacagccaagggtcatcaaaaacctgtgtgcttcaagttaaaacatgtattaaaattctttaaccagtctcttatctttaattcatttaggtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaaggtacttttctttctctgcaaaacagtttttcatctcagtcactcttcagcttaaaatttggttatttgtcctaaaaatggttttatagggaatttttccccttcccccctcaaaccaaaattgatcttttagtagtaaagtttaaaggtttcatgtttcaaagtttgagttcagttattcagtatggttaacatgacttaaatcctgtaactcacgtaacagatttattttttagaatagtgtaatttctcttctgtgagttttataaattataagtgacttttaattaagtttcttccaaaatagtcaatatttttaatctcccatgtactgctgcatttggctcacaccccagtgatatccacaacccgaaattgttttgaagggaaacaccagtagctttttactaagatacagaaattatttcaatccatattcactattgcccacaaactggcgcatctacatgccctcatcttcagtgag

SEQ ID NO: 59459 - DNA, 1079 bp, Homo sapiens
cctgatactcaagaaattcatgtaaaaaaaattaattttttacttctttatcagtctttcagttttggtttagttgtttcaagacacagtagttcaaatctaacacgttcatttatttgactgctatataaaaacttatttataaaaatatgggttcaaaaaataagtgtataaatcttttgtggaatataaaaacacatcctttaataaatcaaccttggaggtgggtgctgtggcgggtgcccatagtcccagctacttgggagtttgaggagggaggatccttgagcccaagagtttgagaccagcctgggcaacataacaaaatcctgtctcagggaaaaaataaataaataaataaactggttttcatgaaagccaaaaggaagtgttaaagaagccatagttttatcaagttaatttttgctgatctggttcaaatgaaaggtttttttagtcataagatcatatatttgaaaatatatggatacagttacacaggattgacacccccgccccatgcatccttgtgggagaatgatagtcaactggctggtgttgaacatctgtacactctgaaaataactttttgctacttaataagacttagtttttttaaaaaaaaaattctattataccaaatcttttattaccagcaggcaacttttatgtaataaattttaagataaaaaaccaactcttctaattatttatagaaatttggataaaaaaccaactcttctaattatttatagaaatttgtttaggatttgggaagtttcttaactcataaaaatgtcatcgttatccatactcatcttaatgagtattcccactgccaaatagatgagtaaagttccagttcttttagttgggaagctaataagagttgtgggtatggtgtaagtgggaatcctaatttctaggttatttccaatctgtcatctcactgaatgtttggggagtgggaaaatgtcattgtctaggtgggtggtaatgttctaccttcttggtcaggagatctctctgttactttctacctcctcctttttctccccttcccttaccaaaaggtaatt

SEQ ID NO: 59460 - DNA, 2141 bp, Homo sapiens
gccagtatgaaaggattatccaaattattttttcattgtaatgttttttgaattttaatgaaaactaatgttatttattgcaatggctttcatggataattgcaaagcaaagagcagtcgcatgagaaggaatcacatgagagttaccagcatgagaaggaatcacatgagagttaccagtgagaacctgggtgcatattcactatcttggctaactagttccttttaaaatataagcttatttgatattttgtggtgatgtatcactgttacttttatggtaaaatctataaatgtttcaaatacctttttattgaatttactttcaaatactatttgttgtaattttcaaaattagcatgctttaattgggttttgagaaaggtcagattagaatattaaaggaacactgtcatcatattccaggatttattttcatgtggattaatacaggtttcattggtctcttattctgagtcatttatcatactttttctaggtagcattaaaatattgaaccttgcctctactgagttcatagaaaatattccagaatacttgacagacttatttgaagactggccacagattattaaaaattggcttaaatataatgtatactgacaggcattttaaaatcatttcatttctactttaaggccatgccattgttgccaaaagagtaaaacattagaaaatgggtaaaacaagtacagcattgtttctgaattcacttttaaattttatattattgttcagaatgagcttgagttgtattgaattctctgaacctcagtttacatcaccaaaatgacaggttaggtggtaggactaaagcaggttaaagcagatgggatcttcttacacactaaggtatgtatttctttttctaaaggaaaatcttcacccagaagtccaaggtaccagtgttggacgaaggattaacatctgttgaaacctacacccctgcaattagagcaaatgacaataaatgtatgtataataattttgacttcaggattattccatttttgtgttttgagtgaagagttttctgttcttagaacaaaataatctattgtgttattcagatttttcctcctcagttattcctctctctggtcagctttcctggtgtagaagtattctaaggagatatataagctgtcagacagtgggttgcttgtaaggcattctgtggctctaatattcaaagtcttagattactagtccacagccaaatgcatccctgccgtttgatcttcttggactcagaagagttatttcgtgtttgtttgtgataacttaaggccaaggttgacttttcattattagaaaataatcacaaatgactgaatattctccagggaaattaacaaatatatggaattttttttttaatccaatgagcatttttgtgaaggcctattctcagttaggccctggctatacagagatgaggaagataggattttcttaaggagcttacagttggattcaggggaagcagacaccttgaatgtctatgcccagaattggtctgatcatcttgtgtctattaactcatttaatcctcacagcactatactatgacatagttgttatctgactctagagcccatgctctcaactgttatgcctttgttcctggtacattatgaatggggtatacggcaagcttcagcagactagtttttgtcccatgattaaggtaatacatgattatggagtaatccagagagaattgtctaacatgtaaaaagccgatcacccattttaggggtccataattaaccatttaaagtgtctttcctgaatttttgttttctgtgcccatttctcccgatatgttggaagaggagacaagacggtgcctgaagagtgcagggggctgaacccgaatgtgtgggttcctaacccagttctgcacttcccagttctgcacttaagggctgtgtctctatttttttttgttggtaaaatattaatagttttaaatgggaatattaataagacccatttcctagagttgtcaggattaagccccttgcatgtaaagtgttttgtgtagcgcttggtacctgaagtttagtaaatgttagctgttagaaatgatcattatcaaaaaagcaactttcttt

SEQ ID NO: 59461 - DNA, 2210 bp, Homo sapiens
tttggttaacaagagggccaggggaacactagtaaatgggagagacttcacctagaattggtgggtcagaaaactgaacctatttgtatgtttcttaccctacacacgtttttaacaaggttatttaaaggtaactcctaactctaaagctgtaaaactacatacttacataaaaatctgcatcttaagtagtttaagatgagagtccactgaagtttggactacgatatctttacttagtaagcatgggcattattaattactctaagaactttaggaccatgcccataaatagcatatgtctagaaatttacactgccttacttatttgagacagagtcttgctctgtcgcccaggatggagtacagtggggctatttcagctcctgcaacctcttctcttgcctcagcctcccaagtagctggattacaggcatgcgccaccggtcctggcctacattgctcttttgatgtgccttgttctactaacatgtttaaatggtagctgttaaaagaatgttcatagcattatcttcactgattattcttacaatattaggcagtctcaaatagaaatttgtatttatttttttttttttttgagacagagtttcgctcttgttgcccaggctggagtgcagtggtgtgatctcggctcaccgcaacctctgcctcagcctcccgagtagctgggattacaggcacgtgccaccatgcccagccaatttttgtattattagaggcggggtttcaccatgttggccaggctggtctcgaactcctgacctcgtgatctgcctgcctcagcctcccagagtgctgggattacaggtatgagcctccgtgcctggccagaaatctttattgtgtttgtggtgggtggggtttcatacaacacaaactctatagtgaagctagatttgaatcctagctcagctacttactgagtatgcgtcatgagctgggatacgcagtataaccttaggcttcagttttcttatctactttttttgaatgttgaggattaagtaagttaatgtatataaaacagttgcattagtgcctgttcagcaaaaagtgaaaagcgagaggttaaggggggctcttgagctaggttcagagaattagaagaagaaggtgttggccgggtgcagtggctcatgcctgtaatcccagcactttgggaggcccaggtgggtggatcacgaggtcaggagatcgagaccatcctggctaaaacagtgaaaccccgtctctactaaaaatacaaaaaatcagcagggcatggtggcgggcatctgtagtgccagctactcggggggcggaggcaggagaatggcgtgaacctgggaggcagagcttgcagtgagccaagatagcgccactgcactccagcctgggcgacacagcaagactccatctcaaaaaaaaaaaaagaagaaagtgttagcagtctgataacacagcagcaaacctaaaagaacaaaaaagcagacccaacaactttttaaaaagtaataatgcaagactatcagtaatcactaaatatttagcataaataatattcttatttgtatgacttataggcaatttagaagatgcagaaacaaaggatctcttagttgcagcagaggcattttcagaattgaatcacttaagcccggttcaaggaactgaagcttctctttgtgcaccatcagtctatgaagggtaagttaatggagagaaattcaaatacttttagaaagaagtttaatgaaattatgaaccagaagtaaaatattctgtgcatgttagatttcacttagatctttaacatctccattttggtaatgttggctgttttaaaagaagtttagttgtgcagttatatgtcatttagtagttactataaagtttcggaaatatacagagacacggtaaattgaggcagaactctggtgattctgtttttgttgaagaccaagatttcgctcacagctgtgcatacctccatgccctctgctttccagtggtttcaggatgatcaggcacaagactcttgtaggtagacacagtagagcacaggggagatgacagacagttttatttccttccatttgttcaatacatgactctaagtttgtgttttttaacgaccatttgaaacatactcccaaataattttcattgacactttaccagatgacgtattcaaagtatggtcaagc

SEQ ID NO: 59462 - DNA, 2196 bp, Homo sapiens
tgaatttaagttggaaataatgcttttagaaagatggatgcagttttatgtttcgtagacttacgtataaaaagctctggaagaattttgtattttctttgcagaaatctggaataaatatttctattgatatgtttattggagatgagatgagaatataaccactattgtgactcagttgaccccatctgtttttatataagcacttttttttttttttgagacggagtcttgctctgtcgcccaggctggagtgcagtggcgcaatctcggctcactgcaagctccacctcccgggttcatgccattctcctgcctcagcctcccaagtagctgggactacaggcgcccgccaccccgcctgcctaattttttgtatttttagtagagacggggtttcaccgtgttagccaggatggtctcgatctcctgacctggtgatccgcctgcctctgcctcccaaagtgcagggattacaggcgtgagccaccgcgcccggcctataagcacttttaatggtgtaattccatttgctctttactatagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggtaagtttgataataattgggagaaaagacattttttaataagaatgtattagctctgacaagtaaaaagttagataaatcaagtttttaaataccactatagatttttgtatataatcttgtagctagtaatgaaataagaaaaggttagttctgaaagaaacactagggccattggctaagccaaacccatcatcttacagataaataggactcggaagcaccaagtaagttggctgtagtcagctagatgtatggtggtagaattgggagtaggattcaaacctcctaatttttagtccttcttttatctttgtttttaccttatattgtgttgtttctaactagttatatgtttttgagggtgtgtcttgaggtccactgtaggttaataggaacctttcagtgattattggtcatctagcctgttctgtgttgtagtcttctgaaaatactggtatattaccaattagggaaacattagccaccattaacttttacgtactagaagagaatggatttagaataaatgaatttttattaaggagagaatttgggtaaaaacaacaaagaaagtatgggtatgattgggatgggtagcttaggactagacttaactgtgatatttactaatttttttcttttcaaaatcttactttacaggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggtaagaactcatttctgaatactcaaaattgttattaatgtccctcaataaagtttataatagaattttttccaccataagaaaagcatcctagccaggtactgtggctcatgctagttaatctcagcactttgggaggctgaggctggaggattgcttgagcccaggagttcaagaccagcctggtcaacatagcgaggccctgtctttacaaaatagaaatttaaaaattagccaggcatggtgggagtgttcagaagtttgaaacctcagtgagtcatgattgcaccactgtactttagcctgcgtgacagagcaagaccctatctcagaaggaaagcatgagagttaaatattatatgctcacagtatactagttcctagacataatgcac

SEQ ID NO: 59463 - DNA, 2418 bp, Homo sapiens
catatgcttttattaaattcccgtttgttagagatgcacttaattccagcgttcttcattttacagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaataggtatgttttcttacacgtttcatagtcatgctgcttgttaatctttactggacatcaacagcgttcatcaacaatccactctctttgcctaagtttattagtgtatgtaaaaaagaaaaactctttatgttggctatgtttctgagaagaatttttaaaaacctttaaaagtgaaatgttcattattatttgtaagcaatgcagaactgtacaaagtaaaacgaatgaaaaccctctgttctcccatctcatccacttgttatcagtgctccttgtgatacatcagaagttaaatttttattttcatagttctaaaatagaagaaccatctcctatagtgtattcgctcccagctccagagctgcctgaggcattttttggaacaccaatttcaaaagcatcacaaaaaatttctaggtaagagtttattaaatcattcttagagacacaatgttagatgatagttacaattgtaatttttaattatctttaacattttatagacttttaaattattaaatgaatattttaatgtttgctttttattatactttgggcagcagtaattttaggaaattttacatcaggtagtagtatacttaaaatttttgttcaataatttcagactgcttagtggacaggagtgaagtttgtctcatgagcaaactattaacttactttccttgttacctgcttgttagtagacctctaaatgagggttgtttttatacttaattacagattaatcttgggtagctcattgaagctttcttctgttgaacagtgcctactaaaatgtcttgtgttgcttcagatgcagcacgtttacatcttacctgtggtgttaagttgaagttttgtatccaagatgaaattgtgattgcaagtatttacttacgagcattggttagttgaaaagtgttcataattatgtaccacagagaacagagtatgtctcttcatgtattgattctttgtccttaatatgcccaggatctttggaaatttttgattgttttatcaaagacaaaattacattgtttaaagtatttataatgattataaataatcattacaagactctgaatttttgatgctaagaaaaagatacttgagataaggtcatacaaacaactgaggccagaagtacagagtgtagtttaatggacatatgttaaaccttgaaaggatttttctttttttggactaaatttagttaggttgtttccctttatttactctggtaagatggtattttaaatggaaagaagatattttaaatgaaagtcgttattaccgacattctttttttctaccaatagttcggatttttttttctgcaagtccccttttcttggtctttttgtaatttaatggctctgaggttgcggggagcaataatagaagttgaaaggcctttgattaatggcctgaggcccttaaagaagtattatgagcattttttaaagccagtgttaactcagatgtaagagagccagttgagttttgaatatttaccttctgtgtttttcatgctgagtttgcattactgggtagacagtatagcctgcaatgaaataaggcagaatagataacatccgtgggtacatcatatagtaaggctgaagtgctaatttatgtaattgatgttttatttttatgtgatataggatgcattctttatatggattatggtaaaaaaaaattagctctaacaagtaaaaagttacataaatcaattttttaaataccactatagatttttgaaaataaccttgcagatagtaatgaaatcagaaaaggttagttctgaaagaatatttggtctcagggttgaagacctgagacctaatgcaatatttaacatttcatttagaaaataccttaaaaagatttctcagaacctttaaactattaagtcttgatgatacagaagttttgctttgacttggtaggtagcttttgttgcacagtccttgcttttgagaagcattcattcataaataggtgccttaaacataaatattaacacaatgcaaaacatttaacagtgttcctttgggatagctcagtataaaagtgagcaaactgttttccaagtttggatcgaatccaagtacagaatttaaatgcaaacaagatagagaaagaagagaatctagaagaaaagaaatgtctagcagcctgattggatattcttg

SEQ ID NO: 59464 - DNA, 2792 bp, Homo sapiens
aagttttattggttaatgttttgtcattttcatactgtttttaacttgctttttaaaaaactaatgattttccaagttaatacatattttccttatatagggctacatcgtaattcattgtttcactgtatttttttttttttttttttttttttttttgagacagaatcttgctctgtctgccaggctggagtgcagtagcatgatcatagctcactgcagccttgacctcctaggatcaagcaatcctcccaccttagcctactgaatagctgggactacaggcacacaccaccatgcccagctaatttttgtatttttttgtagttagggtctcaccacgttgcccaggttggtcttgaactcctaggctcaagtgatctgcccaccctggcctcccaaagtgttgggattacaggcatgagccattatgcctggctcttactgtatattcttatacttaatcttttgcaatttttgctggtgtttctgtagactgtattctttgcattgggatcattgggtcaagacctatatttaattataatttttatagatatgctcaagtgaaccttcaagataatcctgtcggtggggtatgagttgaacactggcattaaaaaaaataaaaataaataaataacagtaaaaaaattctcctacctgattctggaagacttctgtgtaagaaacactccttcatttaaatgatcttatggcccacaaaggacatcttagcacctctgcatggtgtctgagactgccaaatttaactcaggttctccaatctgatcttgctgcaaatcaaccaaaaaacatctactaccaagctctactcttcccttcctcatggacacagcgtgcttgtttccatctatagatctcagtctttcgcacgcttcccactgagtgtcacttcttaaaaacctgatgttcctctgtcacaccacaccaaccattcagctctatccaggccacattagttttttgtcttctttgaatttttgtctactttgcttttttattattttatatctaaaaagcagcataaaattctttaaacgtgtcattttactgacattcttagcaagattattatgcagtacttagtattcaacaaatttttaaagtacttttcaattatttataaagatactttacaaagtatctttgaaattctacatgtagatttcttgttttgtacatttaaatagctttttctaaaactaaactttgataaatactgctttcaggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggtaattacttaccgatgtaaacttgtcagaaattcaagataaattggtagtttacaatctattttgttctttttaggaatgtttagtgaaatttttgcagtccagtgccagcgttcagaatcatgaattccttttagtgcaccatttgcagcgtgccaattatgtgcctgccttgaagctgaaccaaactctgaagattaatgttatggtacgattaaagttgtcttattatgggggataagagaataaggaaaactggaggcttttttggttgttatataagagcttacagtttggtaaccactgtgcctagcattaccttgaacttggagaatcctcagttcatctctgtaacagaattgggaacagggtattaccacgtaattcttttacgtatgccatttatgttctgatgtctgcctacaatattgccatttcactcagggaaaacaagaggaagatgtagaggccagcagtaggagttacatagtacaaagatcattgtgtggtagaggaagacgtagaggccagcagtaagggttatatagtacaaagatcattggacttcaagggtcagactaattcttcatttactctgtgtgcttgggacacactctgagtcttgcttttatcaactgtaaaatgataaaatctccttgtgaggttgttttgaggatgcacagagatgtgtgtgaagtagaatgttgcctgacacatggatgcttaataaccattgtttttattaattgtgaagaatcaaggcttggtagcgagatttggaatttattgatgggtaaggattgataaaaaaattagatatgtggatgaagttcttggtttggaaaaatggatatgtaggtagggggaagattttttggatattcatagttttattttaaatggtaaatatagaattacagcacctaacattttgaaggttaaattttttaccaattttgatgtttaatagaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattaggtaagaatttcattgaagaatatcataatctattggatcaaaaaagatactgaatgattacttttctgaaaccaccttaaatttagctactttcgctaacacatacaggcatgccttggagatattgctggtttggttccagatcactgcaatgaagtgactatcacgagaaagctagtcctctgaagttttggtttcccattgcataatgtttacactatacttctaagtgtgcagtagcattattcttaaaaccagtgtacataccttaat

SEQ ID NO: 59465 - DNA, 1023 bp, Homo sapiens
acttagtctaaaaatgtataattccatttataatttataagctagatgatgtttgattaagctgccatcttttgctagatctttagaaatttgcgtatatctttgtttcttgtatttactgagctactgacttcataaaaatacgctttatctcctttgtggtgctgataataaaatactgagaatgaatgaagttggtgcgggactggttgtacccacatttactaaaactatcttctcattgctgactctccatgatggctttctaaacactaaaaacaggcatttcaagtctcttttaatgctacattttgttgctacctattgtaaatatatacgtaggaggtttttgttgttgtattttattgtccttaatccgctttttaaaagaccatttatttgctacttgatattatgtattcctttcccaacaaaacagacactcccattgaatctttcccaactgtatttgccatttcttggggccaagttaaacttattcaggggttttggttgatagatcataatgactatgaggtaagtctattcacttacagcataaactttcatgaattactagaattttagaaaatacacataatttaaatttggtattaaaagatatgatacagtctactaaaaatagttgaggaaggacccagtttaatcagtacctttaccaagcactattttagaaggcaagaatataaagataattcagaaccccaggtttcttactgtttaaagaaggaaactaataagtaagtaattacgatagttcagatacagtgatcgttaatattagagagatgtttggggtgttgggggaaccatggaaggcaagatttggccttgatatatgaaattggtgatgggaagatcttataaaatagtgtgatagggtcttagaggtatcaggttttttataaagcttttattctttaaaatacagttatcattcagtatctgtgtggaattggttccaggatccagaaacataccaaaatttacagaggctcatgt

SEQ ID NO: 59466 - DNA, 1026 bp, Homo sapiens
gcccaggctgcagtgcagtggcatgtgtatagctcactttaaactcctgggctccaacgatcctccttccttatcctcctgagtggctaggactacaggtgcacaccaccatgcccagctagtttttatattttctttagaactggggtcttgctgtattgcccaggctggtctcgaactcctgaccttgagttgatcctcctgccttggcctcccaaatcactgggattacagacataagccaccatgcccagcctcttctctctttgatagttgggattattacttttaatattttgatgctggttgctttgatattaattaacagtgatattaaataagtcttaatttttccctgattgcagagggaagtggaatcccgattgcttgatgattgatggactggtttctcagttaggagagcgaattgagaagttgtggaaacgagatgaaggaggcacaggaaaatatcctcctgctagtctgcatgtaggtttgcagtaatgtgctatcatttagagtctacaaagctggggagggaggagacatgcttagctgtgtgtctggcacaaacttgggaaaacaagaagcatgaatgaatgaatgactgtataagatccactgaaggttttatccctttgttttataggcagtacttgatatgtacctattagacggcgttactgaagcagccaaacactctattgtatccttttaagttttatccagtgtttcatgtattactaaaattataaaatttcaagagtagtggaaacctgacatatctaattgcaaggttgaattttggttttgttttcttaagaagaggtgttaacccaggatctgttgtttgggctcagatggcctgtgatcaacctaaaactatatgaaaaattttgttttttatttgtttttctaggtatagggtacttggcttttatcagacacttaaatgtgtccaagacactcaaaaagttaacaacagttgctctaaaatactaccaccaagtggtcactatcaatggc

SEQ ID NO: 59467 - DNA, 1067 bp, Homo sapiens
tgtaaataaaaagatgtgtagtaatcttttattacctaaatatacccaccctgtgggttaaccaggggttgctgtaaatattaaattacagtaaaatattaatatgtattgttgagatatttggggattattaccagctttttttccaactcttaaaaatctagatgattctgtgcagttgtcaaggttatgctacaactaccctgtaattcagaactactacaccagtcgtcgacagaagtttgagcgtttatcaaggtatagtaaaacaattttagaaattacatctgtaagaagtcaaagtttctcagaatagtgttcatcgttttacaaagtgattaaatgggtagaattctcagttaagtatcagaatttgctattaccattactattttatttctcttttttaaaaaagtacacgaataacctacttagttcctttgaaatgaagtaaaggtaatagacaaagaaagtggtgttgagagtcttgaccacacttctggaaatagtcgtcttcctcgagttgcagtgacaaaattacaaagcatataacatttagagcagtgccacaaacgttgattccaggtttcttacacctgaatcacctgggaatcagtactttaaaatctgtgccggctgtaattctgatgcatggcaattgtgggaaccagtgctttagaatgaccaatttaggagagtgaacattagcttgggagattgactaggcatattttaaaattctagatctgttatttcctaagtgtatatccttggcagctttgttatgctttctaatcctgcttgttatataagttataaagtcagtataaagctaaataaaatagtatgtgcaggacatctagtgcagtgcctggctcattggacaaccgcaaagagtagtaagtgctgccgctattcacaattagaaaaggaaatcaggggaaaaaagaagagaaaagaaaaggaaatagggaccatacctgcacgttgcatcataggcactcagcaatagatattcgagtgaaggaatcactgaggataaaagactaacccaagtgatgaaacag

SEQ ID NO: 59468 - DNA, 1040 bp, Homo sapiens
gaaaattaagacttttatctaacctagagaccttattgaaatcccagtaatgtcctttatttcaatttagagggtagagagagctcagaatcatgctttgtattttgttttttggaaaagagatctagaatagtttgtatgtaattgtttttataatttcccttaatcttgtacattttgtcactttgtctttcaaaaaattgacctttttttttttaaaggaattaggccttattttatagactgcattttagtttgtgcttgccgtcgctcctcatgattaaatgacagtttttgcatttttggcggcagcattacctgaaatgacgtgctccgtggtgtggtgcactgagaaagtccattttcccaagttgcctccctgaagtgttgatgttcactcggttagggtgctgtctgccatgcttctccaccaacaatttagaactctgtttgtaattaataatctttattttttcccttttgtatttacaaataagaacaaccaaattctgccactaatttgcgctttgttcttgaatggacgtggaataaagtggttctcacaaaagaggaatttgacagactatgtaagtattagaggtctagatgtaggacagaatttaatattaaaatactaaccttggtttatgtcttaagtacataatttttaatcattttgaagttgtaaactcttttctttttttgagactgagtcttgctctgtcgccaggctatagtgcagtggcgcgatcttggctcactgcaggctccacctcccgggttcaaacgccattctcctgcccgccactacgctcggctaatttttttgtattttttagtagagacggggtttcaccgtgttagccaggatggtctcgatctcctgacgttgtgatccgcccgcctctgcctcccagagtgctgggattacaggcgtgagccaccgcgcctggcctgaagttttaaactcttaaaatttgaagatgtcccaaaagaaaattatttctttttacattaaagtgataaaagtaatttttttt

SEQ ID NO: 59469 - DNA, 1007 bp, Homo sapiens
tctgttgtatgagcataccataatttgtttatctacaattaatgggcatttgtgttgtttccactttatggctattaataatggtgctgtgaaccttcatgtgaaatttttgtttgggcgtgtatttttgtttctttttggtatatacctaggtgtggaattggagggtcgtgtggtaagtctatgtttagcatactgagaaaccgccaaactgctttgcagagtggctgttccattttacattcccaccagcagtgtatgagagttccagttttaacacgtccttaccatgcttgttattgtcttttgattatagcccttcttatgggtcatactgatttttttagccttaaaatttttaaattctaaaccagaacttgcctatgatctcacaccctctttctttccatttctttcctttctgtaatgcatggtttaggaagaacagttagaagctatattgtcagcagcaattcagactagttccctgggacttttgactggttatatccgaagatggataacagaaggtaagattctgataacaagtaaaatgtttggtatttttaaagttatcaacttgctatttgttatatttttttcttagttattttaattttgatataattgaagatccacatgcagttgttaagatgcaatagagagatcccaccccctttagcacgtttgcccacagtatgatgatctgacaaacctttagtacagtcagcaccaccaggatccctcatgctgccgttacagccatacctaccttctttctgccccatccttaacccctggcaagaattttgtcattttaaacatgttcataaatggaattatgcagtatgtaacctttttggattaccttttttactcagcaaaattctctaggaattcatccaaattgttgtgtgtatcactgttactcttcacacacatacacacacacaccccaaacgcatattgtctgttcagaaccatttgagaatagttttttttctgaa

SEQ ID NO: 59470 - DNA, 1063 bp, Homo sapiens
gcctcccgaagtgttgggattatgagcgtgagccaccgtgcctggcctgaaaaatgcttttctagggaagtatgatgtggcagaccttttcattgataatcgtccagatgtggatgaatgctgtatttatacttaatatcaaatctctttcacattagataaagaggagtagactgcaggagttttcctgtgtgtgtgtgtgtgtgtgtgtgtgtgtgtgtgtgtgtgtgttttgtcaagatgtcaccaaatctgtcagctttagagaagacagcagggttatacagttcataaaaatatataagctaccttttgctaatagtagtattcacaactagcaagcattggttaagcttaagaacctataaactctgtttcttgcaggaaatatagtctttcataatttccacttgctatctttaaattttacttaaattttaagtgtaattaattaatcttaaatttgattattcaaattgagcattgattgatgccttactaatttatctgttacagactttgacttttttaaagaaatcaggtccatcactcaatgaactcattcctgatggttataatcgatgtcttgtagctggccttctttccccaagatttgttgatgttcagccttccagtttaagccaagtgagatgatttttaactctattgtttcttttggttggatcacgttattagctttctattacagtaaaaatgtattagataatttctgcaaaaataggtgaagtagtgtaatgctgactctgggtgatcagcagttgtggtcttaggtttggtttaaaattcctattcctaatacccaataggccataacttggcagcaggttgacttagctgtatagaaggatacaggacaggaaacacctcatggctgcctcaggctggaatgcagtggcatggtcatggctcactgtagcctcaacctcttgggcttaagcgatcttcccaccccagcccccgcaagtagctaggactacagacaggcacaactatgcttagccctttttttttttggtagagacagggtctcgctatgttgcct

SEQ ID NO: 59471 - DNA, 4111 bp, Homo sapiens
ggtatagtattgctggtctgagatatatgcatatataattttgatggttattccagtttacataccaaccagtagtgcatgagggcttctgtgttaaataactttagaagacttgttggtaattatttttgagagactaaatctcactttttatttgttttaaagtatgtaaaattttagagcctttttccatgattggttctcttcagtctaaattgttttctttgtattgtgtgaacaatctttaaatttggagaatatttaattttagagtgactttttgcctagaatcagattaatatttgcgtgtattttatgttacaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaaggttagttaaagtacttgaaatatgtcatgtgaaggctggatttaaaatttatgacaggtgttattttctagatttcatactcctggcagttcagaaaattggaatagtaattaacggaatttattcagttctatatgagatactagatatttcttgctctccagattgctatgtataactaaacaataaaatagattagggtaatgaaggacccttttattttaatctagttctcaaaacaggcgatccctagtctgaactagtgtgagtagtctttgaatgaagtttacccgtgtattttttgagccatgtatggcatacatgccttggttgtcttgaatgttttctctgtcttctttagtgtcatcgctttttcctggcagttttttttgcatcggttttttaagccaagattatcgtaatccagccctatcactagtgatgacctttgacaaattgcttaacatttcagagctctgtttctccatctgtaagtgggatcctagttagaccttttgcaaagggtagttgtgaggattaaatcacacagcgaacttacccatcccagaaatgccctttttgctagggcctgtatctgtatttctgatccaggtttcagatccagttaaatatgtgaaaagcacatgttgtcatgagctcacgtctttttaaagtttttatttgtttatttatttagagacaggggtctcactctgatgcccaggccagtccaggccagagtgtggtggcatgatcttggctggttgcagccttgaccttctgggctcaaccaattctcccatctcggtctcccaagtaactgggactgccggcacacaccaccacacctggctaatttttgtattttttgtagtgacagggtgttttgtttttttttgttttgtttttttgagatggagtctcgctctgtccagtgcagttgcacgatctcagctcactgcaagctccgcctccggggttcatgccattctcctgcttcagccccctaagtagctggggctacaagcacccgccaccatgcccagctaattttttgtatatttagtagagacagggtttcaccgtgttagccatctcctgacctcatgatccacccgcctcggcctccccaagtgctgggattacaggcgtgagccaccgcacctggcctgtttttgtttttttagagacagggtctcactgtcgcccaggctggagtgcacttgcacgatctcgtctcactgcaacctctgcttcccaggttcaagcgatcctcccacctcagcctcctgagtagctgggactacaggtgcatgccacaatgcccggctaatttttgtatttttttgtagagatgaggtttttgctgtgttgcctgggctggtctcgaatttctgggctcaattgatctgcccacctggccttccaaagtgctgggattacaagtgtgagccactgcacctggccatgctctctcttattccccattcttcctatttccttatagtagtgtttcagatttttactttcttcttctcctgttgatgtctcttactctattcctgtctttccattccacaggcaccatccaagcacttttctttttctctctttaccttataactggataagtccttctcagctaaggttcatcataataaagccttaatgcccaaaagcatccgttttaggtagtgaattaacttctctagtactagctccgtaccgtccttgcgagagagactgttcattcaaatcattttgtactttctgcctctaatacctcaacgttgctcaagtattaactgaaaacaagcaaggatataacttctgatgagtgactactttttaataaggccttaaaattgagaaacagtcaaaatgcaagtgaatgaatctggtcttacatacaaatgatagaaatgcgttttgatgaatcaagtgaaatatgaattaaaccgcttaatttatgagaaaatcttgctataattctgttgaggtgattttactttgagattctttattctgtttttaaaaattatctttttcttccagctctatcgcctgacactagtgtttcagtctttacctggcaggtgaatatatatggacagggaaagccttctgtatatttggggctttttgatataaatcgttggtatcatgcacaaatgccagattcgttaaggtatgattctttttttttctctctcctttctctttgtatttgtatgtgtagctgaccaatgacttagtaatgttttaaattttcttttaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttggtatgtatttccttaacattacctcttaagaaaagtaatgcacaaaagtatgtaaatgtatacgttgtgtagtttattcatttagtgttatctgtttgtatctcactgttagttaacatatggataacttaggaaattaatatatacacacaagaaacttagtatttatatgttttataaaggaattatgacttggagatatttagtatttatatgttttataaaggaattatgacttattttgaacttgctaggaaagatattaactgtttcacatctggtgcattttatagtagcttttattttttttgctgtgtttctcagctgtgcttggagttttttgggttttgttttttgcttttttcttgttttgctgtgtaataggtttgttatctattcttaggatgaaaatacctagaaaagtttatttaaagatttattacatgtaataatttgacaccttgccttgcagtctgttattggataaattttgttctattaatgccattttaaatatatgtaagtggattattttttaaatcttttttttagatgccacttgtttgttaaactcgggagttgttcatttaacttgtactggctttcagaaggaggtaggtaacaactagtgatttcttaattgaactgaagtcagatcttagaatatagttgatttatggatttaagttttacttagtgatattgacagttgtttcagcttaaatggtagcttctgctaggtttatgagattatcaactagtagtatcagttactaatgacagcctgccggaagacgtattgtatgtttttagcaactaatttatgtagatgctagctacgtgaacctcaagctttctgtctcctcagaaagcttatgaggaaatgaagtaatgcaaagaaggcacctagcacagtggtatagtgcctggcacaggaaaaaaaaaaagaattttgaaaaatacttttctctttttgagacggagtttcgctcttgttgcgcaggctggggtgcagtgacaccatctcggctcattgcaacctctgccacccaggttcaagtgattcttctgcctccgccacctgaatagctaggattacaggtgctcaccaccacgcccggctaatattttgtatttttagtagagatggggtttcaccatgttggccaggctggt

SEQ ID NO: 59472 - DNA, 1108 bp, Homo sapiens
agtgaatagtgtggtatgaggaatattaggaaggtgtggtgtgttagaagccaagtaaaagaaataagaactagtaataggaattattaaaagggatcaactagtagtaaaattcagattcagatgatgtggctctggaatctatgctcttaacacttactgcatgcttcgtgcttgagttcactacagggttgatttagtatcttcactttgtgtcttgataggcctctcatggtcgagggcaacatccatattttaaaaaaattttttccccacccttcccccaactgcccgttctccttcccatactccccattgtcctttgaacctctacattttaagtaaaaatagcaagatggaggaagagaccaggatgaaggcataaaggatattttgtttattaaggaaggttctgtgaggttactatgggataattctgtttacatcctggccacaactttaccacagggtactgcacttagctgcaaaggaagctgggagatgttatagaactttaggcaaccatgtgtttaagtagagtataaccattgaggaaggaatatttgagaaagaatattgagtaatcagtctttgctacataagatatctcctacagtatgcaaacagcatcgatttagttgattagaatcaataataaatatcaattattatttcaaaggactacatttttataaaaattaccgaaaactaaatttttcacagtgattttagttttgtcacatgcactcaacattgcaagcaaactaaacttacttggacagtaagagatgtttaatgtattaatatatttagcgtgtcttcgttaatttctgtttcagtgaaggggatgttttgagtttgcatctgctgcagctggcctttggtaatagaaagtgtttggcatcaggacaaatcttatatgaggtaaatggtcattggactatgggtttatattaccattttgttgttttctattttaaatatgttgtctttgttttaagatattgaaaagtgattctttttttttttttttttgagacagagtctcgctctgtcgcccaggctggagtgcagtggtgcaatcttggctcactgcaacctccgccac

SEQ ID NO: 59473 - DNA, 1047 bp, Homo sapiens
tctcgtggcagtatctcgtctctttgtagggcatcttttatggttgagcagtatgtaggagtgtacatcaaatatgactcttaggaccagtttacacagacatgaatgcatccacttgagtaattctaacactccccagttctacctcttgggcattgaatatgactcttaggaccagttacacgcacacataaatgcatccgcttgactgcatctgagtcttcccagttctgtctctgggggatgggtgccatgaccatagtcttgatgtcttgtgccgtgtgtatttttgcagataagatgacttggccatggcccacagatcacttattctggggaagtgtaggaacagtggttgcctaacccaagttcttacatgatgtacctttttcctttctaaaaaataacttaaaaatatgaaatatactaatttgtttcagatattacatacaattggaaagtggacaagttcctgtatatgctgtcacttttcaagaacctgagaatgatcctcggaattgctgttacttgtgggctgttcagtctacacaagataggtaggtctcatacaaactttgttttgttttgttttgtttttttggagacagagtctcgctctgttgtccaggctggagtgcagtggcgtgatttcggctcactgcaacctccgcctcccggattcatgccattctctcgctcagcctcccgagtagctgggactacaggtgcctgtcaccatgcctggctaatttttatattttcagtagagacggggtttcaccatgttggccaggctggtcttgaactcctgacctcatgatctgcccgcctcagcctcccaaagtgctgggattacaggtgtgagtcaccacgactggcctgatacatacaatctttaaaaattagtcaaaaatagaacaggtagtctatgtagttatgtagtcttttttagtgaaggcaacacaattctttcagtgaattagtgagtagtagttgaaattattttaaaagttaaatggttgtttctacatgcttgaataattctga

SEQ ID NO: 59474 - DNA, 1026 bp, Homo sapiens
aaaatgagaacaatttaggtttgcgttttatgcgtaatgattttatggcttgaataactagactgactttctaagcctcaggttatttcatctttaaagagaagtactcacacatagtctactatcaaagcattgtcatgaacattgaatgagccaggtaacacaatgcctggcgtatcagtaagctctcagtcaacatcaattgttagtccaactgcgtgatttttctatgtattgagtaatggtgtaattcctagtatagctgaagatttcattattcagatcacaagtatcaaatgcaaatttactctatagtcttaaatctattataactgataacctgctttaacttaaatttattgtgttaattatattttcttactttgcagaagaaaagcaaatcacgtattatgttttctaggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcaggtaatcagttctttacttgaaaccaaaaatggagcacctggatattctgatgcaatattttttaaagtagccaaatttttttatagcagctggagtaaaataaaagatatcttcctatctataaaaaaaaaaaaggtattttaaaatcttttttattgtctggacctgagcacagtggatacttcttgcataagatactgttttgttgatcaggtgttcatatgttctcaagtaggccttgagaaaggtagtgataattgattttatttgttttcatttacatacctgaataagatctattcttaagtaaatgctggaataagggctaaatataagaaatcttgagccttatcagccaatatgaaattacccagcaatgtaggatctaacatagtgttcttggcatattgtttatgtttgtgtg

SEQ ID NO: 59475 - DNA, 1212 bp, Homo sapiens
ggtttagctgccttatctctacattgaggtgtgataaggaataaatgagataacattcaagcacataccatggtggtggcttttactgaatgactattattattattatttgagatgaagtcttgctctgtcacgcaggctggagtgcagtggcatgatctcggcttactccaagctccacctcccaggttcacgccactgaatgactattattattgtaatgatagttgcttgattaaaagatttcaatgtggagataatatgtaaagttttatgtaatgaacatatagttgtatgtaaatgagctaaccgttattgcatgttttgtgtatatacaatattaaaataggcaatttttttttcttctagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaggtactgtttaagatacctggacatttctctttcaaaactgaacccctgctggttatataggtgtgttactttttgaaatttcactgacccgcaacatttacaatttgtatacttttatgtaaatgtgttactcttaggtaaagtgtttagaataaaaatgaggttaaagatgatatgttattcaaggaacttaacatttaaaatgtaactttcttattggttaaaacgttccagagtaaaaatagcaatgacatgtaatgttctgatactctttttttgtgaaaagtatcatctaaatcttgttcttatctccagttgtgttctatgaggacactcgaagtttataaaaatgtattcattactattcaatttttaaaatgtttttaccttttaaatttgcgacaatagtcttggattggagcattatggaaaatatatgttagattcccaggatgaataaattgaacttggtctgtgcttttagagagcttatagtctagtgggagaagacaaatgaataagactagcataaatatagtgaatactttaataaatttaagcacttggaacatgtagaatgggtaa

SEQ ID NO: 59476 - DNA, 1112 bp, Homo sapiens
accctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaa

SEQ ID NO: 59477 - DNA, 1034 bp, Homo sapiens
ggcacataacttgtttcatttcacaggttcacagctggagagaattttgtgtcaggtagaattgtgccttgagtttcaaccgtaactgatttagatgatatttaaatgagatgttggactccggacttttgagttgatgctggaatgaattaagactttgagggttattgggatagaatgaatttgtttggcatgtgaaaaggatatgaatttgggggaaccaggggcagaatgctatggtttcagtgtttatatctccccaaaatttgtgttgaaattgtaatccccaagatgatggtattaggaagtggagacttttggggagatgatctggtaacaagggcaaagtcctcatgagtgggattagtccctcctaaaagaggccccagagaactcccttgccctctccatcatgtaaggacacagaagacacctgtcttttgaccaagaagtgggccctcaccaggcacccagcctgctggcaccttgatcttggacgtccagcctccagaactgtgaggaacagatttctgttgtatagaaactgcccgtcctacagcgttgtgttgtcacagcctcagtggactaagactgagacacctagctcgtcccggactgaggcatccctgttctcctgtgctttcagagtcgggtttctccattcaaggacatgattttatgcttctctgaagaggattggtcccttctagatcctgcccagactggcttctatggagagttcatcattggggaggattacggggtctcaatgcctccaagtaagacttaacttccccccacacctcaagaccagggaactgggcaggggagttctcacttggagtaagagtcaacttcgtcccataggatcagggaagcggggcctgcatcagatctctctgttcacccccaacctggacaggaggtcatttgcacacagcggccctacaggcagtgtgtccgattgaccatcacctgctgtctcgccacatcaggcttatcagaaccaaatagaacatgtgctgtatgtccat

SEQ ID NO: 59478 - DNA, 1047 bp, Homo sapiens
cccagggcttctccaaagggctggtctctgagggcattgacagtttccttgtcactgtcccccagaaatgaccacaggagaccagaacactgaagccagtgatttctgtttggaaatagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtgggtgagtagaagaggtggggctgggacgggtagagatctggtacttagacactttggctgggccatgcatgtgctggctggggaatgaggagttccatcgagagccatttactttggttaggtccagactagagtttcctaagaaagccagttttactccctgaaggctctaatttgggcatgatagtgtcgtgcccctttacagcccagtccaaggcctaagttgagcctttgatggtcagctgtggagtggatggtcaccaggcccagggagagatgggacctcttcccctagccctgaaaagctgtctctgggattgcagctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcgggga

SEQ ID NO: 59479 - DNA, 1035 bp, Homo sapiens
tgcgttccttagaccccgtgcggaccctgctgagccctcagcatctgtgagtgagtccctccgcgtcaccttggcctcccgtgtagctagatcagtcttccgaccccttgttctacttgcacagatttctgattaacctcttctgctcctccagagatgagtcagggctccgtatcagctccccaaggcatttgctggcttctgacatttacttggaggactttgggctgcgaaagggcaaagtttgccgttctcatctctttttttggtgcctgcccccgggtcttgacctttctctggagtcttctctcctggttctttacccacctctttggtttctcctgtggttctttgtcaaggtgtcccctagatgtcacactctgaggctcagttgtggctgagtcttgcattgcaagtgtttttgcaggtgtctctgcgaagcgtggatatgggatggtgaaagtggcagtgtgcacagagtgtttgggattagatgggcaggtggaagggcgtctaggtaggacccctttgtcctggtgtgaggtaatgaggttctagagtgtgctgtcaaggtgaaactaaaaggaaaggatagacaggagactttgtgaaagacgaaattatggtagtttggtaacaaatggatgcagggactggtgggtgggtgtagaagaaggcagaaaatcttgccaaggacattgcaagtcctgaatcagaccaggaaaattaaggttcaattaacagaaataagtccagagggggagctaattttggaggaagtgtggtgataaatttgcttttctatgtggtccagctggtggagagacatcaagaagcacttagagaaatacaggaaatagagaggtgggtgacctaagtcctacttcctatcctgtctatgtatatataacaaaggccaaatgaattcatgtgttgaggtctgctttcctatttctaatagcaatggcataaaatgaattctagccaattctaaagtcactagtagatagtaatattcacgaagtagccacaaat

SEQ ID NO: 59480 - DNA, 1406 bp, Homo sapiens
ctctccccttacacacacgcccccaacttttgaggagtcttgagaatctccttaacgtccttgacagttgatcaatgaaagacatgtagggagatccagattgcaatgaatattgtattatttgcttaagaatttgaagagttattgcttcgtagtaaatgaagatgagcatattgaggtttataagggaggctgaggttcacttggccagagattcagatgttcactttattttataatcatcctttttaaaaaacaaaatagactgacatgggcaactttctcaagatttcatatggcacattgcatgtagggataaacagtaccaacattatttgcttggagtgctttaggatcgaggaatggggaagcctaagcaaaacccccaaatcttggcaagctcaggaggagggagcagatagcactgctggggtgatctgtgctgcttgaatgctcttttggagaatcacttccctgtagataggccacagattacagtttaccaaaagcattgactgtcagacccacatagctggtttccattaacatggttttgctctaggtctttttcaagtcctctttttttgtttgtttgttttttcttttttctttttttttgagacggagtttcgctcttgttgctcaggctggagtgcaatggcgtgatctcggctcactgcaacctctgccttcagggttcaagcgattctcctgcctcagcctcccgagtacctgggattacaggcgcctgccagcacgcctggctaattttgtatttttagtagagatgggatttcaccacgttggccaggctggtcttgaactcctgaccacaggtcatccacctgcctcggcctcccaaagtgctgggattacaggcatgaaccaccatgcccggcctcaagtcctcttttaaacgtggaaacttcttcctgcattacacagttcttttctcaccctcttcctgcctcccttcctttcactataccttagctatactgaattggacatataattcttagctcatgcatggctttcttttaataattagctaaacaatagcatggtcatatatgatgatatcacccaaccagagaataacaacattgtccgtatttacctctgtacattttctctgcagcctgtatgcctgtctctcttacctctttgtgctgattgttctgttgccttttttgtagttttcatagtttcgtcagtgtgcatgtatttatacatttatgtatgtatgtatatgtgttgtttgtgtatatatgttcacatgtatgtgtagcctaaatatagcacctaaacaatattctatttacttttagtcatttatgaacttcataagaagcttattattctgtatagagcaacttggagctagcttatttcactcagtagta

SEQ ID NO: 59481 - DNA, 1652 bp, Homo sapiens
acaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaacagttaac

SEQ ID NO: 59482 - DNA, 1050 bp, Homo sapiens
gtttgggacaggtgggatatgcaagcctaaataggtggtagatgattccaggtgccagggtctgtccttgggccttgagcttcaatcctaattcccatcgctgactccaaggttctgcttggctgctgcccactgccttcaattcatacataaggacccagctctccattccatgtgtctcctttgagaaagaaccagcctagaggctgaggtggggtggtgcacttccatcaggagttcattggtttgagtgggattggcgggcaggggctggggtggacaataatgaagtcttttagctgggttcgtatcttacttggttgtcatgacccatcaggtaagggaggtccagacgggctccatgatttggataacaactaattagaacctgagcctcctgacctccaatacggtgcactctggtgagggacagtgggtggggtgggccaaggaggggccacagggtgggggcagatgctggagtgtccctcatatgcctgcagacacccgggactacatctgtgagttctgcgcccggtctttccgcactagcagcaaccttgtcatccacagacgtatccacactggagaaaaacccctgcagtgagtgctggggtggggtctgagggccaggggctagaagggaggaggtggagtctggaagctaggcatataggacacctaggcagtggggagcaggaggaaccccctagggaagtcatgatggcctgaggccttgttccttccctcttctgtccctgactccaggtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggc

SEQ ID NO: 59483 - DNA, 1526 bp, Homo sapiens
caaggggtccaatccctacagtcaaccagagcacttggcacagcaggtaccaaggctggggagggccacagacactgggatggtgaggtgagggtagacagacaggggagaatgccgcccacagaagatgacagagaggaatcaagtgaaaagggaaaatgacccgggatgacagggaagctctaggctgagaagagcattcggcagggcatgtcagacattctggagtctgctgtggagaagatcaaagcagcccctggaagtttaactgtggaaaaatgggattctaaagaaggggacagcccatgcaatttagtgagccaggatgccaacttaggtcagtgaaaagagaaatactttgatatttaggagttaaggttgaagagcctgttacccttaatagtgttctaggttgagagtgtgtgtgtgtgtgtttccaaagcagatttagaagaaaatcatatatatacccatggtgaactattaaaaagcaagcagttggggagatactgttgtacgtgaatactgacatcaagtaggatgatcatacttacccaaactgctttcccctctgcagcagatagtgcattcatgattaggtgaaccaggggtgtcacccagagtgatactttgtacagggaacattgcaggacattgcagggtgagagtgtgacaaggaggtgagataatggaagtaaagcacagaattgggtgacaggagagttgagtggtcaggatgggatgggtgtggtactcatggtgtaggtgaggactgagcctcaaggaaacgagcaggccatgacagggagaactgctggggcacaggggccaggaaggggacagaggagcatgcctgccgggtcagctcagttcatctctccgtggaaggtggctatccttttgcctcttctctccctaccacccacttccttctctagcaccacaaaaagtaccagcacatccaccagaagtctttctcctgcccagagccagcctgtgggaagtctttcaactttaagaaacacctgaaggagcacatgaagctgcacagtggtgagtggtggaactccaccttcctctgtgggaccttttaccttcctttgtgggtcccgtcaccctgggctctgtgggtttcttcacctccccctctacggggtcctgtcacctcccgctctgtgggtttcttcacctccctccgagggatgactctccctcatcctgtatgccctgtgtgttgagcacctgcttgttttaaactgttttgggtactgggtacagcaatgaacagagcaggcagcgctaaccctcttgagacatccactttagtgatacagggctatgaagaaatgtggaagcaagggaaaggaggagagcataaggaggagttgctattgtagaaagagaagatgctttgagcaaagacttaagtgaggaatggaaacctgtaccttacagactatggacagcgcgtgtggaagggcccttaggtggtatctgggtgacatgttccaggaatagggaagagg

SEQ ID NO: 59484 - DNA, 1318 bp, Homo sapiens
ttgactgtatagttttgtgaactatgtgaatatcatctctgaaacagaacaactcctcctactcagatagcctctgctccctcctcctccttcttaaaagtctctgcctgggtgcagtggttcacacctataatcctagcactctgggaggctgaggcaagaggattgcttgagcccaggggtttgagaccagcctgggcaacatagtgagaccccgtctctatttaaaaaaaaaagaggagtctcccatcacttcagaccttagaactttatgtgtcctcatcccttgagtccagagttccttctcttttgactttgcctgtcccacagatttggaatctgagcatgatgagaggactcaagaggccaggttgcccaggtgaggatgtggataggagagaaaaggcggaattgcataggtgggaggatgagggagcaggacctcaggcttgccttctttgggcctgcaggagggtgggacccccaccagagaccttcccacctccaggagaggaagagggtgaggaagaagaggacaatgatgaggatgaagaggagatgctcagtgatgccagcttatggacctacagctcctccccagatgagcaagttggggttgagggagaatgagcagagcaagagagggaggcagctggcctggcagttcatggctttgcagactagagggaagggcttgttagtgtggagggaagggtgggttttggggaaggcaaaaagaactagaggctttgaactgagggggtgaaaaggggtgaagtcaggtgcagggagattgagggctgaaagcagatatgaatggggagcctagggtgggggtagggttgtttcaagtttgagatcttttcagtttaggggctagggtcgggcaggggatggctgactgcccagaaagttaatgccatcttcctctttgttctcctttcagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaatt

SEQ ID NO: 59485 - DNA, 1061 bp, Homo sapiens
agcccttggtcctcctcacttaggtgttctgcatcccacagtaagctgagtcatatggaggcaagaacattcttaaaaataatttaatctgtttgtccaaaagcagaaagtaaatgtttacttgttttcctgtaaactgagaaatatagtaattttagcttagtaattatggtgtgcacaacgttttcagatttttgaggttgattttaattaatggttggatgttatcagggagatagtgttggttgtactttgaaagttgaaaagttagagtgctttctggtaggcagggtcatctttgtagtttttctgaatgtctttttacaagcaggagaaaaaatatgaatgtctgtagaggcatttaatttgccttgtctttgactaactggcacaggttacattatagttgttatttttggttgactcatctttataagatgaccaggctagagaatcagagatcagaggatatgggatgtgattatgacagaatcaaaatatttgtcttgcttgactctgttacttaaaggatttctgtatttcacatggtgcttttcccccatagagattgctcatatgaaaaccaactcttccttttacagtctctaaattggacaatttatttttgcaattaccatttgtgaggtgtttaaataaatgtacatgtacgagcttccagcttcacaaaaagaaatcaattaaaatgttaaaatttagttctttcattcatactgaataccattctgttggcgtttttttttttttttttgagatggagtcttgctctgtcgctcaggctggagtgcagtggtgtgatctcggcttactgcaacccctgcctcccaggcttaagcgattctcatgcctcagcctcccgggtagctcgtactacaggcatgtgccaccacacctggataattttttgtatttttagtagggggccggggtgggggtggtttgccatgttggccaggtctcagactcctggcctcaaatgatccacctgccttggcctcccaaagtgctgagattacagatgtgagccaccgcacccggccctg

SEQ ID NO: 59486 - DNA, 1054 bp, Homo sapiens
ctggcctatcattactttgatgaatgatattattattcatctattttaattcatttgaataatacaaataactaaaatacacagtgtgagagttcttattttaaccattggttttatgttaatatttttctgtttttcatatctggcactctgtccataactgcttcaggttgcattttctatatttccttgaagcagatagactttctgaataaaggaaaactggtgttttctcttcattagatcttcattaaaccctcaccaacatttctactaggaattcagcatatgtgagtttatttctaccaatatctcttacatactttcagttacttgcagtgccattatcaagttttcaaaacaaatgtaaatctgctttgatacagtgatttgtgcagatgttagtgacctggaggttgttcatcaggttttcagtgttttgtcttctcttagtctccacttttgaaatgtttagtagctacaattttataacataaatgaggaccataataataatatatcatgtattgtctgtctactgtatatcagccactgtgcaaagttacttacacgtacactgtccaacttaaacttacacatggtccttttttttttttttttttttttttggagatagggtcttgctctgttgcccaggctggagtgcagtggtgccatcttggctcactacaacctccacctcctgggttcaagtgattctcatgccttagcctgccaagtagctgggactacaggcaggagccaccacgcctggctaatttttgtatttttagtagagttggggttttgccatgttggccaggctcttctcaaacgtgtaggtgatctgcccatcttggcctcccaaagtgcagggattacaggcatgagccaccgtgcctggccacacattgtcatcttaaaagcatagcagtcagtcttccttttaattatggaaagttcaccttgtagcacactcttataattgcatcctatcccagacacacacacacacacatacacacgcagaaacagaagagaagtgggtgagata

SEQ ID NO: 59487 - DNA, 1053 bp, Homo sapiens
acataaaagtttgagagtctctgggataagaggtcaatgatagaaatgaagataatgtgagggagataagaacccaaatcaaaatacccaatacaatagtccttttgaataatcatggcttagctgtggttttaaaaacatatgcagaaatgatttattgcttaaggaaagatttgtgtgtgggcacctgctgttactgtttttccattagaaaatccatagagttatttagtttgtatcatggaaatgctatacaagttttagtatcaaaattatttgcaaatgcaaagaaatctgtaaaataaaaaatatttttagtgtttgtgttatccattattaggtcttaggagagaaatttggcaaattattagacataaatatttaactcaattcaaaaaataacctaattagatatttaatctttcattgcatatatatttttcctgttcagcagtaatttcctgatttttatctcaggtttcttttaaagagaatttagcacattggaaaatattttcataattaaagtgctgggtaaattcttttaaaatgtgttcaatcagatagaagtagaaatacccttacgtgcacatacttaagctattcacactattaggtaattgtgaagttacagttgcattgagtatgtggcacatttcatttaatgttggtaacatctgcaaatgtccagagtgtttgcttcataaatgtctaaaagtttgcccacttttatgtaaaactaaagaagtagaaatgacaaaagtaatagaatactactgtatcagagttttaaaggaatcatatggactcttcgatctgtttgtttttcagagatgagagggatatgtttacagaccacattagcttacacattaattggaaaatgtgtttcgctgaaatacacacagtattttcatttttctgtaaacttaatatttaggtatagtaggtaaactagttttacatcagtgtgtttatagttcaagttacttcataatttgtttcataagatcacactaaaatattgtctattttcatataaggagaatatat

SEQ ID NO: 59488 - DNA, 1003 bp, Homo sapiens
ggatttcaggtgattattggtattcctccaggctgggggtaatatttccatgtacaggtggttctacaggtttggcagtctacaggagtagattagagtctttaaactgagtgtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcttaacttcctttgctctgggaagaagtcctaacttcctttgctcagggaagaagtccttgaggtgtaagactcactgtggctccaacccctaccgtccaatatttgcattcactccttagtaattttattactcacactagtgttttgaggcttcacaggtatcccagtacctaggcagtgcctgataatttccacaggtttattttctctttaacatagtgttcataattcttcactgattccacaaaggccaagatgcatggcaggtggaattttagggagtgaccaggtaagcctccctgggcttggtgctgactgttgacagggtgctcaccagggccccatcagggctcttcgtttgctcttctcacgggacagcacagcctcatccaccattgattttccactgctgtcagtgtccttactgtcttccgggttagaccttaggtgataacatacaacgtctgtgtttttaaagtgtgctaagtcaaattttcttaaatatacataattttgtcagttttaaattaccagatacattcaagaattatattaattgctgctgagttagaattgcattttaaagagaatagttttatgaaatttgaacttgaagaatagagtaggaaatgttagatggttaccctaaacattgtaaataatagggagggaagaggatccgatgtctgac

SEQ ID NO: 59489 - DNA, 1030 bp, Homo sapiens
tctccaccccaaatcaacagaatatgcattcttctcagcaccacgttgcacttattccaaaattgaccacatagttggaagtaaagcactcctcagcaaatgtaaaagaacagaaattataacaaactgtctctcagaccacagtgcaatcaaactagaactcaggattaagaactcactcaaaaccgctcaactacatggaaactgaacaacctgctcctgaatgactactgggtacatagcgaaatgaaggcagaagtaaattcattcctttattaagcaagatgtgtaacttttggtgtaagctgtttgtattggaacagattgaaaattcctattgtctctctgcccttgaatacctttagccgtggtactgatgtactgatatgttctctaggtaattcacattccaccagttttgaagtacagaattgttatttgctatttttatcagatatgaagtctactgttatacaacctacaaattatgacaaatctctcaaaaaatttgagaaatgaaacattctcgttaaatttagcatggactagtgtgattcctatataattgaataaccaattaaaatgaatattaataaaaatgttaacatatcatctgtttcttcaatttttaagttcctagtagacagtgattgtgtcattgtaattaacttgttaggaaatattatagcagatgacaggatcacagtaatccctgatctaccatgctggtaattactcaaagttggctgtctcaaactagaaatataacgaagagtttccttttcttttttaaatttacctcttttattggcatacattctatttatatcagtaacatctacagaatgtttattgtatgttatagaaatggcaattcaaagcatttaaaaagcaaagattacatactttattatatttgagtctcattattcatcatagttatgcagtgaattgatgaatgctgacctgttgtcctaggggaaatagagtttggtccctgtgagcctctggtcacaacacttttataaac

SEQ ID NO: 59490 - DNA, 1066 bp, Homo sapiens
ttttataaactgttttgtcaaattgaaaagtcctgaaatatccttttgctttactagtataactaaaaaagtaattaaaaaattttttaaaaggtgaatagagagttcataatgacctgttttgctatcaggaaccttgatcaatgtgttacatagcagtatttcccattcttaatctaatgtactttgatccaaacaaacaaaaagctaccaggagatccattctaagggctctgtattgccagttatccatgttctatgcctgccacatatggaaagcatacagcagattgattatcttgggggctcttggggcagtattattgatctttacttttcttaatacctggtagttaaccatttattattatagactagattaatttctcctcctatttttaaagttttttttaatgtggcaaatacacataacatataatttattatctttatcatttttaggagtacagtttagtgtatttaaatgcatttataatgtgcaattctcaccatcatccatctctgtgattctttttattttgtaaaacttaaactctatacccattaaacagtaactcttgataccccctggcaaccaacaactaattttttaacatctcaggtttggctggggagagtgttgaatcagtaagtatttatttagcatctactttatggtaaaagttattaggggcatgaagaaggtttaaaatatgggatgctttaaaaaactgacaatactgctgggcagacaatactacatatgcaataattgtataggaatcaatgataacatggaatttattataattataccttgtatatatgtagcttatacatgcaagttataatgaaaattgtggggcaccaataaaagaccaaacacattaaaaaaaactaatgctagtattgataagaatttaatatataatgccaggcatggtggtatgtgtacctgtggtccctcgggaggctgaggtaggaggattacctgagcccaggagaatggagtccagcctgggcaacatagtaagactctgtctcttaaaagaaaatttaacatatg

SEQ ID NO: 59491 - DNA, 2011 bp, Homo sapiens
ttcaggtagttctcaaaatctttgatttttaacttcacacctgtttttctgagatgtagcattgcttcattctttaatcttgattttaatcatttctgggaatctgtgacatcacttttagagtttctgctacttagtccccactacattcttctggttatgttatataaatagttacatttactatttattatggtattattttaaaatgttagctttgctgttaaatttaacattttacattttacagctttgctgtattttttatagttctgagcaaattattcatattcttacatatcatgaattgtgaaaaaaaatttacaagttgacttgttacctatacctatatgtattattcttcagtgtttgctctagaaattataatatgcatccttaatttacaatagcctcccttgaattaatatactactacttgcgtaaaatataggaaatttataataatatatttctgcttactcccacttcccttcctttgtgctttggttgttatatattttatttctacgtgtgttataagcctaatgacatctatcaattatttttatctttgctttaaactgccaattatcttttaaagaaattaagaaagggaaaaattggcttttacattttcctacatatttaccattttgcagagttcctcatctctttctgctgaaattttacctcagcgagaagtagtgtctcccttgtctgaatttttatagcacatattgtggaccatttatatgtcatatatgaccttacagttagttccatgtatatgtcaaatttcctctgccagttttagattattttcttggcaagggtcgccgtttatacagttttaactacttcattgtgtctagcacagtgccttagataaagtggacacctgtatatatttttaactatgtaagaatgagtgaaactttgttcatttatctgagtatttatataatctcacaggattgagttgtattattacagttcaccattagatgtcactttctgacatatgttaaatccttaccaatgaattccttccattaaggcatattggattctgaaagttggtgctccaacacaagtgcacttaaacagataaatttttgtacatttaaaagtgattactgtctaaaatggaagtgttcctaagttataatttttatattttcattatgtataaatttatacagaactaactgattttcctaaagttttctttagaacttgaatactggtattgtttttgaattatttgctctgtggagcagcttggaactattagaagtaatagtgtgagaatattcaggaatacctttaaacatgttcaaaatgtattctgatggtggtgtaattctgaaagacatcttattttaggagcctgactgacccagttttctcaggttttgatagcaactatatagtttatttgtgtttgcctgagaaaggaggggaactgagtaggctgtgaagaaacacagaggtagagaaaaaggagattcctgtggctgtcttggccagtcatggaacacagcaaagtgcttccctccctcattctctaaacttaaaagataggaaagggcaggtcaaggagatttcagcaatctcagaaggcttaatgttcactgtatatttaagaacctagattttaaactcagcatgataacatgtatgatctagagagatgtttcagtgcgtccccaatgctaggattcatgacaaacgcttaccagattcctacaagcacgtctctccatgctgagttaagagaatcctctctgtgataccactgctctccggacatccagggtttaacctcttttctttccccatcttgccaggagacagcaggaaaattattgggaggtgggaggtgtggtggcagttttcttcaattcatctggaatactaaaatttgagtaaaataacaatgctgtttcctaatagtgtaataaatacccccaaaacttacacctaatccaagaatgttaccattcttcat

SEQ ID NO: 59492 - DNA, 1353 bp, Homo sapiens
taaatgatggatcatttgcagataaagcatatcaaataatgtcgtttgcaattgaggcggttagtgttaatttggtgacttccaactttattgacagcccttggcacaaagctagaatattatttgacagatacttttgatctcacatttaataatttagtcaagagtgttgaggatgacttaaaatattaaaaagtgatctttgctgtaaaactacttctccctttacttacctaccaggtttggtctcacagcctcatttccttgtcatagttaatgccaggacaaaaataatatatgagtttaaaatattaaaaagtgatgtttgctgtaaaactacttctccctttacttacctaccaggtttggtctcacagcctcatttccttgtcacagttaatgccaggacaaaaataatgtatgagtttaggaaccacgttgatacttttggttaaagtccttctaccggtatgttttgctgcttgtgactcaagagcaactgcacgcatgatattatactacttttaaataggcctagggggcatctttgttttttgttttttttttttttgagacagggtctccctttgtcacccagcctggagtacagtggcgcaatcatggttcactacagccttgacctcctggcctcaagcaatcctcctgcctcaccctccgaagtagctgggactacaggcatgcactaccacacccagctaattttctcattttttgtagagacagggtcttgctatgttgcctaggatggtcttgaactcctggcttcaagtgatcctcctgcctcagtgacccaaagtgctggaattgcaggcatgagccaccatgcctacacctttttaaatgaaaaggtagaattctgtgtcttttgctttttctcatttaaggcttttgacacatattaaaacagcataattaatgaaaatatatattttctggcttcttaaagagattaacctattggggataaacaagcttaaatcttaatttacagaggggcaagatagacccttcttttctgtcatcatctgttcctcccacctcaaaatgcccagtctaaaaaaagttttgggttatatttctcttgaaatttagcttagctcacatcttttagataggagataggaatggaattgatggctttattcttcagaactaccaccgtaggcagccatggcaagcaggggcgcccttgcgttgttcttgaggaaaatattaagtgaggctaaattcaaactgagcctgactccccaacccccacaacccttttatatatatatggcatattacagtgagaatttctttttaaagttttaggtctttgtctttttcttg

SEQ ID NO: 59493 - DNA, 1027 bp, Homo sapiens
ctgttctgtgcactgagtagataataataacaacacttcctgggtgctcacattgtgccaggcactcccgtaaggactgtctgcgtattgactcatgtgattcatagaaaaaccgtgtagactgcgtactatcattttgttcattatataggtagaaaatgacacatagagaagctaagcattctgcctgagattatacagctgcgaatgccagggccaggatttgaatcaatcgagctccagagtcttaaccaaatgctatgtgaatgacagagacttagatcaataggctgctgctagaggtggatttttctactagattctgaggacagcctgtataaatttcatgttatggtgaggtattgagttgaccacactcatattcatcatttccgatttttagagaatccagtgtgaaccagttttaaattaataagacatacattcatgtcttacgcaagtttataatggcactgaatttatttattagcaaaatatttttctaatatcattatagttttcacggtacattggcgggagattttctctatgtccatttgtagcttttgtgtttgttagttgaaacgtttcctctacaactagtaatgactcttatgtttgcatgcttctgtcttttcgttattaattagcacattgatagattaccagttaatatcatctgtaaaatagtataagtcatataggaaataataaacagtttggccctgtgtgaaatccctttagccctgtgtattgcctgacatttagcaaagttaagtagcgagaccaagattattttgtttttattttgaaaggcctatagtatgcagcctttctccaggacagcagccccaaacaaggtgaactaattttgcactatgttattttactataattctgctttattttttgtattgtagtttctcttttaccttaggctagcttagttaactcttgctagatttgtttgttaaaaccatactatctttacatggcttctaattttgaatttcatgctagtaggttt

SEQ ID NO: 59494 - DNA, 1070 bp, Homo sapiens
agtccagacaagtatttttactggtaactcttttcgtcattctgttttttgccctctgcagaaagtgaatgaagggaaataccgaagttatgaagagttcaaagctgatgcccaattgcttctccacaataccgtgattttctatggaggttgaatatttttgttttttttgtatgcatttttaaacacaccatttacattccatgttgaacactatcttttataaaacattactttcaaagaattaataccttaatgatctacaagtttagagtataaggttaggaatatctggtgatatagattatagaatggactggccaaaaacaaaatcatagtatactaaatgatgaaaacacaattactctttacagttttatatgtatttgttttagctgagaggtttttaataagcactatgattaattctgatcatttccccactagtaccacatcatccaaaggtaaggtcattctctataccctgagaattagtggttgtattggatggaaaacaaaagctgcctgtgtaattttattttgctatcgttattttaaatggacattttggtttgaaatggtagatgtctacttttgcaaactgaaagaaaaggatagtaactttgagtcttgtatttgcagactattgcttataggtaatatctatttttaattacagcagacagtgagcaagctgacattgcgaggatgctatataaagacacatgtcatgaggtactattcattgcccaatagttatactctttctataactgaaattaatttatttcaggattccactcttatctacattttagttgtgccatttcctttaaatgtcttttattgccgggcgtgggggctcacgcctgtaatcccagcactttgggaggccaagttgggcggatcacgagatcaagagatcgagaccatcctggccaacatggtgaaaccctgtctctactaaaaatacaaaaattagctgggtgtggtggtgtacgcctgtagtcccagctactcgggaggctgaggcaggagaatcgcttgaacgtggaaggtggaggttgcag

SEQ ID NO: 59495 - DNA, 3640 bp, Homo sapiens
tcaaatgaggcaatgaaactcaagatcacgtagaccccattcacttttccattcttcttagtgccttcccctggtacacagtaaacatctgttgaacacaacatttgggatggatacaaatttaagccgagaaagagaccaatgcccaggaaaaagtgttctttccaacagaagcaaatgtagttgtcctgctctagttttagatatgtatcgcacttatgttcacagctaagtacactgtggctaaataatcagtggctctgtgtgttcatctggtttctctaatgagtagaggcatgatacaaatatgacttactggataatatttttagatcttcccattttatatgaatatatgtatgtatcttatgaaaatttttgggcattttcaagtgattctttagtgctaacggcaaatagctagatgggttatattagtttacagtattcagaacaacaaataactttaaaaggacttatgaagaatacagatatgaactaggacaagctaagctgattgaattgtgaacaattgggaggcatttgtgaatccagttctgagaacttttgtcgactgtgaaagacaaaacaaatctcatttattttccgcttggtaacagtttatttattcaagccatgacgaagcctaagtgattgtggttttcgcaattaaaagtaacggcagaacccacaattgcttttgcaccaagctaacagacgagaactgccacaggtcgcactttatggcaggcagggtccactgaagccctcttttaccacccttcctgccatttgggatgtttctaactatacctttatgtgtttttcctagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcaggtgagtgtgtctccggaaggaagtgcctattcattattacttttaaatgcagaaatcttagtgcacactcctcactgtaatgaacagattttgacgttctccttcccttttttacatttgtaaagtgctctgcaaaactaaaccaaaagcagttcaaatgaatacatagatgtaacaatcaatgaccttgaccctgccagtaccaagagagttaagtacaagtgctcctctctgaaggtgcgctggctctttcaagcctacagttaccagaacagtaaattaagtcagtggtaactgagtggatggaaggatgcaaaaggtagaaatgtattcacttctcacctgtgggtccactatgagtgttttcagcagagaagtattttctagtgtctggaataatatattacttttataatgcccacagctaaaggtcactcaagaaccaagagcaaagaaaggacgacgtaatcaaagtgtggagcccaaaaaggaagtaagttgcccacctcgcagtatccaggtggcaaatgaaacaggaaatattttcaaagtattttgtattttcaaagtatttcaaagacagtcactcttggtggatacttgtgaaattcagctgctgtcagtcaaatcatatccatcaagttgaaaccagtcttctgacttccctgtcattatctgttaccctggaatagcgtacatgctccaagtctccatcttaattaagcagccgctgaccaaagcttggctaagtaggaagggcacattgctattaatacatttcctgggagctctgatatttttcctaagtatgattaaaaacaacacatttatccagtatatcagttgtgccaacatttaaaaacttgaaggagactgtggttgagctcagccgttttaagtgatataagccctgcatgttttaaaactgtaaatctgggcacatttcaaacacatattcagtgagaagtggtttaggatttgaggaaatgtgttaatgaatctagtccaatgaagtaattataagttgacaataatttttatattctataaatttctgtgtttagtttattttaaaaacaaaacttatagtattgataagtaaaattataaatgaagcttatgtttataattattgtagctgttaattgcatgttcttttcattcactaattgggggagatttgtttatttttaaattgtggcaaaatatacgtgacatctaccaccctaactacatttttcaacagcagtttattctatggctattatgtatatcactgaatttttatccgaatggggtagttcttgaactggtgaattatgtggcttcgtttggcgtctaaactcttgtctcaccttttaggaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaaggtaatgcttgtcgccactgtgggtgccctgctgcagccggcactcctgtcatggttaggctcctttcactcatgcatcaacccagtagcagcttttacatgtagccatataatgacaccagtatcttttacagcatttcaagtaataatgatactttcctcacctaaattttttacacatgtaatgaaggggaaaaaaggtacctcatgcaagttgtgttaagtttctgttccagtgtagatggtctgtgttaagttgtgtgctgacgcactgtgggttgtcttttcattccagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaaccccagatcccatattactgtgtactgctcaggattattttgttaaattgagattataataccttagtacatatttattacaattaacttatataatttctccatctatgcatatattttatttgggcaaagtggctggccctgacttttacctggtgatttcagatgggtaacatccaaatggtgaaattataaatgtaattatcacaataaatagtttcagatttccctgcacttaacatttatacattagattttgttaaagaaatcagttacttttactttatagtagtgacatctcattggtctcta

SEQ ID NO: 59496 - DNA, 1034 bp, Homo sapiens
cttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaa

SEQ ID NO: 59497 - DNA, 1050 bp, Homo sapiens
tatacacagaattagtagcacagagaagcatgtgtgggatagagtcacagagctggtctgactgtggctgcactgtatcccgtgtgatcttgggcagacgaggcctcagccgatgggtccacggaactcagaccgctgggtgccgacttcgcccctcagttgctcccgatgaacatgcaatcaggcagttgactggatatcgaagctgagccaggaaagatcttctcccaaagcacaagtgtagagggcgcatggcggctttgcagccagcctgtggggtactggcacacgagccgagcacttgccaaggagctccgtggcagaaggaaacaaacgtccctggatccgtgagccccttcctttgcatccctgtctcacttgggggtcgtttttaatctttttttaagaaaagaaggaaacggcttgagcggcattatggggaagcttacgcaggctgtcattactccacagagcgccatgatgccctctacgtggtaggggcactggacgaagccatggagctgcggggcatgcggtaccacccaatcgacattgagacctcggtcatcagagcccataaaagcgttacggaatggtaagtcgtgagcttgcagcttgtacccaaatcaggagcagagtttgtgaagcattgagaatgtggagagcacggcggtggaggagagttttgttaaggtagggaagggggtgcgattcaacatttgactataaatctttatcttttggggttaaagcaacaaaagaacatgccacatgtagagttaatgtaccatatattacctgaaaacgatagacttctattgccgtgaaaactacttgacaacattttccaggaagccaaattgtttggtttttaatttacaaaatcatgatataggaagaaaacaaacctcacacatatgtaggcacagaaaatacttttatgactgttgacttgggaactggaagtaacatgagacatgggaaaacttcagtgagaaggagaggcagcgtttgtccagaccccagaagagacttccaaaggaagaattg

SEQ ID NO: 59498 - DNA, 1048 bp, Homo sapiens
aaatctcaaagcttttcagcattgttcttgctctttagaaataatcattcgttaaagtgtaaggaatctagtgtgactttgttcatttgatgtgtatatttttaaaacctatttgttaaatcttcaactaatctgctttaattcagttccccatagggatgccttggctggttgcttggccacaaacttggtagactgcctttatttcagtatcctctgtgtgtctctcgagaaacccgaatgagattaacatcatcttggttattcagtccaaggaaacgtttactatcactgaatataatgtactgaattgtcaaagtagttgtagtctcatttccctggagataaaataatgtcatccacagtgacatttccctccgtttgcagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggaggtgagagtccaggctggcggcccccccccaacagatgggcagagaggttaggctcctgtagatacagaagcctttcccaaggtttacagcagccaaagccaggagggcacgtgtgctagctacaacccagtgtgaaaagaaccgagtttaagagcaagaggaaagcaaaatgcaaatgtgtccaacaagctgagctgtgcatcacataccctgtcctgtcctgagaaccaagagctgactgaaaaccggagaggggcatggctgctgagcatgggctgcagtgtcacccacagcaaagtgctcagagtctcagaccacagagtctcctcagcaagcctgaaggctgcctgctcccacggggtccatctgagacagaagctgtcccagtggctgcaggaacgtgcatgctgctgcttctaggactgggtctgcccctgtcagggaagaggaggccgcgaggctctcgggccctggtggccagctgtc

SEQ ID NO: 59499 - DNA, 1025 bp, Homo sapiens
cttggaatagtcacactgttaaatctcacttaagtctgaagtgagatttcagggctctggattctgctgctgactatggtccgccagactgttaggatggatggtgagcacattcctactgttggaaccaactctgtgaagcattctaacttgcagccatgcaggcaactttataatagaagcaacatgagatgctcttagaattatgtcaatggagaaggaatctgacaactggggccgaaacggaaaaaaaaaaaaaaaaaagagtctttatttaggtgtttaaatatctttcttgccctttagttctagtaaaaaaacaaaaaaacaaaaacagaaacaaaaaacacacccactgtggcagaaactactggttgtctcttgttaaccattcttttctactttcatagtaatagataccctgatttttaggtaggcctttacatattcagaattgatatctcaatagttcccaacctttagctaggtgtggccatgtgaccacattctgatcaatggaatttcagtgtaggacagcttgggaaccttctctatggtctgcatgctttgttctcttctttttctgtttctcctcctgctggctggaatgtggaaatgatggctggagcggaagcagccgcttcagctcctgaggggcccctggtaattgggctccaatgcgcagaacgaggctgaaggcaccagggcctctgctggcttcatggaggaggagatgcctatttcctaacttttacctgaggaaaaaagtctaacttgtttaaaacactgttattttgagtttctatactcactgatatgttactttcaagaaattgttttggaaaaaacattctaaaaaatacatttcctaaaatttcaaagcccatacagtcagaagcgaacggatacagaaatgcgtgcctcttcctataatacttacctttcccgattccatcaggggcagactatgaggggatcctctttccactaagcggactctgcaaacagaaagagaaaatattcct

SEQ ID NO: 59500 - DNA, 1093 bp, Homo sapiens
ttttcaccctggctgtcagttttctaaaccaggtataggcctgctctttattaaattgctgtttggtaaatattttaggttctgtggtctctgaccactcagctcaaagccactggagacaatatttaaacaaatgagtggtggtggccctgttccaataaaactttatttacaaaaacaggaagtgtctgtggtttgccagctcctgttctgaagctggactttttttttttaaaccgaaatttgatccctgtgttttctactaagaaagaggatccagtttgctgatgtcgcaggtctgagagacatcacagcatcacagcgtttagtagtcttaaatgtgtgttcaaagtggtaggaactgccccatgattctgtagtacgtatttgcttttcagaaggctttcgtgaacatggttgcagtttgcagcgttggctttactgtgcccttctacagatggcagcacgggctgttccaagtcctccttttccttggagtcagtgctgccctgagccctccagccttgctgagctccagccttgctgagctcccgccctgacagcctcttctttctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggtaagcagctcccttggcagctcagtgccctgtgagcccacagggactcctttctaagaaggcacatctgtgatggggtgaagttaaaacagtcctccaaaacaaagcctgggtttaatctaacgtcacctgaagcttacaaactgcctttatatgaaaatctttttaacgtgaatatttccccacgaccacagacagtaacgaaccagaatgtaaaatattttcaatgcctgtcattccactgggtctacttgaaagatcctaaatttgattttttgttgggtggattcagtgttctgaagtgttcagtgttcagaagatcttaggtgatgttaactttatt

SEQ ID NO: 59501 - DNA, 1040 bp, Homo sapiens
agcatccctgggcgcctcccacagttcttcccgtactgatgagtgtggggaaattcggaagtacagcggccgttttgaagtcgtagttggagctgtgtcactcactagtgatggttatggagcccctgatggcggagggagggctgcatgagcgtccccggcgcgtgctcaccatgctcctgtgtccccgcaggatagccgtgttctcggtgaccgtgctgcacgacgagaggatcgtgatcgtggctgagcagaggcctgactccacggaagaggacagtttccagtggatgagccgtgtgctgcaggttgccctccctcgccctgggcactggtcccctgtgtcttgtttctggcctccttacttcattcagatcatggtgtgaccagctgttgctttgcccatggggtggccctttttcccttcccttcatttgatcaggaactacatcaagtgtccagaaactagctcagcagatcgagggtgtagggaccaggaatttgcacagctggttcctaccggacaccttggggaggtcgaagtaagctttttgtttgatcttgagaacatgttatcttttctccaaagttccttttttactgtgtatggtcttccacaagccctgggtaacattattcagctttggtgagtttagtaggaaaatcctttctcttaccttggcatttttatgctgggaacagtgcttatactgcacagacttctgtgtattgtggatcatattttgcataatataaatacgtactgtttatacttcctcttataacatgatttcctctttattaactttctaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccaggtatgtgcaccacttgggcagcttg

SEQ ID NO: 59502 - DNA, 1067 bp, Homo sapiens
gttcagtgctgcaactcagaactcttatctttttaccaagtaggtcctggccttagaagtagcacaacatttaagttatatgtaagaaaatataaattgtttggggatacatttcctaaatgtttagaacttttggttgttgttgagacagggtcttgctctgtcactcaggctggagggcagtggcacgttcacagctcactgcagcttcaaactcctgggctcaagccatcttcctgcctcagcctccgagtcactgggagtacaggcgtgtgccaccacacctgaataattaaaaaaaaaattcttgtgtacatatggggtctcatgctgttgtccaggctgatctcaaactcctggcctcaagcaatcctcccatcttagcctcctaaagtgccgggattacaggcatgagccactgttgctggtctaaatgttgagaactttggatgtggctgaacagatgttacagtacctgtctatgatagctttcttgagtgtgaattcaactttctaaaatatccctcgaaactgagctggatacaaatctaaataaaaactccatctccgtttctctggtttatctgcaagggtggaggaaaaaagagggttagagtttgaactgatctgatttgcttccttaatatttttcttttcagcatacttccaacaagggcaaataacattttatgaatgaagagagattactttaaaactaacagacgttgtttaaaatgtaccttgactcttcactcgtcttttacattgtggttttgtaaaccaagtaatcagttactgctgattggcctcctgtgagacttctgggtgttatctgttcagggttcagaggcaggaggctccagcaggtgagtggaggtgcaggaacggatggggtcctgctgaggtgggcaggaagtgcttttctgcctcgaagactgttggccaccagcggtcactgtgacctcggccctagggcagggttgctggggtgaaaggcagagcttaagcaaagcaggtgccgtgctcccaggagtagcggcgaggattaaaaccagctgaccacatga

SEQ ID NO: 59503 - DNA, 1021 bp, Homo sapiens
tctggacacggcccaccatgggttacagcagcccctctccagagccacctccctggagctggcttcagtggtcttctctggtgtgccacttttctgattggcgtgattgggctcaacacaccgaaggaccgaaaaggattaaaggtacaattttagcattccaggttgaattagaaatgacagtgtcctgaaaactagaagcagcccgcagtgtccccatgccggttctccctgcccctccatcactcagtctcattaagactgtctttttatgtcgttatcatgcatatgatgcatatttaaaccgttcagtgctgatgctgtaagaaagaataatctgtataattggccattgcagttggactccctaatttcctgagatgaattaggcagcaactctatctcagtggtgaaaatctttaggagagaagccaatgctggtccttagaacctgtacctttcgttaccctgatgtttaagttacttttgaataaatttgatgaaagcagcactcgtacttgcgtttccaccaacacatccctctctgcattgttttctgaatgtgtgaacagaagggaaacttccctctgtgcgggggtttcagttgtgtgccacagaaaggttgggacagatgcgtgtttttggaaaatgagccagtgcctgtgaactcaagtgtattctgtcttaaaacttgaggtgaatttcccatgtaggagtggtcagaggccaggttattaagtgaaaaacggctttcgtacattccgtaaagctgtactaagtgaggtctggcaaggcttccctgtaggttttggcatgagaacaaaatgaatgccttcttaaaggtcgtcacgtccaatgtgggaggcagtacagcgatctcattttatttactccttatgttttttaaagaagaaagacaagtgttcggctgctacattcccctgttttgttgcagagaagggtctgtagaggacggattatgcctgtttggatgggttcgaggatggccgtttcctctgtg

SEQ ID NO: 59504 - DNA, 1071 bp, Homo sapiens
aggaaaaaaatgaaaaaaaccatttcttttttctctctcagaactgttgtgagtataaaggagaaaatagaaatactctgtaaaagtttgtaaagtaatactcaaatgcaaagcagtattaaacttcagtttaacacagtttcaggaacatgtacactggtttatgtgaattaataacctgtacttgaaatcacagtacgttaaacaatgaacaggaatgtgtgactgttatttttttttgtaataaaattccatgtgtatattggatcccaggatagtggctgaggctctgccagctttatcgggcacctgaacggggaggccaaacaccatctctgccacttgggggaagcatttgtatcctcggattttattcaattttaaggaaatgggcagaatcttaccaaggaaaacacatatttttgaacaagtgaatcacggcacttggcctccctttgcgggtttacccttgcagtactggaggaagttttagtacaaagaatgtatccaaactatgaggggctcataactcatgtacatcaaggctcagtgtgacccaaatgtaactctcgggtgaccacattccggtaatttctaattaggcacaaagataatcttcctagactatctggaaattttctgtaactttgaaatttttttggaaaaaaagcagtggcaaaataatgaaacttaatcagaaaaggaaaaatattttctgtggcaaaacaaaagaagtaaaaagtcagatttgcacttgaccttgtgagataatcagaagcctacaaacaggaaagtagcgtgtgtgatcgtgcgtctgcgtgcgcgtgagtgtcctaaggagtccaagcacaacagatggctgagtcacactggccgatccctccggcaagggacagaagtggaggctgcagaggctgcttgtgtccgaggggagaaaagcccagggctgcagactcaggtcacggagtctctcagagctggccacgcttctacttgctgttgaagcaaaatctcaagtcctttgtggattttttccaccaatttaattatgccggcaattaagtagggaca

SEQ ID NO: 59505 - DNA, 1056 bp, Homo sapiens
tcaaggctgtgtcaattttacttttatagaaattgtgtaagttttcttaaaaggcagagtgggccaggagcggtggctcaggcctgtaatctcagcactttgggaggctgaggcaggtaaatcacgaggtcaggagttcgagaccagcctggccagcatggtgaaaccccatctctactaaaaatacaaaaattagccggtcatagtggtaggtgcctgtaatctcagctacctgggaggctgaggcaggagaatctcttgaaccagggagtgagaggttattgtgagctgagatcgcgccactgctctccagcctgggcaacagaggaagactctgtctcaaaaaaaaaaaaaaaaaaaaaaaaaaaacccaaggtgatagagaattttcaggctcttaacattgttgcttttctaacaagtaaacttttaaaaaaattcccagacagcataagtcatgtgacagtgataataagtgtgtatattgtttgcaattattatcttttaaaaaacaaacccgtgtcttaagattatttgccgtgacttctcctctcacccgatggctggagctgctcacctgagctggcgtctctcataactcacctggaggtaggattctgagtgtcattcttaaattgaagtttaaataacaaatacaccaacaatttattcccaaaaaccttggtactgcatgaaaagttattaaatgaaaaatattctcataaattatagtgaaaaaattgatgtattttgttataatccaagatatccaatctgcacagatagaaaaatcaataatgagaatgtataagaaacaaatactgtaaaggtgaattgatttgagtgtaaaatgtgacgtgatgaaggtttgtcgtgtgccccggaggaaaacggggaggtggaggggctgctccgcgtgaggcacgttctgctttctctcctgttaccatcatcagtgtcttgatccttaaggaactgtatgggtatctaacacacacacaccgacgtagaaataaatcagctgcatggttatctaacacaccaacgcacaaatca

SEQ ID NO: 59506 - DNA, 1032 bp, Homo sapiens
tgatgtttttatccccgaatatctcattgcaataatgacatcaagcatagatggtgcatttgtatactacctctttctctgaggggtttgataggtgctgatgcttttatccctgaatatctcattgcaataatgacatcaagcatacagggtgcatttgtatactacctctttctctgaggggtttgaggggtgctgacatttttatcccctttttagtactttatccctttttagtatttttagtattttatccctttttagtactttaagaaacgctgttaaatgtattttagttaaccaatttatctaacactataaatgtaagtagtaccaacaaactcttcactagcaatagtgatttattcaatgctgcatgaagctgatcctgaataagcccttctcttaatagatgggtgcttctgggttcttagagtgaaaggcctaaagggaatgaactgttagcagccacagcagaaaaaacgagaaagatctgcctcttttggagtcaccaaatgcacctctatcaatttattgcctctcagctccaaattcaccctttattgccttcttcagaaaccatggatctgagtcctgcaaattctgttgagttgtgtttgtgaagtgtgacagaggcatgtgaggacagtggtttcacttcttagtctcagggctgtgcacagaggctctagcaggtcctgctgctgctggggtctctggcctctgtgttgcatggcagccagcagctcacccccagctccgacagctttgtaggagcttctccagcaatatccctccctgcctgagatggctgcaggcagcgtggtctccttggagcccctgtgctgtgtttgccctgacagccctgagtccagctgtacctgttacattccctcattcctttctcattcagtatttatgcatctgcttcttttctctttgctttgataacacgttaatgctgctttaggatcccaaactagaatcatcttccatttacgtgaaattttaagccgtcacttcctagcctct

SEQ ID NO: 59507 - DNA, 1019 bp, Homo sapiens
aatttacgtttctgatccccttggttcccctgacatgggcacaggtggcgtgactgctcactacacctctctctgagctttcctttctcatgctgcatattgactggttgagcagcctcctcattacacctctctctgagctttgctttctcatgctgcatattgactggttgagcagcctcttggattgctttgactcttggtagctttgacttaaaaaggcaactgagcagaaagccgtagctactatgcagctgcttaaatgattctgcagagacttaaagtcagactctgggtgagggagtgtgtgcttctaaaataggaagataatgcttgatgtgttgtggaaagttgaggctctgttggccccggtgctgaggtcactgcgcgcctctgactctggtgtgaacacacagtgaccatggagctctgttgacagagatgtcctcctcctggggtttaggactctggactgcatgcgcttttgtgtttactgaggttagcccacttctttctgctgtcaaagtgattccatctttgatagccttagcagttctcttgtttctccaaaagcactttctgatgaagaagggggtcacatagtgtgtgttcatgaccatcccctgtggcccagcactcgggatagaccactctgccactcacctcggggtggtccagcgtgacttttcagatcctggaagtgacgtggattttgtttattccagttgtcctcctcccccttcagcagggctgtgatattctccctgctggggcatctgaagtgtctcctgtagttggaggtaggacggcggcactgggccaggcggttctgcacgatgactttgttgccaccagtctggcccttggccagatgccttgggcatctcggacttgctgagactgtcatctgtgaaacaaggatgatagtgcttgtggagtgtttaaatgacatagttgtctgtaaagttggcagtaagaccccgactttgtaggtggataatcggcctccatcctttctc

SEQ ID NO: 59508 - DNA, 1066 bp, Homo sapiens
gtgtattgagcatggcaagaaagacttacgtgtgtcttaaacctcttgaacaaagcacgtcgatgtttcaactgcatctcgaaggctaatagactttgctgtggtcaatattcaggagaaaataggttttaatgagataaagacatgagtggcaagtgacatgtttgtgcccccgtatgactaagtgatgtcctggctgtcccacaccaccagctctgagcagccagcatgcagatattgggtcaatttagatatccctgatctttacggaggtttgatcaggcagctcaagagcagataaacacaaatgctgactggaaaccccggcacacggaggcgctggaaacagcaggctgctgttaacgtcacagtgagatgcagtcagctgctctctcaggggtgtcagcttcttttgcttctagatttccgtctgtgctgcaatagagttttgttcagcttatccccattgctctgctgtcttcgctgttaaaatctcagccagcacttggctctgaccctgcagtaatttcactgtgcggctgcccaggcctgcctggcacggctgtaaagcaggcgagagctttccggaaggtggtcacgagaaccccaggcgggaaagagcgttgctggtccacatacggcagtgcacctgcagctgagcatgtacgtgcacgttcaggctaaatataggtgcaggagagaagaaaactgcctatgattagtcacttaaaatgccgaatacccagcccctgagaccctaggacacagagcaggggtcttggagacggcaaggtgtgttgaagtctggttttatcatttagtttctccaagcagcattttcctcatctctaaactggggctaacaactgccccacatagatttgtgaatggaaccaatgagtgtaaagtggggtagcccccaggacctagaagggactcagtcagtttcagtggtcatgcgtgttgtacgggtcccccaggaaggcgattgctacagataactccctccgttcgatgtcactgaatgttaaagtgggaccttggcttctgatgtgtctggtttgct

SEQ ID NO: 59509 - DNA, 1018 bp, Homo sapiens
cacgccaggcgttgcagaaggaggtggtgtgcgggggttccactgcctgtgtgagccatgactggtgagggcctctgggcagcagctcacctgggctacttggaaatgcagattcctgggcacagacctgctgggacaaaacctgagaggccctgggttgactaccctccagggattccatccaggcttggccatcatgtctcttggcaggtcactcaggcccggctgtctcattgagatgcctggccatcgcagggttagctgagtcacctgcacagctggtgtgggtgtgctgatgggtgtacggggctggcctgtcttcctttctccacctacgaagcattcaaaggcctgttatcctaccctgttctctccctgtcctcagtgggcaagcaggaggttcattttcacttgcagatgaggaaaattctgaagtcttgtaaagcagccaagatcatattcagaatcttctttgttccaatcagctcgaatttttacagttagaaagacttttcctcaaacactttgtatttgttctgtatgagaagtgccgtagactttgctgttgttttactaattagtatctgtactgtgttctgctgtccatcacaaatgtatgtattttcattctgagatacgctgagtctcagcctttgcaatccagagggatttcatgtgtgttcataaaagcttctatcagaaaccacattccgaatagctgtggacatacaacctgcttgtgacttggaaattgctgaagtcaaattctatctcggtttgaggcgttaggagctttagaaattttgaaattataaaatgaaaatgtgataaaattaagtacatttaaacaaaagagatatgctgtgggttttaagggctgtgatgcatttaagaatgcttttctgtattttagatttggttgtctttaaggatgtcatgttccatccaaactacaaatacatgagataatttaaatgtaagttgaacccttcagaatatcctggatttggtcttgatc

SEQ ID NO: 59510 - DNA, 1049 bp, Homo sapiens
gtaacagtctttttttttttttttttttttaagagatagggtcttgctgtattgcccaggctaatcttgaactcctggcctcaagcaaccctcccacctcagcctcccaaagtgctgggcttacaggcttgagccactgcaccagcctacagccatgtttttaaaagtcagcagtttaaaaaccctactcctctcaccccctcaagcaggctggttggccttgtacaaactggggtgtcacgaccttggccccccttttatttttccctttctttggcctcaagttctgataagaacagcagttacaaaatgggcattaggtgattcttccattaataaagccagaattctcatcagttagagatgtttgtccccaggagtccagaaagctgttttgaatcaagcccatagcaaataaggaacaaaacccttggtcctctgcttaatatctgggaaatgtgttagttgctgacaccctttgatctgtgctcacgtgctgcatctcctcacgggaagcaaagtcgccctgtggaataaagcccggctcacggtggcatgtccgggatgctccgggctgtcagtcacttagacggcggcaggcgtggagactcggcatcgtgtgcagagctcgggcaaccggagtgcatccaccttagagaccacacagccggtcggcaaggtggacgtccaggcagatggcctgatgggcccgccacgtggtggcgaattaggaatttgttagcaaagaaatgaaacttgcctgttggtcccagcttctttgggaggctgaggcaggaggattgcttgagccagaaagtcaaggccgcgatgagccatgatcgcaatactgcactccggcctgggtgacagagtgagactccacctaaaaaaataaaagcaagctaaacctttccatagcaggaggggagaatttatcaaagtaactgcaacaaaaatcttagatgatgtaatttcagtggctaagtgagctatccagcccatgtggctggctcacaaagatgcaacggagccaggtgctgctgcagctg

SEQ ID NO: 59511 - DNA, 1113 bp, Homo sapiens
aacttaaaataatcaatatttaccagaaataattgatggcgagatgggaattattggtgattccctgacataggcggcctgtatagataagcatgttacagtgtctgatttccgagatgttggtccacaccttctcagaaacacactttcaggcttagattcctgtgcaggagaagctgcctttccccgagacgcgatggtgggcccccgcactggcatggcagggtggttgtgtgactgggctgggctggacgtgctcctgtccccctgcgctgggcgcccgcctccaccccccgtatctacatcgagggtgcctgcctttgttcccccagctcgtggtgatacaactgcaccttcctttacgcatttctgaatagagatgattaggtctgggggtcgaatctcaatccgtgagatgcatccaggtaaattattcacacacatgactcgagtcctcccatcctggttcagggtcaggaagcgggaggtgggtttggagacagctgtgtggcctcaggaaggttctctcagaacctgtttctttctctagcaaagtaaggattcctacctcactgggcttgacgcatgctcagtactcagatgctgtctagtctttatcatagttagtatttggggaacagcgtggctggtaagacaatgcgttatctttccaatttatagaatgtcatatgaggcaagcgtgaaaccaggacactaccctaatctgaagatgctgttgcttactcttcttaagcattttattataattctgtcatgtgtccgccctgtcatgtgacggcaccctgtgaggttgccagggagcatccctcctgcctccagccctccagggtttcgccctctggggtttcccccttccccgcccccttccccgcctgcccctgccccctccccctgcctgcctgcctgcccctgccccctcccccttcctgcctgcctgcctgccttcctgccccctccccctgcctgcctgcctgcccctgcccccgccccctccccgcccatcctccccctcccccttcccacccatcctctcccccttcccctcccctgccctgcccatcccctcccccgcccccacccccacccccaccc

SEQ ID NO: 59512 - DNA, 1081 bp, Homo sapiens
catgagacatcaatcaaataaatgtaagatgtacattggtttgatctggaaacgcggggacaactggaagcaggggtgtccaggtcataggtagattcaaaaatttcctgattgacagttggttgagagagttgtacgattaaggggttgtgtggagaccaaggctttgtcatgtggagggatgcctccaggtagctttgaagagaatagattgtgaatgtttcccgtcaggctaagagtctaagttctgtctaattccagaagggaggcggggtgataaggcaagtcccaccccccaccgatcatggcctggactagtttttcaggttagctttggaatgcccttgccaagagtaggggctgttgagatggccaggggggcctagaattttaatgcttttacaaccagaaagtgattacgttgtttctgtggatgatagcccgtgtggtaattaatattttattagcagattaatttgaaagtcaatgtgttttcaagtatgttaattattaagttatcagcaaacagaaagcttactttgaaaccagcctgagaatcaagaggcctatcaaaacaatggacttgggagaactgattcacgtgttcactgccgcgagtttcaggcattatgagaagtctgtgtgctgatacattaagtgactcgagaacttaaatcctgatggactcctacttaacagtgacacttttttctttttttttttaaatggttgtgtttagcttgtctcttgtgttgtgcagcttttgtcttccagccgctgagcactttagctttgtgttcacatggcctcattctccgaacctcccctctttgtgactcctccatcctgtccaccttgatcgcgtgtcttctccacccctgtgggttttatcccgaggactgctctctgctgtgcgtggagggatgatcagtggacactggctttattgactcattttacacctagctcccagtttctaaaatcatgattgtcttggtttccctgtgaaactgggagtcaggccttgggcgcagtgctgggtgtctgtgacagggcaggagggagaggtgagaaccggagg

SEQ ID NO: 59513 - DNA, 1031 bp, Homo sapiens
gttttttctggtgagtttggaatccgcccctctctgtcagggttctgacagtgtctgaatgccggcctttgcaggagtccaaggtgctgcctccagcaggagagtgggtgacgtggatctgaaacagcaaatcaaagccgggagcccacatggccctgcctgcttcccaacgtgtgaagtgctggtcagtggtttccttccacccttggactcagttattaggctgttacatacctcggagaagggcgccagcctgagagggtaactcctgctttagtctccttgctgcgctcgactccgttacgcgactgtaagcacatatttttatgcttgggttttgggcaactgcaggagtttgaaatttaagtgcatttgatgatatacctttaaaaatgaagcttacatgtagcaaacgggaaacacaccattttacatccttattcctttagcatgtgtgaattccatggttttaaattctaggtgaagttgggttagtagtctgtggaaaatgcctctcttacgattggaaaaactgattgttcatcatatgccttgtttaaaaagagctaagatggaaaaagggatcttctgggctgactgtagttgctgacagtttcactgcatgtgagatgtgtggttttgaaagtttgactctgcattatggggttgtgtgtgtttgtctaggtctttttttttttttttttagaatgcaggtactgtttcatatttttaggagtcacatggtttcctcagctgaatttaaacttgtggaagggcggtactcttaaggttcttaaatgctgtgtatgtacaaatgccagcatgatgctttgtacagagaggacattcacgcttagtctattgatggaatggacgtgttctcttgcctgtgctcactcgaggccctgatactgactaggggtggtccaggctccatggaaagcttcctaaccaattaggggagtgatggaaccgccctctcctacagcacctggtttgccattgaatagaggaagggaaattgctggtag

SEQ ID NO: 59514 - DNA, 1988 bp, Homo sapiens
cctgtgcttggcctctttaaaactgtttcctgatccataaaatgggcacgacaaaatccaccttgtgacactgtgaagtttaaatgagatgatctacatagtgtcttccttcccttcctgacacgtcatagactcacagctatggtggcaatgacaggctggatggaatgctggagctgctttgtgcctgatgaagccacatggatttgtgcagtgctatgactatctctgaaagcctttggtcgtggcagtggcagccttgagtggctcttggcatacttcagtctgtggagtgcaaggttggctggagctctgaggccattgatactatccaggggtgagctgataggaccctaaaacatgggggaaggctgagaggacttggctgccagaagcactgtagatttctggcttccagaacttgctgacttatggacataggaaggtaaacccagatggcttcaaaattttaagtcaggaggaaaggtgtgcgagggtagaattgctgactaggtcatggttgccatgtccttgtggccatcctctctcctccctacccctgcctttgtgggtaggagggcctgagcctgcacagccgtctatttcatggtgacgatggctgattattaccctgcagtaagaagtctctccattttattttgcagcagtagttaaataaatttaaggagtgatggtgtagtggtatttgttttgtttttgcttttttttaaaaaagaatataaaacaaatgagtatcatttaaccgaatgttattcccaatttcactgatcactttaagaggccacacatgctttggtttgttattttgcgtttgagtttgagctagttcattttctcacgggaatgccaattcgttattctgttgtcacacatcattatgtatctcaaattgtattactataatacttagctgaattgcctcccttgttttggcttttacaaaactcaaatctgtgttaaacacaggatggtgcatctccattgagggttgttcaaaagtgtgacttttcctggcatgcttgagaatcaatgacattattttatagaaacactttgtagctgacagcaaagctagaagcttctgtaaagggcagggtaggcaatgtgttatgccttgtgggccacggaagtctctgcatattctttttcttttgttaaaactttgaagtgtaaaaatcacttctggttccctggccaaggctcggggattgtggtttgcagacccttgaccgcaccttacctgaaagctgatctcccatgcagtgagcaggagcccacttcattggttcagccaggaagccgctgccctcatgctggaatttacttcaaacaaactttgaaagctctggcacagctgttcatttcctccttgttgcaggccatctaaaatacggagcgtgccttggcatttttgattttgttactcttgaacggctctgagatggctcattgcaggtagacatttgcagaaacgatcaggcagagccacagccatcttgcagatcaagtgaaggtttttttttttttttttttttttttttttttttgagacggagtttccctctgtcgcccaggctggagcgcagtggcgcgatctcgactcactgcaagctccgcctcccgggttcacgccattctcctgcctcagcctcccgagtagctgggactacaggcgcgtgccaccatgcctggctaatttttgtatttttagtagagacggggtttcaccgtgtcagccaggatggtctcgatctcctgacctcatgatccgcccgtctcggcctcccaaagtgctgggattacaggcgtgagccaccgcgcccggcctcaagtgaagttttttccgaaagcttgttacaggcttaaatttctgatccctttccttctactgatcttggatgattcgtttctttttgctctcatttgggtctatgaaacttgttgaacagcgtctcaccccacggtag

SEQ ID NO: 59515 - DNA, 1068 bp, Homo sapiens
tgtggtgatataacatccgctgctacggaggcaacatgagccctcattacagccacacaaactgtcacgccttgttaccaatacacagaaccattttcttcagttgaaacacagcagaacctgaagtcatctgaatgggtcctccgattattacacttggaattcactttatattaatatgcttcctaattagcagaaatatcaattatacagaaatgtgagaatgtctaattatacgtttataacagaaaaaaacctcttgttgaataccccagaacacatggctatgaatgtgtctccctcatgccctaccactgttttcttcgcttgaaatgtgaaatgacacttgaatatggttttctggcgacttagactcgcatcgttcttcagagacaagatgtaaagcacatggagactttctgctgtttgtggaatgtgatttcctggtcgcctcattcaggccgccgctgtcttcccctctggctgcctgcactgtgggacgtctgaggagaggtccctgtttcatcctgtggaagttctgaaaaggaaggagaggagggtgtggggtgtggtacctttgtgttggtcccttgagcttttatttggagtctcggttaccttggtggttcctgccttcatgtccctagctggtggcttcgtccttgtgtctaactcaccggcaggcagatgaaaagggaagttgtatttagccaacagcttgatcttattctcaaggctcaaatcgactgggtatttgtaaacttctgtgcaaattggcatttttggtttttaaacatgatgttttatttgtacttcaaatgggtaactggttctcttggaaaaaatatagccatataactggtttttaacaaaataggggagtgggtgtgagagagtggcttagaaattacaccagtaatggcagggcatggtggctcacacctgtaatcccggcactttgagaggccgaggcaggtggatcacctgaggtcaggagtttgagaccagcctggccaacatggtgaaaccctgtctctactgaaaatatgaatattagccaggcgtggt

SEQ ID NO: 59516 - DNA, 1024 bp, Homo sapiens
tcttcatggtttcacaaaaggttgtggtcatattttattcagttgaaccataggaaactgccaatatttggctgtttttggcctacaaaatggcaagtttgtatattaaaaccaaaggcttcctggatggggaaaataggaactaataagaacctgaagttttctgtcatggcccacgagtcacaggtgagtaaacctgcgtgaggggacgttggctgtacagtattttctttgttttgagactgtcagaaaaaggtcagtttgattccgtgtgggccctgcgcctcgcctttgctgcagaggggatttgccattttacctcttgtcccgagtgcccaggaggctgatgccatgtagaagacctgcgggtcggtggatgtgaacgggcatcggacacactgcaccttgggacacatctgagaagtgcgtgctttgcaccaggtctgcggtgagggcgtgttctgtctcctctcccttctctggctttgcaggccttggaagttggtcctgggaagtgaaattagctaatgctaattagctcaaggtcaaagcccgaatcaggctcatcatttcctgcagtgtccacagcagcaggtcgtaaattcgacatgatctgaacccggagagtcgagattccgccctggtttgcggctcggttgtgtgtggtcttgagaaagtgaacatgggttttcttgactctgagggggccgacgagacctgcccttcactaggggtgttgaagcattgggccttcctgtcaggaagcagccagggactcgagaaagcaccacgtgccctccagttcccttacgttgaaatggtttatactcagccacgttcccttatgttaaaatgatttgtactcagccatgttctcttacgttgaaatggtctgtactcggccatgttcccttacgttgaaatggtttgtactcggccatgttcccttacgttgaaatggtttgtactcggccatgttcccttatgttgaaatggtttgtactcggccatgttcccttatgtt

SEQ ID NO: 59517 - DNA, 1073 bp, Homo sapiens
actctgcaggtccagcggtggttagaggaggccctcctaaacgtttaatgatggcgctgctgagtgcatgaagccacgtcagccccagagtccaggtagggaaccgtggggtagagggaagagtggacagatgggtgctttccttggcccctgggggcatggccaggtccacgttcagacctcctggtttctcccgtatttccataaatagccaggaaaggactcaggacccctaggacctcatgggtgtaagctgtgtcctcgtgtggccccagctgtggccagtgacgttattctctttaacctcaagcttattttgtataaaaacatgaagggacagaagtagttcaggagcctctgaagacttacgtaattgttagtaggcctacttttatgatttcttacgtattaagagcaaatcatgaaacaaactcatttctgtttgaaggaatctttactgttctcatttttgtggcaagtgacattgattctttgcatagtgacagcgttagtgcactcctgcccagccctgctgcccagcgtgtcctcggcacacacctctgtccattggtctccattcaccaggtctccattcacctttccacctagaattgtaggggggcactgggatattggggctagaaggaaactctgaagaccacttctaggggcagcttagtcagggctctccagagagacagagccagcccggtgtgtgtgtgtccagggggaggcttgctgcaggggctacggaggccaagaagccccaggacccactgcctgcaacctggaggcctgggagggtgtggctcaaaggcttgagaagcggagggtgcagatcccacccaggtctgaggagctgagacccaggagcaccgggggcagaagacggatgccactggcctgcagccagacaggtggagcgagcccagccttccccgccttgctgttttactcgagccctggagccctgggtggacagggtggtgccccctacactggcgaggatgggtctccacttagtctccactcagtccagaggcaaacacacatctcacacagaaataatgcag

SEQ ID NO: 59518 - DNA, 1001 bp, Homo sapiens
aggaacttaagggctttgagaactgacactttaggactgcaggagttttcttcagactgtaaaaaccttggtgtgtgacaatactgaacgttgcctgagtcctgaaatcctgtaaacagtgatggttaagacattccccgcccccaccccgaccttatttactgcaaaaagccccttcccatgtggcttaggctgacttgcaggtgaccctttaccaaggacaaggccagagtcaggacttcaaacacccattctctgcctcataagtgattagctaaactgccggttcccactgatcaatcagaacaaaacgcgtgttagccaaatcttggttcctcccgttctctccttacccgagcctgaggcccctctggagaacaggcagcctctgaggaaacctctgatccccgatcagccaccccatcgcctgcgtccccagccgcttcctcctggccttgttcccccttccctgtgaaggagagaacagtttcggctggccctgagatgctggcaggcctgcagtcagggcagtgggcgcctcccaccttgaaatggtccttcgtggtgcagttctgcttacggggtagactttgttgccttccacagaggacagttagggtgggcaggaaggaagtctctgccacaagtctgcattccaggctgtttccagaagtgggaattctctcgtgccctggagtctgggaatgcatttttagtttcccagcttcaggtagaattgaaattgagtgagccaacccaccacatccatctggagccaggaactagtgccgttttaaagcggcagtttctccgtaagattacaaaaaatgcacttagcacgtttcttactttgacatatgcatttggacatctaaaatgggaatggtggtttttgaagcatggatgtagttttaaattttgagtgttgtaaaccttaatgtagcttcctaaaatttttgcctgattatctagagatttactgaacctttggagtggtaatg

SEQ ID NO: 59519 - DNA, 2381 bp, Homo sapiens
tagattgacaaatgtcttttaggggaaaattaatttaattagagaactttttggataaaaactataatcaagagaagctgttttgtaataagatctagttaaatactaaagttgaaagctccttatatttgatcttaaacttgggcccagggtgcgtgtccgcacgcttgcgctcatgacgccaggctcagctgtgaactacaggcacactgtacttactttctggttgcttttttgaaagtcttattgcttggcctctccgactcagatgttgagttacattgattctgttccgaatgtgttcatccctccatctagggtccactcgtctttcagggagcaactgccttcctcatctttgtctcctatggtattgtatatttaatagtcaaatatttataggttgcatgggtgactgatgtgttcattaggaggaaaacaatgccaatttttacgtcattataatggacttgttaaatgcttgttagtgtaatgaagtttacatggcaaaagaggctttggagatgtgactgcgtaacagacagtgagatgggggaggaccctggattgtccaggtgggtccagtgtcctcacacacatgccttgatgagagggagtacgagggtctgcctcagaggagacctgaggatgaggtagaggccagagggggtgtggggctgagggcagggctggggggtggggtggtgttgtggggctgatgagggagctggggccggaggggcttggggccaagggtggggcagtggttggaggggtgccgggccggaggggtgtggggctgaggctggggcagtggtcggaggggtgtggggctgtgagccaagctgcatggtggcctctgatttgggagactccaggcaggaatgcagcctactgaccccttgacttcagccctgggactcctgactttcagggctgtgagaggaggtctgcgtgtgtggtaatttgttgcagcagcaataggaagttaatgcattgtatctattcacctccagacctttgaaaagtaaccctgttgtatcagccttttgtgtgccctaaattataatgagatggtttgtgggaaatagacacaaacgatggcagaacagatagttggacagaaacagtgtcttctgtggttctatgatttgggtctttaaagttagatttcgatcacagtatggtcttgttccaggtatacctgatatacttgttcagagctcctgggggagtggtctttaacacatgacgtgttaggattaaaacttcaagcacatcagagacagaggtcctgagtcagtgttaggcgacctttgaataagggttggggtatagaatctgcccacattactagtatgaagcagcaaaatctcatggttggtttttttttttttttttttttttttttttttttttgagatggagtctcattctgtcacccagattggagtacagtggcgcagcctcggctcactgcaacccccgcccccctgtgctcaagtgattctcctgcctcagcctccaaattgcatgatttattttcctgttttatatacttagtatatgaaaactctgcagactttattaacacaaatgacatgccagaacttacatatgataatccagcattttcccgtgcaaattagtggtgatgtggaattcctgggctggtttggttttataagacgtagggtggattctttgcctaatttctatggagctaacaattgttaatcacccagcactcttgcctcccccaacggctccggtgaggggtgttatcaccactgttgtgttgagaggcgggagactgaagcttagacgagcaggtgacatgttgctgtccggcctcacccaccctgtagtttcctgccatggcccagctatctttctgcgaaaaaggatcgacaccctggttctgggtagaattccttgtgaaccccgtttccattctccagggagttcttgctttatggtggtggctcacgggaggcctctggcccactgagaaagtggctaatgttgtaacatgactgtctgggctgctgtagattgggtgatctgtagctcacagctctggaggctgggaagtccgaggtcaaggtgcctgcagatctggtgccccaggacctgttgctcacagacggcaacatctcactgggcctcacgtggcggaggagcaggagggctccttcaggccttccaacaaggacaccaaccccggtcctgagagcgaggcctcccaaaggccacaccttttaacgtatcccatcggagattgcttcagtgtgcgtgaggttttggggacagacattcaggccagagccattgctctgctgtggtgttagggctgcgatggtatcattactgccacagag

SEQ ID NO: 59520 - DNA, 1438 bp, Homo sapiens
agttagtgtttttgatattggaaaggtgatgtattttattttctaagaaggaaagaaacacaagttatcctgttaaatactctaaccacagactaaatcacatcaaggaaagaggaactattttggggggaaattagcccttcatgtcaaagataaaggagatgacttacattgttttttaattgagttaattatgaaatcttaagtgggtttgagaagatgagctgtggatgctgaaaggagagactgatgctgattgaatgttagtcagccctgataggatgtggctagtatttcaagcttgctccagtattgtttgatagattgtaagtgaatgtaaagatctatttgatgcttttattttacaaaatactattgagaaaaagtttctgacagccagggaacagccttcaaccaatttcttcctaatttccatcaccagaaaaaacttgtcctgttaattccagaatttacttttggaaagttcctgtaaggagagcagaggtattggtggttgaatggtgacttgaatttaggtgaagatcattaaatatttttgtagtcatgtttgtcttggtggttttagcaatttcatattaaatttagaactgcgagtcataaaaaccaaacgtggtcttaccctttgcttttgtgatactccttttgtttatatgactatactggtaaagtgatgacaaaatcatgcttatagggttttcttctgtgtagatattaggatttttaggggaacaaattcttctaatagacattgtgccatgtgttggggtcctttgtatattagtcaaatcactgtaatgagaaccacttgcaagtatatttctatacaagatcttttatatgctgactcgtggtatgtaaaatccttcatcctctaagaagactaagcaatgggttggaggagaggtttatcccccattaggtctattccgaatgcccagaattgaatgcaagtacgaattgtttttgaagtggtgtgtgtgtggggggatgtgtgtgtgtgggggggatgtgtgtgtgtggggggggatgtgtgtgtgtggggggggatgtgtgtgtgtggggggggatgtgtgtgtgtggggggggatgtgtgtgtgtggggggggatgtgtgtgtggggggggggatgtgtgtgtggggggggggggggggtgtgtgtgggggggtgtgtgtgggggggtgtgtgggggggtgtgtgtgtggggggggtgggggggtgtgtgggtgtgtgtgtgggtgtggggggatgggtgtggggggggtgtgtgtggggggggctgggggtgtgtgtggggggctgtgggggtgtgtgtgtggggggctgtgtgtggggggggctgtgggggggtgtgtgggggggctgtgtgtgtgtaggggctgtgtgtgtgtgtgtgtgtgtaggggctgtgtgtgtgtg

SEQ ID NO: 59521 - DNA, 1053 bp, Homo sapiens
gtcctctgcaggccgagacggatcccaccacagagccggcactgttagacttgggtactgtgtgcagacaaagaggtgcatgtccaggcctggcgggggctggggtgactctggcctccttggccaggctcccgtctccgagtctccaggggaaatgcacccatcatccacaccatacactggaggaaaactgcaggcttctctgtgtggatggtgaattgagatcaccaagtgtgactcggcttgggctcctagccaccgtggaacccagtgataccttttaggtggaacctgacatgcctccatgtgtgcatggcaaagagaatgcagcgttgtcagcttgaatccagatgtgtgcctgttttgaggtggaaggttctgggagcgttggctgttggtgactgtcctgccatggaggacgttgaatgcaggcactggtttaggataatgcctggtttcctggtcctgtatgtgggtatccctgaatatcctgggctggaggaaggcagggcagatgggagggtgacaagaggtcaggtgtttccagctgtggggagtgatgccatcagatggccgagatcaggagggtggccggggaaccaaagcaggggtgtgtggaaacgccatgtttcccggggcacagggaagacctgttgagatcaggagggtggctgggggaccaaagcaggtgtgcgaaatgccatgtttaccagggtgtggagaggatctgttgaactccattcctgggcaacagttcttccattctcaggaatctgccattgtaattcagtagcaaattctgcaattgctctaattacctgctgttaagtccccatcccaattaccatgaattagaaacagtgacaattattgagaggtaaggaatcgcatatttccagggtggagacgaatgcagttgtttgcctggtcaagccttgccaagaaaaaccagtggaaccagttttaggtgccttgagttccctccaaatcggattccttagtgggcttgtgtccacagctgctgcagttcctcccgggcctggcaggcacgtt

SEQ ID NO: 59522 - DNA, 1052 bp, Homo sapiens
ttagctttaaattttgtatcggattgcggtccagattacaaacggctgcttgataatctaattgataaaatcgaggaatttagtacttggaacccagagtgaagagaacagaattgcttttgtttctcaagtgtgtgtgactgagggatgacctgggtgaagagaagtgcctggagtcattacactcaaggaggagatctgccccagcctttctcagcgtcttcaggataaaacaaaagggtgataaatgtggaaaaatgcagcactgagtttgtctatggtctgagcttctcatgtggtcattaatgtgagcgggctgtatctgtggagcctccctacaggcacaaaggaatcaggctagagtaagacggccggcaaactctggcatctgggctgcgtgtcgtttcctaaagcccttttgggtgaagtgacacaggcgcaatgtctgtttggaggagtgtaatctcacgcatgagacgcagattttaaacactaaagtcaagaagcttggtgggagtggctgtcttccaagtgggtttctgtgttgccatggatgaggcatggatgtgtcatctgtcggtgaaatgcgctggtgaagaggctaagcaaaccctgtgtgtgtgtgtggggcgggtgtgtgtgtgtatatgaacctacatctcttctggcatccgaagtaaatagacgttttgtaaaactggtgaatttgatgactctgaccctaaccctgagagttgaagtctggtgcagtgtcttgagccctcttctgcattgagggtgagtgactgtaaatgactgattcctcagtggcgaaagttcaaatttagcgtccctgaggaagccagacctcatagtcacctgtgtctccattgtaaacaccgtggcccctatgcgggtggctgcgagtttccaggccctccttgcagaagcagccatgcagtgcttggtgatttgataacatcagccaccttctgtcttctgtctaatcacggtacaaatgattttcctacagggaaacagatctcatttcttccccgatcgttgggagaagc

SEQ ID NO: 59523 - DNA, 1705 bp, Homo sapiens
tgacttgtccaggtgttcacagtggcgttagggggacggcatcagtgttctgggaactgcagttttactgaaggaagggggctcaccgtgcctttcctcacataactgaaggtatgtccgcctgccacacagctcaggagacagcgactagaattctgattttatttcttatgggaagcaggccacagtcagaacacagtgagggctgaaatgagcttcctgcagcctcagctggaaagaagaattggaagtatttttgatgtttttctacacagacctgtcctttcaggttttgttaagttctggaaaaagggagaagccaggcataccttggcgagggacagtgtttctggcgatcgtgcggcttcagcctgaacgtggccgtgtggctgagcagtgcgggagggctctggtctgcacgtgtctgtgtggaccgaggtcacggggtattgtcccaagcacttatcctgatctggcagaggctctgttcccaaataattattccacggtttcagaggctgtagctgagtgatagtcttttaactttgttgcataaaagcaaacaaagtctgtcatgagagtctaaaaatcattatttagtagtcatgactaaattcatacatggagctttgggatggagtgaaagccaccgtcacctggcgtggacgctgtgtggtatttttagcatggtgggcgcctgctcgtgccttgagctctgtctgcagtgcgagcgacagctgtgcatttgagaaatgtgggcaggtcagcttgctcctccaggggcctgcgggcgtccggctcaggggcctgggacgaggccatgtcagtgggaaggagcttggttgtgtttcagcagatatgtctgcctctccaggcctgcaagccagccagaacccagttttcctttggtcatctaatgccagaaaaaaacctgtttcttagagattcttgtaatttatattaatgaaccatttgaccatacataagaaaatattatcagaaaaatgcatgaggctttacaacttggcagatgtgtaactcacatgattgaatcaaactgttgaagatacttgtttcacttgagggtttttagcattttatgtgcagaccaaatgccaatagcattctgaaagagtattttggaattttaaacacacaatcacagagtgggacagtactgggtcctgggatgctggtgaggtggacgtgacctcaagctcttggagctcacaagcaagcaggattcctaaattgtcacacctgcagtgcagggaagtcaaagtggatttctgtaaacgaggtattagtgcaataaggaacagatgagtgcccttggagggcagtttttgagcctcccagacacctggggctgggggggcggttacccaccagagcctggatggtggagctgggtttgctggttgccctgtgtggcaggtcattacgtgcaacaaggagcaggtgagcgcccttgagggtggtttctcagcctccttcggaaccgcaagtggaagacgccccaagcaggggtgggggtgggggggtggtatccacaggagcctggacagtggggctgggtttgctggtggccgctacgtggcaggtcactgcgtggagcaatgggaggtgggtggagtgggaatagaggacacaccctccacagctactgttgggagttggccctggtggcagagggtgcatagaa

SEQ ID NO: 59524 - DNA, 1048 bp, Homo sapiens
gtccccatgtgtggaccgtgagccggacagcactctcccgacctgacacatccccatgtgtggaccgtgagccgggcagcaccctcccgacctgacacatccccacgtgtggaccgtgagccgggcagcaccctcccgacctgacgcgtccccacgtgtggaccgtgagccgggcagcaccccccgacctgacgcgtccccatgtgtggaccgtgagccgggcagcaccctgatggcctgacgcgtccacatgtgtggaccgggagccgggcagcaccctcccgacctgacgcgtccccatgtgtggactgtgagccgggcagcatcctcccgacctgacgggtccccttgtgcccattgtgggacctccatcatgcaggcaggtgacatgcatcaaactgaatgcaaggaggagggtccaggattgtgtgcgggctccgtgtctcgtccttctgaggccttctgggaagccaggagggcagtggggtcttttgtgtgtttcctcctggtggccgtgggtttgtagaaatggctttttgcaaaagggcccggaggcggaattagagcctgtcctggaaaggatgatgccttcgcgggcacctctttccattactccagtgctcccgtgattttaaatatgtgcaccctgcagacttcagccttctagtgtcctgggtgaataaatgccaggattgctccaatgctggcaaacctgaaacaggaatttctctgcattaagtttgtcaccaaaatgggaggtaaggggagaggggaaggaacttcttggcctcgtcagcccttttcttgaaactcacagtcaaactttgtcaagttctaggtgatagtgcttgaggcgatgcacttatttatgttatgtcttgttttctgagtacggtgcttcgagaatttaaatatttaggtgaaattgccatgcacagttgaattggcaccataatttgactctctgtaaagccttttggtttcctgttagagtgaccattttttgagtcaactgaagcaaaccctgctgtcagcacgaaggagccac

SEQ ID NO: 59525 - DNA, 1055 bp, Homo sapiens
ccggccctcggcaggtggaaggtgctgcctggcagcccctgcaaactgaaggggcccacgtccctcctggctctgcatcccattctcagggacacggctgtcatggggggaccagctggggcaggggaagagtatagggaacccagtagaagtggccgtggactctcttaggaacgataaccgggtcacctaccatagatgaagatgttgtcggcctgcgttcttctcgtgttggtctggggcgtgtggctgccgtgggctggcgttatccacagccccggtctggggcttgcagtggctgtgggctggcgtggtccacagccccgggcaccatggtccctggccctgaaatcgcatccagtgctgtgtcacctcgggccagctgtctcctgaggggaagggaacagggaacagccctccccgtgtggcctccccagcaccacccaccccgcaggacctccagtgttgactctgctggggtcttctctctcctggggggtccttgtcccaacgggaggactccatgggccgcaggaggtgtcaagctattttctctcctggaactgggttgctggcagctcccagatgcaggaggaaaggctcagaattgccttcctaataaggaattgttgatgtgaactttggacggcaaacactgcttacatttccttttccgttttgatgtgttaatggtgtgcggcaacgccgtgacgcacggggacgcaggtgacgggcacccccccacaaggggaccatgcacctgtttgataataaggcatgcttctcttactgcaaataaaaacttcaatggttttctgccagaaagaccctgtcttttatgtaggatacatagaggatcatttggcaagtgattggggattttgggttaaactaaaaataaattaatttcattttatagcactctgaacacatttgagttaattattcatcgagaatttgaatagcacacactgttctgacttccgacttcccccaatgaatggcatttgctgtaacgtgacaaaaccctgagtcttagaattattgggtaatgt

SEQ ID NO: 59526 - DNA, 1044 bp, Homo sapiens
tccagcatcaggtccagggagaggtccagcatcaggtccagcgtcaggtccagtggcaggtccagtggcaggtccagcggcaggtccgggggcaggtccagtgtcaagtccagtggcaagtccagcagcatgtccagtgtcaggtccagtggcaggtccagccaactttccacatggcccatgtgaaaatgtacccactcccttgcattttttaaagcagtagttattagtagagcctactgccatttctccttgagttcctcacagtggatgttaagcatttgctttattaaagcaaagttccatgctctttgtgctaagtcacctctgcctttctgtgagaggctagaattgggatcgaccctcagctgtgccagagccttggtacctgtctcagttctggaatctactctgtccttgttgccttccattcaccgacagccgtctgtcttcctgtcactccttcaacacggagtccagcagtgtgcacacaggtgagcctgtgtggatgctggtttcgtaggatcttatcgggacctcactcatcttttcactaggaaatcagacactgcaaaggacttacagaaaagcccaaagaagccgtattgatagaatcatagagacagaattctataaccataggaaacggcattgattatcatgaaatgtgcacttacgtgtggcatagtaaaacatcacatttgaataccgcactgggtaagagcttggaaaagagattatgaaagtataactggctctgctcttatgtagtgggacatggtaaagcgatgcctgatactgtatagaatggaacaaacaggatagaattatacagagtagtgcagaatagaacaaatagtagagtgttcgataaggtagcatagagtagaagaaacagtgtaacatatagtatagtatacaataggagaaatggtatagcgttatatagggtagcatagaaggaacagtgtaacattatatagtatagtgtacaataggacaaatagtatagcgttatatagggtaacatagaatagaagaaac

SEQ ID NO: 59527 - DNA, 1626 bp, Homo sapiens
tgaaacagggacaagggctagaatctctgtttcatacacagagcttgaaacagggacaagggctagaatctctgtttcatacacagagcttgaaacagggacaagggctagaatctctgtttcatacacagagctgaactgggctgagcgacctgctctgctgacgtctgtttctgtcatgagagggaacctaggcctcttgacatttccttttgtacattttcaaaaagattattttttcctctctctggtccgttccactgtgagattctctcctaaggctgtttctttgccttccattttgacaactatgatttagtttccgagatgatgaaagggtagtaaaaaggcctgggaaagagaaagcaggaagggaaggaattatctcatgattttagtcagaaggaaatcactcagacagaaacgcttttacaagtggtcagatcccgggaagtgggattgaataagtggcatcgtatcacacaaccctgttttacattcttgctgttgccaggggtaacgaaaagaacgagtatattcattccgaggtcaaatatatatctttgctgactctgactataattagcagaattcgttcaattcaagtttgagaatacctttacagaagagggtcttcaggcatgtgtgcctatttctattcgtatgttcacatgtatttgagtatgaatgtgtgtatgtgtgctgtgtgtgagacctcattatttgaaatcaagaaatgtgcagtaaagtagagtttattaattacaagaagttacatttgggggataaaccattttgtatagaattgaataatggggtctttgaggggtgtatatatgtatgtgtgtttgcatttatgtgtatgaaagtgtgtattgcatgtatatgtgttgtgcatgtatgtgtcttggtactgtacagatgcatgcatgtgtatatgtgtgcatgtgtatttgtgttgtatgtatgtgtgtgcatgtgttacatgtttaggcatgacatcgcacacatgtgcaagtatgcatgcgtggatgctcctgtgtatatagttataaatgtatatgtgtgcatgttatgtgtatgcatttacatatgtttgtgtgtgccagaatgtatatgcatgaacatgtatgtatatgcatgtgtgtttgagtgttgtatgtgcatgtatgtgttacatgttggtattatgaatgtgattatgtgaatgtgtgtgcatgtgtgaatgtgtgtattgcatgtatgtgtgtgtgcgcatgtgtgtgtgtgagatatgtgtctgtgcatgcatgcatatgcacatttgatttgtgagtcctctctgggagggccatgttcctggagagagtgcatgggatcctccgctgtcctctcagggagagagatattttaaaggtttgagccattaggtaaacacgcctgatgctctataaaatatatatttacatataccattggggttaaatatatgttaaatgggtgcaaagctgttatattgcattaaaagtcatgttaatacttccttgttaaaggctttgtgaatgatttcctgcacatgaaacataatacaccacacagaattacagtgggtcagtggtgatatttgccaggaggtctggctaatga

SEQ ID NO: 59528 - DNA, 1476 bp, Homo sapiens
tttcccggtaggtgctgaaggaataattaataataataaggccagttcggagaaaacaaaaactcacaattacatatgtcacccggactcgtattattccagatagcccttctttcccacgaactcacagctgctcttcgttcctccaccgtagccacgcgtggagggagagctgcgggacctgggcctttccagggtgctgccggcctgcgttggtgacggccagcgctgagaagttagagcaccccataagtgccacggcaaagacttcggcgtctgttgggggaggaaagcgcttctttgagtgatttccacttgattatttacctcttatcagcagattgtgtggaaggatgagtgaattcagtgtaagatttatggagtgttcctgtaagagataagcctggctcttgttttcctttcgatctcgtatatttcatcgggttcgtttgattgatgtgttttgttttgggaaagcggctgaggaggagtcacgtgagtctttgctcagggattttccagtgtgggaatctggcgctgtggtttcgcgtagcgtttggttctggagggtggaggacgatgtcccagtccgcgtgtgcctcgtcacgtggcggcgaaagcatggattccacgagtcttttgctagagaaaatccaggcgctcccaaccaactgtgtgtgctttccttttggaaatgtctctaactcatatactgaacttagaatttatttagtgtttcttatgtgaagtttcctggaactactgaaaatattttccatgctagatgatcgcgttactggactcacacaattaaaactttttctttagattacataattatttattacctatcccccgtttttcttttcagttaaaaaagcaccacctagaacaatgtcctaatgatgccaccatgattagtgttagaatttagctgtagagtgaggttaataatgaattaacaatcactagtatataatataaagcacggttaaggtatatatgtatattttatgaaccatccaaagcaaaaaataaattagggtcaagagaactcacaggtgcagaagtgttatttttattttctgttttattcaggaaatttaaatctttaaagctgtttttgttttgttttgttttgtttttttaaatttcaaggtcaactccaacagaattgatctgttcctcagcagacctaggggagagtacaggtgctgaacagacctgggtatctgctagtcgcgattcagtagatattttcttgttagttggtaattaaaacatcgttataaaggttttaatgtactttttgagctttattactatatattccttcaggagtctgtgagaactctctactttgttttttcccgtctatttagtattaagttaggagttttaattccttctaccctgatatttatttaaaaattccctatatatttgtagatatatatttggttcattttaaaatgc

SEQ ID NO: 59529 - DNA, 1716 bp, Homo sapiens
atgcatgcgtgtatgtgcatgtacgtgtgtgcatatgcgtgtgcatgcatgcgtgtgcgtatgtgtgcatacatgtgcacacatgtacacacgtgtacatgttcatgcatgtgcgcacgtgcatatgtgtacacgtgtatgcgtgtacatgtatgagcatatgtacacgtgtggatgtgtgtgtatgcatgtgtgtgtgcacagatatgccttttcctttcatacaggctgttttgagtattgctgttaggcagtgacaactttccgtttcctcagtcagaaaatgggtagctcatcattaataaagatgaacattcgatatcaggaatccctaaaaacaatggaaattgtcatattaaatgaataaattccaaaacaaagatagtgttctgtactgtgtgtttacattgaactttcttataaacattggtatgaatgtttcccacttattggaaatcacatgactagtttaagctgaaacgtggaatattctgtcttcagatcacttttgcatatttatgattgatctgttctgctgttctggaagctctgaaaaccactcggtcttaccctagctggtgccacagttgtgagaattcagggaaacaaggtgtttgccagtttaagtattttagatgtcaagctgcctcttacctgcatcataaaccagtcttaaagaaagacacagtgtgacttgtagtggattatatcagttttattttctgtggctgaatcatcactctacattgtgaattaatgttatttttcggctcatcttcataatgcagggaggttctccagtgttgagtgcaggttcagtgaaagcgctaacactgttaccacgggcttaaacggacttgttttctgaggcgataaccctggagtcaggcattcagtgtctgcccatcacttggttccgagttctcggtcccctcttgctctcctccccccgcacccccttgcttctgtcttgtcttctttttgactaacaggccctctgcagatggtgtgttgggggccggggtctgctgtgagtctttgataaccttgggaaagaactttttctttggagcaagacccctctcaataaactttcagtagcccaactattgtccgttgtgtgaactatttgtggaaaatgctcagcatttttccttggattctggctgatctttctccacctgccaatttctcctcagtttgccgtgtctgtaccgtcaccaaccccgttccagccgcggttacatgtaaagtaattgaagcagagctctgcagatgagagagtgtgtgtcgccccccgagttcccttcctggcctctgagtgtgagttgtgttttgttccgagggatgactgaggctcctggcccctgttttggagcaccccacaccaaagtgggtgtaaaatgaaaaaagggtttatgctatattattgtaattcatggagcagatgataaacatgcttgaatctgaacagcagctgaaaatgaggacatgttaccagtttggatgttggatgaccttcttgaaaaaagcttttgtcatactttagaaactgtgcatgtgctgttttctatttcatacttagaatctgtacagtatgtgttgtatgaatgtgttgtatgagcgtgttgtgttgtatgtgagtggcatgggttgtatgtgtgttgtatgtgcatgttgtgttgagttgcattcattgtatgtttgagtgttatg

SEQ ID NO: 59530 - DNA, 1012 bp, Homo sapiens
ttgaaacaaagatatagaaaaaatcttataattgtagggtgccttttagttttcagccgctctcatgtggatcctttttcgtccttctgaaatgctttcccaggagacagcattgctctctttgtacagatgaggagactgggtttcaaatggttaggaattcatcgcaggcattggaatctttggtttcctggaacattttctattcaagtatagaccacgtggcctctaaaggctggctcactcttaacaccaagattggggatccagcctcacctctggggtgggcggcaggagctccacagccatcctgggtgctctggggtggggtggctgagctgtggcagcccctcccagctgagcagcaaggccggggaaagctcattccatcccccttggttctaaccaggtacaggcttacactgcacatttccttagctgggaacctttagaactttacatttaaaatctaatctgtgatccagggggttgatacatgggtattcactgtacaattcctacattttttgtacatgtaatttttttttatgtgtgtcatggatgacaaaagaaatgcaacccctccgagttagcttttctgtatagcaccttctagaatcaggaggctgggcagggtttagtttcatcagaaatctttatgtttctggtcaagagacggcactattaaattcttggttgtgtggtttctggaaaagaaatattctaaatgagttccaggaatcacctctgtggcatttctacaggaaaagtgaccactcttgaagcttcgccatcactcacaagaatgattgtgatggtttctaagcggtcgccagccaatctttagttcttttatgcagagtgctttcattcgaagtgaagtgcccttctgtttaatggtgacctccagttattacagggattgcagccgcatttgatggatgtgaacctgctcatctctggctccccagcctcgcctctggggtgggcggcaggagctccacagccatcc

SEQ ID NO: 59531 - DNA, 1105 bp, Homo sapiens
tgcggggagcatggacatggggagcagagatgggcgcggggagcacgggtgtggggagcatgggcgtggggagaacgggtgtggggagcatgggcgtggggagctgggcacagggaggacaggtgcggggagcatggacatggggagcagagatgggcacggggatcacgagtgtggggagcatggctgcagggaggacgggcgtggggagcatgggcatggggagcagagatgggcgcggggagcacgggtgtggggagcttgggtgcggggaggacgggtgctgggagcacagggtatggagagtgcgtgtgtgcttcctctgctctgacagatgctgccgaacacgtactctgtgctcagatgggtcagagcctcagtgcctcttttttaaaaaattctttctttttttaaagataggacttctctcttcctggtggccccttttagtcgatactcttttaagcctgcttttccagaggaaagctgggaaggatggcctatataggttccagtctgggcatatctggaagaatggcctgttttaggtttgagtctggtgtatctggggacatctttaaacttccactcagagttccagagccacctgtagggactccccaaatgtctgctgggactttccccactgctcggggatgatgaagagcaggacctcaccctgccacgacctctgaggtcctccttcctggagggcagtgccttggtggccagtgtgtgcaggaggctgggctggcaccttcgggctatgctctgcagcgggggctcatgacatgggcattcttgtgctctgcactgggactggtgacgtggggcatcctcatgcactggaccacgccgggtgcacatgagccagacagctcctggaattcggagcctggctctgtctcaggccacccacctgtctgtggcacttctgggggattgtggggactgtatgagtctgggtctccaccctcactggctggacacctggccaggctggggctttatgtttcaccatcccctgttccgagttgtgtgaatatttattttcattacctactctcataagctttcctttttaaataaaaaaatcagagacaga

SEQ ID NO: 59532 - DNA, 2343 bp, Homo sapiens
gattacaggcgtgagccaccgtgcctggctgtgtgtgttactgttagcacatatgaatacgtgtcaagtacagagacatggtcttcacacagcctgcacgttgctgtcgccaaagaggggatcctaaaatgatggcccagtgggaggtttgtaggttttgggggtggctttttcaggacacttggcacaaggtcacagatatttgtggctttggaatggagttctgccctcggcacccccagccctgtgcatttcttggaggttccaccctgcacagtgaggaagtcacacgcctgtgtaagagctgaccaggggaccaccttccagagcctaagagaaggtcctgaggactctgtacacattattttcattgaaaagaaatagtttactctgaaaaaacaaacgtgggaaagctgagcttcattgagcctcacggacagtttgttgtaactgagaggagggtaggagggtcagtgggttcaggagggtgaggacttcttggccaggtagcgttgttacatctatctgaaagtcacagataactaagtatcaagtcgtcacagatatttaagtatcctgaatgagatggctacctgcatgatgcattgaaaacatcattactggttgcgtgcaagatgcattgaaaacattgtgacctgcacagtggcagcactgatatgtgtgggcttttgaacgtgtggactggaatgttaagagtccttcagagttatgacaatagtttgatttgaatgttcttttcttggcgaataaatgctatacatcaaatttagccaggaagctaggaaagcgaacccacatgaagggcacaggcccataggctgctccaggtgccgttaggggcccgagccacgcgcttcccgctcagcctcctgagagccatgacggcgtctctgttctgcctcacactggacttgctagtttcatattcttgttatggttccgaggctacaagcggttggattctgtgagtcactgtcttcctcctcccagctgctttcaaatgggtcgtctctttttttagaactgattttttttaatcagtgatttatggggtgagttgtagcgctctcctgaactgcagagggagcgcactgaggaacctgggttttgatgctgtgcacattggctgagtcaccagcccagggccccgtcagtcccattattaagctcatttcttgctcttctcatcgttactcagacgcctttaaaaaagcaaactcctgcttgccgtcactggctgtttggcaaatgggtgtttaccctggaaagacgggcattttgtcctctggaacgtctatggcgccctttggtgacgtggtcggtttctgaccactctatcttgtgggtgtccttcctgcttccaccttcccttcccgaacgcctccacctccagggctttaatcttccttctgtgtgtgtgccatgcagggtttatgactattgtgccaaaaacttgctacatctcaaaagaagtaattgcatccatttgttggtgatgatcataaacagtgccctttaagggagactaattggtaaacccggctgctgtgggtagaaagacagcggtggctgcggaacgagggctccgcctcttcggagcctgcacaaccgtcctgccttctttcttcaatatccagtaggggagttaattttaataagcccttgaaagcaacaaggcaggaaagtgctaagacattgagttgtgagatttacaattacaaccagcagcctctcattttcccttcgctgggggttgctgcttcggttttgggctgcggggtatgttggtagtgacatcggccctttgtgctgcgcgactcatgaattgagataactttttactaagtgctttgtgcagtaggtatgaaaatggggaaagaaggaacactgtccagggtagagaggcgtggagagatgctgtgactgatggtaggtcttttcttttgggctcctggttttaaatcattttttgtttcgctaatagcttggaagatggtttttgtgtcttaattcaaagattgaagactgtgggccggacccaaactaattccattggcatcagagagagggattctttacatatttatctataggcacgattgattttttttttttgctgaattatctggttagtcaaatcatatattagagaagtaatataccattaaaaattaaaaaataaaaaatgtatctgtaaacatatcccccttccattccagtctttgtctctgtgtaattttagaacccttgagccatgacgtacatagagtttgtattcttttaatatcttgctacttcatcgttttaatgtttaatctttgg

SEQ ID NO: 59533 - DNA, 3021 bp, Homo sapiens
gtgggggtgggccggcgcgtctcacatttatatttggagcagtttagcatggtgaactttttttgggtaacggttttgtgagggccggcagccagaaagtaaactcattcgtgccaattttcaccggcagggaggagctggtgttgactttatgttttcctttttaacactttcagggcaaagaagggagtgagcaggggccatggtgtgcagccaactgcctttccagacttctggggacgggaaatggtactgtttttcagtttcagatgtggggttccgcgaggtgtgtcagtgtcctgtaacgtgacacagttggcggggggcagagtcttccaggcctgtgggcttggctgctgccctcctgaggagctgaggatgaggagggcatggctaggaggcgggagctgccgtgtgcagggttcggatgtaaactggtaagtagattgtgcagtgcagacagctcgtttggtgggtaaggagtgtatcatttgcaaaaggcccaccctggttatctgattgtgtcagccttgggtaggtttcccggcttgcgtctcggcccaggtgcacccctgcctgcagcaccctccgtgttcgctgtctcaggacaggggcttctgtgctgcctgcatcacactgatgtgaagtgtcagtgccccatccaggtcagcagagcgtagcgcccctgagctcagcagggcgagccccatctgagggttcccccacccactgctagcccagaagttggacccacatttgttcccagagtctgggatgtctatgggaatgggtgtcctgtgttgggcattgtggccttttgaggtgacgacacttgcctgtcagttgctcttggagggtgagtgatactgtcttgctgcccagatgatggcaaagccactttcgacgaaggtgtgctcagccgaattccctgtgaacaccttgcgtctgtacaggttttttaaaaagggcttaatgagttagtttcttattgagagaccaggcagagaaaggggtgtgtgtgtttgcatgcaggaagcctaattatatttttccttccacatgaatcttgctgagatctgagctacacatttaagaagaaagggtgagagggttgctccgtggctctattcagcctctctgcaccctccggcctgtgctggccccactgcctcatctgtttgctggatggtctttaactttgctgtgaagtgtgggtttgcccaggttgagtttatgggggtagtgctgtaaggtcatttggaattctctgtctcataaccacataaaacagttttacaggcttaaattagatgaatcaacttgttttccagtattgcttaatagaaatccaagaattgaaggatcaaaattctgtgtttctttatgttattggacttcaaaaattcctcaatgtatctgctttcagagtgaaagctgaaaacagctgttaatgctgaattatttcccatcttcaatcaaaattcaagtggagagaattctttaagttggttgtcatcattttattaaaatatcagaaaatattatagaaacatatgtggaatttccagtgctcatttcctacagaggaggatggaaaaagttccgttttaagcacataacatagactgaaggaaagagtagagcattcccctgaggttcctgtgtgggctgccagcctgcgtgggttacgcattgtgtgggtttctagaccctggtccagttctgctgtgcccgcctgctgggcgccattacatgcactgctggtgtcctgctttgcagggctgcaggggcacttcctgctgcggggccgagggctccatccttcttccactgcctgtccctgtcccgtgccctgtgccccctcacaggggaaggtgaggccagctcacaccacagagcatgcggccagcaaaacacaagggctctctgtggggagaagtgctgggcagccctcttgtgggagctgatggcctcgaatccatgtggggatacattcaggttgtgtggccaggggggtcatctcctcacatacttgggtctgagtgtgagccagggaggaggccatgcaggtaaggaggccacacggtcaggaggctgtgtgggtggggaggttgtgcgggtggggaggctgtgtgggtgcggaggctgtgcaggtggggaggccatgagggtgcggaggcccctcgggtgaggaggctgtgcaggtggggagaccacgtggggggaaggctgtgctagtggagaggccccgcaggtggagaggccgtgagggtgcggaggccctgtggctgaggaggccctgcaggtgaggaggccatgagggtggggaggcctccaggtgatctggagctccattctggggagggtcaaggaatgagagggctgtggcggctgctttctcatactcctttccccagaatattttcttctcccttctcttccctacatttttgccctttataattgggtattcttttttgtggctttaaagggcctaaaaataatttcattaataactgatactttacatggaattgccaaacaaattggagtggaagcagaaaacttccccataaagacaaactcatgtcttatttattttttaatttttgagacggtctcactctgtctcccatgctggagtgcagtggtatgagctcaactcactgcaacctccgcctcctgagttcaagtggttctcatgcctcagcttcttgagtagctgggattacaggtgcccgccacaatacctggctaatttttgtacctttgtagagatggggtttcatcatgttggctaggctggtctcgaactctttacctcaggtgatccgcccgcctcgacctcccaaagtgctgggattacaggcatgagccactgtgcccagactcatgtcttattattattattattattttaaaaaagattgcatttagctgttgattcaaattaggaagtaagtttctctgttgactggtcactgatctttttgggcagtgcatgcttcagaaggagctctt

SEQ ID NO: 59534 - DNA, 1052 bp, Homo sapiens
gggacagagtgaggctccagacccgggacagagtgaggctccagacccaggtagagtgaggcttcagacccaggtagagtgaggctccagacccgggacagagtgaggctccagacccgggacagagtgaggctccagacccggatagagtgaggcttcagacccaggtagagtgaggctccagacccggatagagtgaggctccagacccggatagagtgaggctccagacccgggacagagtgaggctccagacccgggacagagtgaggctccagacccggatagagtgaggcttcagacccgggtagagtaaggcttcagacccaggtagagtgaggctccagacccggatagagtgaggctccagacccggatagagtgaggctccagacccgggacagagtgaggctccagacccgggacagagtgaggctccagacccgggacagagtgaggctcccagacccggacagagtgaggcgccagacccggacagagtgaggctccagacccggatagagtgaggctccagacccgggacagagtgaggctccagacccgggacagagtgaggctccagacccgggacagagtgaggctccagacccgaatagagtgaggctccagacccaggtagagtgaggcttcagacccggatagagtgaggctccagacccggatagagtgaggctccagacccggatagagtgaggctccagacctggatagagtaaggcttcagacccagttagagtgaggctacagacccggatagagggaggctccagacccgggacagagggaggctccagacccggatagagggaggctccagacccagacagagggaggctccagacccgggacagagtgaggctccagacccgaatagagtgaggctccagacccggatagagtgaggctccagacccggacagagtgaggctccagacccggatagagggaggctccagacccggacagagtgaggctccagacccgggacagagtgaggctccagacccgaatagagtaaggctccagaccca

SEQ ID NO: 59535 - DNA, 3623 bp, Homo sapiens
aggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaatttttcttttgattttttttaaattaaaatttcttcaataatgcatcttttctaaacatagttttttgtctgttcccataagtgcatgagaaagaaacacgggcctcatatatgattggatcctaaagccttctcacctacgtgggggctggctgtggcacacggggctcaccctttgtgttttagtggttcagagtgagcattaacatcagatgctcatgcggagacagccattactgtgactgccaagatgtactgcaaaaatacatgttcctgtatcaggactttgattttgttaaaatggcactctctccaaagctgtgtccatgaagctgtttggagctaacgttgggtcttcatggtgatggactcatccttaggcagcagtgatgtctgcactaggaagaggctggcgggaggcggggcccctcctgtgccaggcaccgagtggatgggggactgatta

SEQ ID NO: 59536 - DNA, 1207 bp, Homo sapiens
gccaggggccctttccccagctgtgccccagagttaccacgtgtctgttccacgccacatgaccgtgctgcttgctaccccacccaggtctgcagagtcagtgtctcttccaccctgggctttagggaaggccccgcagtagatagaaccattcctcacttcctagggcagaatttaaggtggattttgatgcagtatctttacaatgaaagccaggtgacgtgtctagtccttttcatattggtagatggtcatgctcctgtttggagattgagtacattccaggattgtcacattagccttaaatttccacaccgtcatttctaaggtattagtgccttgagaagaaatgcagtttaaagatcatgaattctagttttccaactgtagcctactcccgttggtattgagtggaggagaagaggcaggtctccaaccctgcttcagaaacagcagctcctgctgtgcccagtttgagtcttgtgtaaggtttctcttgaagaaagaattgcttctttgaaaagcctgaccctgagccttatgccaccacccaggtgtagtgggctccattgctgcttcttgggagcttcttgagtcaacagcgtggcccttgggtttcaaagtggggtggaggctccagaaatgatggggttcagcccttcccctgttgacatggagctcgtgatggtcactctgacttgcttcatgacctgcagttgtggatctgcatttcatttgcattgggactgcacatatcctgaattaattagttaatttgtttatttaagatagagtcttgctctgtcacccaggctggaatgcagtggcacgaccttggctccctgcaacctccgcctcctgggttccagtgattctcctgcctcggcctaccgagtagctgggactacaggcatgcaccaccacacccggctaatttttgtattattagtagagatggggtttcaccatgttggccaggctggcctcaaacccctgacctcaggtgattcgtccacctcagcctcccaaaatgcggggattataggcgtgagccaccgtgcccggcccctaccctgaatttaaaatgagcttttacaaaaggagtcctttgccctcttgtttccaccaagctggattcctgctggtcgagcgcaggaattgcagcggattctggttctccagctggaagggctctaggtctgtcgtc

SEQ ID NO: 59537 - DNA, 1031 bp, Homo sapiens
tttttacaattatcttgtgactcacattaaaaactatgctgtagtaacacaacacttgtctgaaagtgagaaagtttaatgtctagactcaggctgccctgctttccatctggtgggctggagtcactccagagtgtctcccttgccttcagctgcccctgctgttcgtgagtgctggcagccatgggtggatagctctttggatgtcaccttagcctcactgtgtcctttgtgacacatctcttgggcagcagcatccttgagatttcagttttacagctctgctctagatggttgaagttgcttgggagaaccttcaattgagtgaggaagcccttgtctgggttgaatgatctgcttgtttctacagatattttccagacaggtgtggaaacgagaagctgcttggccttctctctccataccgtgaccctggggtgtcattctgttgcagagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaagggtaagggatatattgcatgtctaatagttgccaacagtgtctaggtacgggttccgtgtcaggcgctttgctgagctctttatacatgtttgtttttaatactcaagagaggcttggaggccacgtgattgcagaggtcacacagatttggagtaaggccagccttgaacccagggctgggccttctccttaacattgctgtctgatgaagtcagaggtagaaacgtgtgccatgatgtgccgtacacaccctttctctcacccagaaacttagattgcattgtcattgttgtagttcagacctgcctttattttataaaacaacagaatgaaatggaaacatctgaattgtattggaaatgattaaaatgtgtagtaatctacatgagacaaggagcaagaagcctgggag

SEQ ID NO: 59538 - DNA, 1070 bp, Homo sapiens
caactcctgcagcctgtttctgcgatgggttctgaagccagagctgaccttcgtaacctcctccttccctctgtcttgagaaagagcttgtgctgttttgcagggaggtgtgccaggccttgcttgccctgagaacctgatccacagcagccatgcctccacctcccctttttgggagggtttgttttgtttccattaactttctctattggaccaaagtgctaagatgtcctggagaaccccttaccagagtccagacacatgtccctacccttgcatggcggccatggcagggcacggcccagctgggttgaatggcatgaggagccccaggcgccaggtggctgccttggtggagctactgttaggatcagctgggggaagcacacctcttcagggtctcaggccttcacaccactgcattcagagtcgcgggtgtcacagtgatgtttcctctatggtgctgggaccaccctgggtcccttgctaccccttgtgagctgtaacccaccatggccctgtcactgagccttggctcagccaacctgctctctgcatgatgggcactgacagctgacagtgttctacggctgcaggtgggcttctgggtctgacacgggttacgtggagcccagtgagggtgtgggggagtgttggctgggcccactgatggtgactgggataggaccccatggcaggcaggtctgtgtcctggacaccgctgtgttccaagggatgggtgcccctgcgtcccagccggtagtgacgagcaggctgcccttggcggagggatgccctgtgccgagccctgcgggatgtcctctgcccatgtggctgctgtccctctgtccagcgctcagggcaatgcctctgggcaagcaggtgctgacaccatccgtctcacacccctcccaggtccccagggccagttgagtcctgtcccactgaagactctcatctggttgcatccctagctctgctcatgggtcattgtagccccacctttccactacttctgaatcctggcgcagcggagtaggagttcagctccctgggttttgggagcaccc

SEQ ID NO: 59539 - DNA, 1762 bp, Homo sapiens
aaggccctgtcaggctgtggttggatgaagccgagtgagcagcagtgggtgtgcaggtgctcctaagattgagaatgttgatgagttgtattaaagccatcaggaatcaagaactgttgacttcctgccagtgatggaggtcgtatcagactgacatgctaaaggttacaacacttgttggagcccatgcgctcttgaccacgtctttcctctcagtgcctgcttccgcatgtgtcagttctcctcgctggattgttgtaaggattggctgaaaggatgcacaaaagctccagcctacttctaaacagcacccattggtgataaaattgtaaaatacatgtctcagcatgggtcatgactctgacaacatcaagaaatgccctcagtttccacagatttgttggtattaatgaaattgaagtctgttttatggtttatttacttgtctgttttcaaatgaatctaggtaactccatttccaaatactggatttataaatgggtttacgtctccagcgttcaagcctgcggcgtctcctctgacttctctcagacagtatcctcctcgaagcaggcaagttccggggcggtcttagcagttttggtctttacgctactgcccttccggagttgggatgagagagctttgatcactagtcctgctcctcgcagacagagccacctgaagcacacagctgcattctgtaaagactaagcactacaatctggcatgggtgcccgcctcagattctctgagaggaggctttggggcaacttgtacacatcaggtgtgcctgattttaatttgggcctggactgaaaaacagctaagcagaattgtggcacattgttaatagatttgcattatcctatatgttaggagttaaccattccaaatcctatttttatactttattaaacagagagcagatttcagcttagctattccatgtcagtatgcatgttatgtaatgccttgatcattttataactcaacacataaaaccatttttatttacaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggtgagttgttgagcagttactgtgtaacatcataaactaatattttaaaaattatttaatttagatatgttttgtaattgtctttaaatatgtcacagaaaatctaactgaaggctataaacataagggttttatataattgctaagacttaaatggcttcatcttttttggaatatgaaatggttcagtgagaactgtagttgttttagatcattatttgtagaaacactggagctcaatagccatagactccatcccatgtgcctgcagtctcctcttggcagcacccctggctcaccaggcccctctgcaagggcggtgtccaggctctgccccatggctgctggcctggcgccctccagctgggtgtgcaccaggcactgcaggtggagcctggagcgggtaaccaggcagatcagcattgcagtctcatctcattggagggttgagactagccaggacgggtcttagctgtgcttcctgcccacc

SEQ ID NO: 59540 - DNA, 1830 bp, Homo sapiens
tggggtacacgttccatagctcttatgaggttattttaagggatctgtgacccagggagtgtcaagaatcattattctaggttctgttcaccataatttaattatatatttccctatttgagctattgagtgaactattggtgcctcttattcataaggttaatcgaatggaattttgtacttaattttgcccttaggcttacaaataccttcgagaagaagtcaaaacttttcaaggaaaaccaattaaggtaagcaagaccattggttatactttgtttatttgcaaattgatgttcttaagtattctaatagaaacttacatattttcaaacaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtacgtcatttctttactaggaatttatgttgtagacactatgctagataatttgaaggattaaaatcctcatctaataggaagccagatatgtgtgcagtctgacatactaaaacagaccttcaagttatgtgggggattttaaatgtagctgagaacagagcttatgcataaagaactttggattgctgtgagcacaatccttgcacagcccgtctcccctcttgtcatgcagctcttagcaagacgcagagggcgataagtgctgtagtgtacctggcgtcccctacacagagtacaatgcaagggggattaactgaggaggaagaggtgtttaataggcttctgacagcaaggccaaggagaaggcctgctgttttaccagccttattttactcacttctcaccagcattagagttggtcgacaggattaatttttatggattttggcctttgttaaggcctatggttggaattcataagtctgtactggatctagacattgtctctttgtgtgctgctatagatgcttgaaagatcaagtgcattctgggtgggaattagcatgagtttggtggcattggatgcacgagagtcagcaatacacggatgagcatgtccttgaagctgaagtctagttgagaagtgaagatgggttcatggcctagaggtttgcatgaggtagcaatgcaggttagttggaattggagagattgaagggtagcatacatagaaggttatggtcagaaagcagaaattgagttagtaactttgagaagagttcatgtccagggtttcgctgtggactaagggaaagactgagtggtcctcagggtcggatggctgggagccaggcaccctgatgtgcagggatgtcaccgctgacaggcagaaaaggagggtaggtgcagagcagagagaacttgagaaaacaagtgcctgtatacacggaaagtaaagatacgggtccatgaaacaactcaggctggaaaagtcaaacatgccaaggagacacgtgtacagaatgccagaacactgacaggtcttatcagggattgtgttgtcatctaggttgagcttttcaggttaagtatgagtttttcagaaggaatcaaagagaagtttcatgaacagaagatggtcgtagattcatgggtgtctgagctgaagcgtacaccgggtggcagggagttggggaacgagctggcagtttccaggcctaactgcgcaggtgcttagctgtcctgaggcatgtgggctttggcctagtgcttgtgggaag

SEQ ID NO: 59541 - DNA, 1708 bp, Homo sapiens
gtgatttttgaggagatgctcggagttttaaattttactttactgaatatttttgtattctaataaatattcttgagctttgttttgaaatgcagtgaagttacctggaaccaactttctaggtggaatcagagcagccttttctctagggctcattttccccactgcggaagcagtgcccttctgagcactgtccctgctatcctgtgtgtttaggagagttttccactgtggccggtgggaaaacaaaccattcctctcttggtgagccttccctgggcttgttccctctcatccctcaggcggttgtttcccaggctgaagatgtggggaaggccatctgcaggcttaccctgccggctctgcggcccaggcactgaaggccaactcccctgttcatgtccctctcagggatcacactcgtgttcacgctggggttcagggcctgaaactgttcttcatgtattttgtctttggttttttaattgagtcatctgggagagtaaatctagtccatcatggccagaagcaaaagtccaagcaaattttttttcttaaattgcctttaaaaaaaaaaaaaaaaaaaaagttgtgcagttatcagcccagaacatgatatgatagttttcacattaatctagcttaatggtatcttgagagtaggggaagctgtaagttgtgtgactgcttttctctatggcattgtgattctgattctggaagccctgctgaaccctcatcctttttggaagagagatttactaggcatcatggtacgtttgtttaaggatagttccttaagagaatgcatttgttaaaaaaatttttggtgaggacaaaaactgacattgttgagaattaatttctaacatctctatttcctgtaggaagtagaagcactatttaaaggagataatttaccaaaatttataaactgtgaatttgcatataatgataattggtttattacatttgaaacagaagctgatgcacaacaggtaagttctttccaccatcaccctatgaattgcatagtttaccagtttttactattagtgcatgttgggactaaacttgggcattgagattacttgtgatggtaagtttgaatataatctgcagaggaaatcaagttgtagaaacttaaatatttgagtgtatttgtatggacaatttttatagcaatataaaaagcatgtgattttactttctaaggacaacaagctaagcaacctaggaaaatcagttttgttcttctatctgggcagagaagttttactatttgcaaagtgtttggggggaaatttgaacctaatcttcatctcccagcagacttcattgtattttggaagatgcttttaatggtattgagaagtaagctctgtaaggaggcgtgaggagttagtagttttcctgcttttaagggaagcatcttatttgtgaggaaactaacgcacatattataaagtgttaaatggtataaacagtatgtggggttcagaaaagaaaacacagaaacctgaaagatgggttttaattggatggagggggaaaaggggaacggaagatagagtaaccatttttgtggagtggagtgtgagctctgccagcccgtgtggcgaatgtggtcggatgatattgaatcaggtgcagggccttcacagttttataggggtttaatgtagaattaacatggagaagaacaagg

SEQ ID NO: 59542 - DNA, 1413 bp, Homo sapiens
ttcttgtagggtgagctttggtggtttatgtcttttaaggaatgtttctgtttcatgtaatgtattagtgtgaactttttcataatattccgttgttatctttttcctgttgatagaacctgtaatgatgttgccactttcatcctgatgctggtgatttgtgtctttgtgacagtgggcacctctgagccctaattgtgatcattacttgctgtgactcgaatctgcgcattgcgtaatttcttagatgtgatgccaaaacccaatttatgtaaaaactggcgaaatctaaattaggcctattactgcagtcacatgagcatcctaatgtaaacagtgcacgaccgttaggtgagggatgatcatcagggagccagggaagggcacacagaaacaagttatgaaacaagattatctcactttaggtactggtggaaaggagaaagccgttaaccctgtattttcatctgctcttagtgcttgagctgtttagaacctttgtttcatagtgttacatacattatggctcctgcaggattttaaatgtccatattcctgagctttgaaaaatctaacgtgagattggtttactttgcccatttgcaggtttctttagcttatttagtaatatagtaatataatgtaacacattccactggcatatcatattttaatatttttgtttcaccattgatttttcttctctttgtagctttacctttagtccaagtggatgaaaagggagaaaaagtaaggccaaatcaaaatcgctgcatagtaatattgcgtgaaatatctgaatctacccccgtggaagtaagtaatttctcctctgaaggttacttggacattttcccaaaggtctttgttggttttgattttattttacttttgtgtttttttgggctgtgtgttttttagactgagtacttacattaacactgttttcccaggatttacacacagtgagttacagagtaggagggaatgataaccaaaccttttgatctcaggactccttataataagatagtgaaggtttatgcatttctatatttagaaattaaaaataacacatttaaatatttatttaaaaataagattagtaaacccataaataatgaaaaagagcacttttgtgataaaaaaaacttttcaaaacaagtatttctatgacaaaggggcatcgtgaataactccctgagccaccagtgcagcctggtccaagccagcacggccactcttagagaactggtaacttggggagtaattttttttttttttttgagatggagtcttgctctgttgcccaggctggagtgcagtggcgcaacctcggctcactgcaaactccatctcccaggctcaagcaattctcctgcctcagcctcccgagtagctgggattacaggc

SEQ ID NO: 59543 - DNA, 1067 bp, Homo sapiens
aggctggtcttaaactcctgaacccagatgatctgcctaccttggccccccaaagtgctgggattccaggcgtgagccaccgtgcccggcctaacaaaattgtatgcatttttaataaactcttaagctacttcttaggacaaaaatgacagctataaataattacatcttatttaaaaataaccatcttctcataaattttgattgtagaaagtacagtatacttttacttttgcactccctgcctctccaaggccgagattttgcaaaaatgtacctgaggctggagagacagcaaataacagatgggtcctgggctgagatttaactccaaagcaataccatgccacactcacgcctcttgtgaaactggaattacagtaggtgaaacttccttttaaagaaatactgattaaaagagattgttttctttcaacagggagaaccttgctagtgacatgtatcttatatcacagatggatagtgaccagtatgtgccaatcacaacggtggctaacctcgaccacatcaagaagctcagcactgatgtggacttgattgtggaagtgctaagatgtaagtaaatgacaatttaaattaataatacttgtccttagagtatttgtcttatcagcatgaacctttaaatctatagccatcaaacgttaaggtccttgatggcgaatcagattcttttctggccttccgttcctttctgcccaggtccaataattctggagtagcgcctgatagtccctgggaatgccagttgaacccgttatgaaacctcaaacaagttttgggacatatgaagtagaaaagaatcttgttaatggggattttaaagatagctgtttcattcatgaaaaacaaaataaaaataacatttatagttaaagtaaaatacactttagttacagttttaccactagaggtttttctttcaaattgcaacttcctgtttatgttcggatgaaataattattgcaatttttcttaaaattatgttgtgggccaggtgtggtggcttacgcgtgtaatcccagcacttttggaggtcgagttgg

SEQ ID NO: 59544 - DNA, 1878 bp, Homo sapiens
caacttcttaacttacctggctctactgtgtcatgttatagtggatgattctcttggctcctaacttcacagtatcctagtggtcttcccaccttgctggctgtgagcctgtgtcccttggccctcatgcgcttgcctcctgctgaaggtgggagtgtcccgggttcagtcctgggctgcttttcttccttcccttgtggcttcggcaccacctatcgcttggagagtcctccctagtgccctgtcctcagtgattgcattatcttccggctggtgcctgcacagtctgtctacaccatggaaccagagagatattttcaaaatgtcagccttgaattgattttctattacgtttaggttactttaacgtcctccttgatctcactcacacacaccggcctctgtgacctcatttcttactgtgtctgtcacccctcttctcagctgtgctggcctcctactgctggactctaccccttgagaggccccaccttgggacccctgtgcttgaggctccccatttagaacacacttcccaccttcctgtgtgccccacccctcctctatcagatcatatggcacttcctgtctggatggcaccaggccttgctgcccctcatcctgggttgtttcctcagtgtccgtttctctctgacatgatgtgtatagttactggttaactgtctgttatctgcctctcccaccagagtgttggcttcacgagagcacaggctttgcgttattcaggctgaattcacagagcctgcagtagtgcctggcacttggaaatatttagtaaatacctattaaacatggggagtggagtgtgaatttagatgagtgacccggagacaccttagtctagatggacagtggcatcaggttgtgttttcaattttccattttcagtctcattgagtcccatgatttggttttgtgttatggttactttagcagttttggtttctttttgctgatgggggtggatttttactaagctcattgtataacaccatacaaactctctatccctctcatttgtcctgaacgccccactttgtctttgccttttcatggtctttaactttgacttttaagatacaagtgtctcttgtgttagcatggctcttatatgattgtaccatgctaatttatataggaaggcaggaaaaacttagttcttagcatttcagtgcctgtcatcgcaacattattaaaatacctctttatgcagtgtccggagtccagcagtttatgcagtgtcttctagagctccaaattcacagccctgtgctgcctgtgaccacacacaccatgccctctggcatcttcttagaaatttcttccaggatttagaaccagcttttgtttcctcttgaagatctggtttatttatcattctcttacaggaattctgtaacatgacaattctcacttgttccttcgactctggaagttggaaggcaaattgaagcctctgttgtagaaactgtctagtcctagagcctgtttgatctccagccttggttttttgctggttatctttgttgttgttgttttaattttttcctctgtattttattattgtttagggtttgtgtttgtgtaggttacttgaaaattctttttgcagtgagacaaggcattaactaagcttacacttgtcatttctggtagaaaaagcccctgctgaactctgctaatgagacttagattatttttctaaactgtgctgtttttgttttgggggataaagggataggtttttttgcatgatttacttttttgataggtaaagtagcatttttcttacttaggatacacttacgtagttgtgtcagaacgtaagttgaaagcattagaactgctgtactgaat

SEQ ID NO: 59545 - DNA, 2389 bp, Homo sapiens
gggagcaggaacgaacaaaccacatcagctgccttctctcagtttcagaaatagtttcatgttttttactaccagccccatcacctgagccaatgtggatttattctgtcttttaaaaattgttaatgcacccatcgtttatttgacggctcatggtggtcctttccagcccttctcctgtgttctgggccgcagaaactggtgtgtctatgctgcatgctggggtagtgcagtgtaactgctcccagcttgcagcctgattccaaggggcaccggggaccagggacctgtcccttcctccagaagctttgacttcctgcactgtggtgtgaaggtgggtggcacatttgaaaaggcaaatcatgtgtaagtttgttgaaggattgtgtgtttggacatttgacttttctttaggctttggggagtgcttgtgtaagcataagaaaggcttgtatcagaaaaatcaggggagtagggagtatccacatggtgggggacttttgtgggtttattcgctgtgtcaggaaggaccaccagtccccagtctctgggcaggatgttctggacagacggacgggaagagcaaaagtgccagtgtgcccagagacagcaaggaggtcagtgtgcctggaaatggacaaggccagggagcagtgagcacaggagggcgctgtggctgcagtgggaacttcgtcttttactccaaatgagccaagctgatgcgggagggttttgagtagaggactgccctgtgggactaactgagcatgcgtgactgtcatgatggccgatgagcttggtatgtgccaggcatcatgttgttgtgctgtcttccaggtgaggtttagcccatgttccacagctgtccatggcagctttggcctcagccccagtgatctgagagtccgttgtccagaacactggactagcagcttcatggtcacctgtggattttctttcaaggtgatactgaagctctattgggaatgggaacaggtagttctgtgaaaaatatgagatattttatcttcttcctcaaaggatgcctgagctttcttatcctgtagtatccctgacagacctgttagaacaccttcattcttaggagcaattttcatcttctacaccttttgtttatgtgactttttgaagctttctttctttcttttgttttagagatggagttctgctctgtcccccaggttgggtgcagtggtgcgatctcagcttactgcaacccccgcctcctgggttcaagtgattctcctgcctcagcctctcgagtagctgggattacaggcatgcgccaccacgcccggctaattttgtatttttagtagagacaaggtttctccatgttggccaagctggtcatgaactcctggcctcaggtgatccgcccgccttggcctcccaaagtgctgggattacaggtgtgagccgccgcgccctgctgacttgtttaagctttctaattagaattttattcatctgccttgtattcaagtttgtaaaaccctgaattgtgattttattaggagtctaggaagtcaccagctattcctcaggtatagtttgtgaaacactgaatcttttggtggcaggcgtgtccttccccatctctgcaagccttggtcttgggaggaggaacttaaaacttggggggaatttaatggaattctgactgctttttttttttttttaattttgaacctgatttcattccaaaggtgtgtataaatacataggctgagcctttggagcctatatctgatgtctcttaactctgcattaatgagtaaaattgtatttggttgacatttggatacaaatgtctatcttacatttcttcctaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggtaagttgagcatggccgtggtgtgcagccccctgctttcaggcctgtgcttttgttgccattttaatctgtctttaagatgttgttcattcataactgtgtcatggtatgtggcagtgcttgagagcccagaggtcttttacagtctaaagaagttgagtcactgcaagtgtaagctttgttttaagagaaagttatgcttctaaccctgcctttttggggtaaactcctaattgtaggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggtaaa

SEQ ID NO: 59546 - DNA, 1021 bp, Homo sapiens
tgctccttaaatagttgtggaggcaaaacagtataaaactacatctttaagataatctgcagttaatcttttacagaagtgacataattttcagttagttaccagtgtcactgcctcagacatcaacaaagagcataaatgatgcctaagtgagaggtgtgcttccagttttaaattagcttttccattatgaggtattcccaaacagtattctcatacgaagcgttaccacgtttaacgatggtgccttgcctttcagagcttcaattttcaaagtgctgttacaggtgtctttttttttttttttttttaagcaaatcttaatatagcagctattactccatttcacaaagaactggaggtagagccttgtatggttctgaagtcagcaaattgccctgaattactaagctttttagtgcatctgtaggagtggttggtgcttgcatggaatgtttctttcccctatttctcacctgctttctgtacctcaccggccagtcccccttctccagcattaattactccagttcctagtcagtaacttgtcagagagactgttctgtctcgtatcggtagttatacaagcttattaattgatacgttatttttcaaagtggagcatattgtttcgcacaggatggggtggggtggaagggtttatttaaagcatcagaactcaggcatgttcactttggaatgtggctgttaaggtcagcttgcctgtggttttaataaccattgcttagccatacatttttaatggaaaaataagacttatagtcaagcagacgacactggagttttttttttttttttttttttttcaaggatggagtcttgctctgtcacccaggctggagggcagtggtactatctcagctcactgcaacctccgcctcctgagttcaaatgattctcctgcctcagcctcccaagtagctgggattacaggtgtgtgccaccacacccagctaacttttgtattttcagtagagacggggtttcaccatgttggcca

SEQ ID NO: 59547 - DNA, 1055 bp, Homo sapiens
gtgggaaacaggtacacaaagacatgaggcagtgccaagtcaggatgtactctcctgtgttagttctagtgcaacagagaacgctgattttgaaactaatcaaatagaaaaaagttatgaaacacaccgagtatacgactgcaaatataatgttcttagtgtgttaccacatttcagtccaagtgttaatccagttatacagaagtcagaaatagtagagaattctgttagtggtggtaaaagcccaaaatggaagggaatttcctctgaatcaattgaagaagcttctggtatctttggtaataatacatcagggttgagtaaaccaaaactaacatgtaaagaagaggaagagagactttatttggagaaagatagtattgaccccagaattactgactgcctgggtccatgtgggacgagtgaacgtgcacaccatttcaaagaaggaaacgccaagtccactcttacacagtcgactttaaatggtgaaatgggttttatgggaaatgctaaggtgagttttgagaaaatagagtcacgtgacactcccagtggcaatttctttctggttggtgttgatcccaccctagcggacagatacacaggtgccccctgcgatgcagcgcaggggattcccgctgtccccgtggacagcaaagacacgattgtaccaagtagtggccacattttatcactcacagaaggtgtcctaaatagatgtgaacatccctcaaaagtggattggcagagtttcccagaaggagtctcccgttttttgagtgaattttcctattacccgatgggagggttaggaaacccagcattttctgaaagactggccagtggttgtggtggatatcaaatgggctatctctggactaatacagtcacaaaaggtgctctagaaggtgaaacaatatttagtgaggatctgcaccataagccacaggccttggaaattgctttgttttcagaaaacactcctcagctaccggtgtcagaggacggtgttgtttggggatggcatgatagagacggacagttcgtaagta

SEQ ID NO: 59548 - DNA, 1548 bp, Homo sapiens
gtcattaggatttgggtttgagtggcaggaacatgtgaccgctgtgcaaggggttatttttggtctctgggtgttggcttctcctcagaaattatagcaagttactgtgaggtgcgtctgtggaggcttgggaccagcacgcctgtcgtgtgcttgtgagctctcaaacatgggctgctgcttcagcagagaactaagtagtgacaatgacagtgaaaaaactggcctgttacaaaaatctgtggaggaaaaggaaccagaaaacaagataagtaaaactttgtcttcattatttgataccgtcaaaggtgaggaggttcaccgtactggcagtggagccagcagtgtagctggcgttagcgcgcggacaaggattttcgcagggtctgggcacaaacagggtcatagacccaagcagtcattgaaccctctttcctcttttatatatacattctcaacaaggtatgaaaacttgggtgagaatgacaagaattcagatattgttgttaatgagcagaattctgagggggtctgtgatctactgtgtgtgggtaacggcagccgacaaggttgttgggaagatgaggagcttttctcatgtgtgctggtgccttctgaccgaggcctgcaggaggaagcctttgtgagtggccatctgcactgttacccagctacttgtaaaaactctttagtagagaaagaaatggtggtcagcgttcacctcagcagtggtgatgagagtaagtctttagacctatccgatagggagaggaaagatggaaaccctgttggtattgatgatcagcaatgtcaggattcaggagagtgcaagtttcacagcatttgtgttgccgactctgcctgcccaagcgtggcagaggagctgggcacctgggtagacacagtagctgcaagaggagagtgttgctcttcagtgccttcagcctcgcgtgccatgtcaggggcgggcgagccagagccacggcaggaagaactctcgccttgggacacgctgggtccaggtgaaaggacaggggaatgcagtgggaaagccaagccttgccctgagcctgtggcgttcagccatgcaccttgtgaagcaaacactgataacgtgcagatggaggctttacaggcagaagcttgcactgaattccctaaaaattacgcagaaagtagtgcactacatggtattgacctactccctgaattaaataacaacatggacagtgactcactaagtcatgcgtgtgtcctgggagaaagtgagagctgtaactcaggagtaggaagtgagatggatcatccacctggtggcttccgtactgacactgcacattcacctggtagcttttgtactgacactgcatgtgttgcagggagtgatgacccggaggtggtaacagttgttgtcgaccagagtttacattctaaaaaggagagagaaaataactctatcacaccactaagagacaacgatgatttctacttggacgttaacaaagcagatagtatccttcctgttggtctagatagaattgatttaag

SEQ ID NO: 59549 - DNA, 1006 bp, Homo sapiens
ctactgattttgaagtatatcgtaccaatagttatgattacagtactttgcattaagtttacctgagttccaggcagggacagtgatgaaactctcgattccctcaatatatcagaaacaggaaggaatctaggacgcggagtggtcagagggatgggaggaaaaccagaggacagtgtggggtggagatagaggcagggaggctgactcaagtgaagtgtagtaaggtaacaaagcgaggggtcagttgtgaccttagcaagagtatttcccaggactgataggagcaaaagccagattgcagtgggtgagagacaggagtggtagacacaacttagacggtgacattcctcctaagatcttggctttgaaggtaaggtgatagaaggcgagaggggattgaaagggttttgagggtgtttatgatgaagagtgaccactggcagtgggccacagcgatgggttctccttcttgaggaagaaaaaatatctgaccactggtattcagcaacagtgtcgtttggttaaaggttctttaccttccctgttagcgccacaaacttcatctatagcaaacatcattctcagcggctttttgcccctcctgaagcccactcagggactccagttcttactcctgtgtgcgaccagccaagtacctgcttttcccttggagacactacatcagcctggaaaccattttctgttgaaatgatcctcttgtgttttatcataaatcaacagcaggtttgagagaggaatgtgagtgaatgatgatgtttaagggacaggtaatattaggtagaagtgtttatgttaaattacctcctcagaagaaagatgcaaagtcacagcaagtcttttctaatcatagtgtgaaactggaaatctgaaattggaaatctaactcatcctcatactaaactctatgtacaattcagcaaaacatctatatcagaatgatttttttttttttgagtcagcctcactctgttactcaggctgg

SEQ ID NO: 59550 - DNA, 1088 bp, Homo sapiens
ttccccaataattagtgatgccgagcaccttttcgtatttctattgccatttttctgttgtcttgggaaaaatgcctgttcatgcctttgatcattttttaaccaggttatttatttatttatttattttgctatcgagtggtgtgagttccttatatatcttggatattaagccttcaattttctgttttttaaaagacttgagtttccaggcacaaatgggtttatttgtgtcagcacatgagtttccaagttttagagtgtggccatcttcaccaaaatggtgtgaagaagaaacttacttatttaaaaaattaagtatcacttcttggtgagtaaggtatgcatatgggaagacttctttaaacttttttgaattcagagggataaacgtgtgtcctggaaaacttgaggattttaattttatttaaataatcatactgtgcccttcaaatgacctgtttaatgtctttgccattttacagcatcctgaggttagcattacacttctcccagtggagcccatgacttctgatcaggacgctaaggttgtggctgaaccgcagacgcagagagtccaggagggcaaggacagcgctcatctggtgggtgctgtcgaatggggtggtggggagtccattgctttttttgataaaggactctatattggagttagtaaggagttctaaacaggaacactggcacatcttaggatctgcatacagatattagagtctcgtaggggagaaaagatttcttacccatctgaggatcatggctgagacccctgcaacaaaagacagatgaacaagagaaaagcatacacatttatttagtaataagttgtatgtgacatgggagcctccacaaaggaagaaccaaagaaacagggaaaactgtattttttttttgcgaagtctaatgcagatgttgacagttgtggagaagcatgattggacaaaagggatgtgacctagagctaataaactggagaagcttagcaaggctgttgtgttcaggtttttcttgacatccctgtgtgttactgctcctggtacagagcagggcccctctggaagggtcttcag

SEQ ID NO: 59551 - DNA, 1047 bp, Homo sapiens
gttaaggctttttaattctgtggcaataaaaatagctctccttttaaatatcttttatttgctatagaaatgaggtcgtctttcttgcctacattttggatttagatgatggctttgtgctggtgtgatttaacatgtatttccctagaattccctttaaattgggagtaagatctagaggtatgattaaatacaggctctttttttggcacgactactttgtggatggtagtctttgatcatgtcaaaaataaaatgcctagaggcccagttttaatgataatactgaaaaatagcttcagtcaatgtctcacttaaccatttggaaacctcccatcacgttcttcacttgataatttcagcagacatcaatgattattgactttattattgtattagatattgggatattttgatttttccgatcctgtcattcactccccattgactgtggttcttgccctgatcagctttttggttattcagaaatgcagttcatcgaggaacagcagcttgaaataactgttgtcctttagtgatcttgggaataataagtgggtgtcctgtagtcccaaggcgagcactgtggtggtggtagctctcatgattgctgccgacttgttttccgttcattcttcctgatcctgatgtggctccgtgcatggctattgggaatccctcccttagtttgctgtggcctctgtgtcttcctgatgggaccagttgtcttcatggcttcctgcttcatggtaagatgtcccaggctcatctcaaattgaggaacattctacaaagtaattaactagtgctctggaaaagcgtagatgaataaggcaagactgaggaactgctgcagtttaaaggagactcaacggaaggacagctaagtacagcatgaggtccaagatcagagcccagaataggaaaaggatatcagtggtaatagtggtgtattgcaaaggaagcctgtactgtagtttaaaaagttacacttccaattttaaaaaatgaccacgtggagtttacttagcttctttaattttgtat

SEQ ID NO: 59552 - DNA, 1232 bp, Homo sapiens
tttttttatttttattttttgagatggagttttgttcttgttgccaggctggagtgcaatggtgcgatcttggctcactgcaaccttcttctcccaggttcaagcaattctcctgcctcagcctccccagtagctgagattacaggcgcatgccaccattcctggctaagttttgtattttttaggagagacggggtttcatcatgttggccaggcttgtctcaaactcctgacctcagatgatccacccgcctcggcctcccaaagtggtgggattataggcgtgagccactgtgcctggccatgattgtgcttctgatgatttgatttagcttctgtgatcatttttttttttttctgatcaatttatgtagcttcaaagggatcaaagtctgggtggtaaactgttttctacaaattttgtttggacattgaaagtaacacattttgattttttctaattgattcccaaggagattatatagtacttaattaaggcaatctctaaagttcttagccctttttccttatttaggtaaatttctgtttacttatctagttgaatattcatttactgatttttgtaaaatggtctgtaaaataaaattatgttggagttcttggaacacatgtctgtctaggagcatcttgtgctgtccatctctgttcatgcgtcatcccttaactcattgttcctaatcatagacaattagagttagaaggtaacttagcaaactttacaaataaagaaatggagtacttagacaacactgtagtaaaactgcatatatttgaatgttactaacaaaaggaagaagatcaaggtaagttgtaatatatcattggtgggatatgtatttctgtcctgttctcagtatcactgtgtgtagatagaagataaaacacagggatacctgtgttccaggaaaaggcaatagaatgtgcagaacatggcaaatagaacagggagtaatctgttgtgagtagggagttcctgacttcagaataatgtttttagattcaggagagaggttttatatttggctcccatacagcacactctcatgggaaatgtctgttctaaggtcaacccataatgcaaaaatcatcaatatacttgaagatccccgtgtaaggtacaatgtatttaatattatcactgatacaattgatccaataccagttttagtctggcattgaatcaaatcactgtttttgttgtataaaaagag

SEQ ID NO: 59553 - DNA, 1015 bp, Homo sapiens
gtttttttcagtagaagcaccgatgtacacatataaaggacattttacaaaattagtcttgaaatttattggcaacatctccttaggaatactccagtgctgagtgccagtttaaatgtataaacaactactctactgagattggacgcatttcttttatccgtcagtatctttgagtgacacacttactataagaacatgaaacgaaaagaatggaatatcatagagatactgaatcttgaaaaaaacaaaagactaaaataacagttttgttggaagcagcagtctgttgctctgtaaatgttcccactattcaagcttacagattcacttgagtatatgatgtgtataaggtacatggaaggaacataaaataatctgccctaaggtgctctcacattattctattgtaagataaaaatgtgcatttcaaatattacagagtggtgctggcagccgtgagataaaccatatcatccaactaacagcacaaggcagatggatgaggaactagaattcctattgtattttattttctgcacttctctatttagatatgcacgtgggaatcataatgaaaatttctgttaagaaatatatccttctgctgggtgcggtggctcactcctgtaatcccagcactttgggaggccgaggcgggtggatcaggaggtcaggagttcgaaaccaggccaacatggtgaaacctcgtctctactaacaatacaaaaaattagccgggcgtggtggcaggtgcctgtaatcccagctactcatgaggctgaagcaggagaatcgcttgaacccaggaggcagaggttgcagttagccgagattgtgccattgcactccagcctgggcaaaaagagcaagactccgtctcaaaaaaaaaaaaaaaaagaggccaggcgctggtggctcacacctgtaatcccagcactttgggaggctgaggcaggcagatcatgaggtcaggagttcgagaccagcctggccagtgtggtgaaacatcgtc

SEQ ID NO: 59554 - DNA, 1061 bp, Homo sapiens
atatattctaaacagactagacaaaagagacaactagcttttcaaccaggtaatttaacatctgtattaaaaagattttatgccaggcaccgtggctcacaccggtaatcccagcacttttcgaggccgaggtgggcgggatcacttgaggtcaggttgagaccagcctggccaatatggtgaaaccctgtctctactaaaaatacaaaaactagctgagtgtggtggtgcacacctgcaatcctaggtacttgggagactgaggcaggagaatcacttgaacctgggatgtggaggttgcagtgagctgagatggcaccattgcgctccagcctgggcaacagagtgagactctatctcaaaattaaaaaaaaaaaaaaaaaagattttatgtttctgcttcaacttgaggttaaatgaagtgaacgtgctgcagctgtgccctgcttagactgcagattttggttttgatgcttcttggtagtccagtatttgacaaaggaagctgtgtgaattagctaagcttgtgtcctaaaaagatactcctaatgtagttgtcaacttttccatttgcttttccctttgtgaaagtgtgtgaaaaggtgtggaaacccttcctaagaagctctttactgggaaaggtgtagcacgggataaaagcaagaagtggtactccgagggccatgattcgcactgctgcagcttagggcttgtgcaaaacaatgttctgtgcatttggttcagatactttatttcagcttctttacaaccaagtattagagtggtggtttttgagttcgtcaaaggtttaatgagtaaaatgctctcctagccagagggttaatgagatgatctaaactccagtttcggtggttgttttgtattatgttttagtaagaatcctagctaaaatggtcttttcaaaagattgtactctccagaagataatgtcgtagacccagtcacaggctttaacggtggaggggaccgttgtcctttttttgtgtgtcgacttagtagacacgttctaaatttaaaatcaggaagattttgaaagtata

SEQ ID NO: 59555 - DNA, 2848 bp, Homo sapiens
aatacaaataattgtttcagtatgtgtttgccacttcggaacttctttagtgatttgttttgataatacaataaaaatttttagtcatcactttgtatttaactcctttgtatgtttagatcccaggtgcacacttaaacggacatgcatgtatgcatatacaaagtctagagaataaaataaaatgaaaatgaaaattaactcaaagtaattttgccctcagctgtgaatattgccttttcccttattacaccacttggaatgtgcaccagcagaggccgttctttggactcatcccattttctgggcttcatattttaaatgctagttaatttttcccacatttgttgccacaagataataaattattaatgtatttactgagattttactcgtttaggtactgtgttagggatacaacagtgaacagggtagacatatttctgacctccgagtgataaaacttttgtgttggagtgaggatgataatttgatatgctgtattcctgggtgtaaaggtttgcaggagtacatagaataaccaaccaaggctttgtgggaggatggggagagcatctcagtagctgtggttcttttcactttatcctggtgcagcctgtcagaaggtttcagttgcgagtccctcgctttagggagggcagtctggaagaatctgtggagtttggggaggtgggaagaagggagatgctttaagaaactgggtggtaattcagttcagttggtggttttctgcacagtttcatgacagggatagaaacttgagcagaagttaaagctgtatttgcaagtttctgccttgggcacctgagtcaatgatatgtccttcaataagagagattggttatcagttcgtatttgttttaaatgagaagtagggaattgattttgagaactctgcaggatcataaggtgttcactgggcattcacttagataattttgtgctgaaactgagcatatggttgtgaacagaagccatgagaaactgggagcacaggagcataactcaaggagacaaggaggtagactcctttgcacacataccgtggcctgtcaccaggatcaacgctgtctgtggatccatgcatacctgtgggttgcaccacactggcgctgggcttctcttcagcagggctgttccctcttcccaccagtggagttgtgtgcttaccaaagccaggtcagcttccaaacttgttcatcgatcatactcattcgtgcagctgtgtgatttaattaatataaattgatcaaaatagtgtaaaagcagttactcatttgaaaactttggagtatctcaaaaacaaatcacagagaaactgctgatgaattagatatgaaaataaggataaaaactgaagaagagtcatagaagcattgtactattcagagggttttcctgtctctcagctgcactttaaaaaacaatgaagatctttgttgatgcattatggatatagtttatgtgggaaagaaataatatctaattgaccaagtctcagaaaaaggcccgtgtgaatgaagatgtataaaatagctaaagatttatgtattcatctttatgattgcccatttgatttactatttcttttgattgcacagggcaagagagcttttgccctacttagtgcagaagagcattcccaagaggctgagaaagcaggtgacgaagtggaagagggtagagtgggcttcaagggaaaggctggtctgttccactgtgctgtgagaggtcctccctgtccaccagcaagcaggaggctggttcttgtagaaggaaagttttctgggaggttggagatagaaacagttgagagctgcctcttcagcaggaggccaggaggacgtccagtcctgctgattctgccctccttccctgctcctcagctcctcccttgctcctcagctcctcccttgctcctcagctcctcccctccccacgttcactttcttttttttgcgacagaataagctgttgaaacagtgacagggaaggattgaacataatggaaaaaaacataattgcaaagacaggagtaaatgggatctagactgggcatggagggactaatgaagataggatcctgacttcggtcaagtgttttatgtctgctctatttagattccttgtcttgacttctgaggtgtgattttcaagagctatataggattataattgttatggaatatttccctttcactgaaatgctaagaaatacgtatatattaggaatattaaattcaagaaaggaggacttcacattaatgcatgtgtaaaataaggtgtattttatcaccacttataacactgttaaatggcatttaattattaaggaaggtaatttgcaggttcagataataagactttagggagtgcctccagggctgtattaataacttgaggaagacatttttataactatagattgagtatcccttatttgaaatgcttgaggccagaagtgttttatatttcagttatttttggagtttgggatatttgcatatacataatgaggtatcttggggatgggatccgagtctaaacacagaattgttttgtatacaccttatacacatagcctgaaggtacttttatacaatgttttaaataaatttagcgtgaaatgaggtctgtacattgaaccatcagaaagcaaagatgtcaccatcccagccacccatgtggacagtctggttgcttaatgccaccatcgtgcctggttctggatttatatgctaccaagtggcagtcatcttcttacccttgctcgcatgggagtactcagcagtaaagaacatgacatagcattaatacagtgaggaaa

SEQ ID NO: 59556 - DNA, 1070 bp, Homo sapiens
gtctcactttgtcccccaggctgaagtgcagtggctgtatcttggctcactgcaatcatcacctcctgggttcaagtgattctcgtgcttcaacctccagagtagccaggactacaggcacgtcaccatgcccagcttatttttatagttttagtagagacagggtttctccatattggccaggctggtctgcaactcctggcctcaagtgatctgcctgccttggcctcccaaagtgctgggattacaggcctgagccactgtgtctggcctgattaattcttaattcataaaatgttaggtgtgaattaaatagtacttttgaagtaagatgtttatattctaagactgtgagttttgttctacgttattttgtcaactgagatttggtaactagtttgtgaaaataattgtcagaaaaacagtgtaatattgcagttgcagtcttaggattttagatctctgaagactcagaaactgaagcccatgaggtaaaattaattagagatacagctggctagttggtgacagagctaggactgtaacgagcctcctctttaagtccagcatcccgttgcactgtaattgcagagtttactgtggtcgctgttaaggcgcaccctccgctgtggtatatcaaaagaaattggtgaaagcattaattttatgtatgttagataatttaaataagtgttttaactttttgaggtagatttttaaagcagttattagactgtgctttttaaaagattgaaatatatttactccaggaaaattaagtgttttgtcattttagataatccattaaccttaatccaaatagggaggtgctaattggtgttctggttaacaccctccggtttgtatcgtgtaatcagactgcagcttacagttcatctttgagaaatagtctaagagaaattcatgtaaattaaatggttttcttcctaaagcattcagggagagttgttcattttaacgtccacgctgttaacacaggagtctgtgtgcagtcttggatccaacttcaacacctgtgttcatacccgtcacctttgtgtagaggaact

SEQ ID NO: 59557 - DNA, 1018 bp, Homo sapiens
tcctctcagatgagcagttgcgctagattctcataagagctcaaatcctactgtgcactgcacatgcaagggatctaggtcgcatgctccttatgagaatctagtgcctgatgatctgaggtggaacagtttcatcctgaaagcatcctcctcaccaccccccaccccctgacccctccgctctgtctgtggaaaaattgtcttgcatgaaacctgtcagtccctggtgccaaaaaagattggttaccgctgacttggagtactgaccattgtgaaaatgagtaactgatgaatcagcaatagttgcttcttcacgctgtcagtgaagaccaaagaatgaatatgggaagcagtattaccagtgttgctgcgtgtgcacgtggccttcagtttttccctgctcttcccatttctttgtacacaccgatgaatttaatctcttctgctgaaatcattattctttagggctcagtacaggagagttaaacctaagcatgaaaggactggaaatgggatgtagaattgccaaataaactgtagaagcattgaggcacttaaaaatctccatgacctggagaaattccagtgaagagtaaacttttgcagtgtgccttaggattccgagtgaccacaagttttattatctttcaggcaaggccacacagattcttggcatactatttcctgtaagttcagaattttggaagtgtgttggtcattgtggtagtcctccccctccccgcgtccccctgccaaccttacaggaaagaaagaagtggtagttttattctgttattgagaataggtttttcatgaaatcacatgaagttacagctcaacataaataactgtagactagatgttttcccaaaatcgttatatggccacaaattgtgttagataattatatgagcaaggcaaataaatgctggatcattaacttccagttttctttctttctttttctttttttttttgagatggagtttcactcttgttgcccaggctggagtgcaat

SEQ ID NO: 59558 - DNA, 1136 bp, Homo sapiens
gatcacaccactgcactccagcctgggcgacagagtgaggctctgtctgaaaaaaaatgaaataaaataaaataaatgcccccttttagatagccatagaatttcttacctttattttgctttaaaataaaaacatcatgttaacccaaaatgaaacaattgcaatattgaaaatgtatcttttaaactttagtggatgtttttccattttttattttctgttaagtattgctaaagggcctggcataaaggagggccactgagattacggtaagaaaagggttcattttcttcctgtggcaggtgttctgaccagttgaacactagggatgcaaagatgaaaggcaacaggatttttctgtaaggcccgtcatccagcaggaataggaaagtgcattgttctatgtaaagccatagagactggcctctggaagtggctggctctcagctgcatgcttctttggatagtctgctacaacagtcacatatattatggtgtatcctgccctgcactctccttgtctccccttcttgctgtacttttttcatagtatttatgacactataacataccatataatttacttactaatttatgtatggcccgtcttctcatacttgaatgtaaactcttatgagatcaagatttatattttgctcctcagtatgaacctaagccttagaacaatatctggtaggtagcatgcgctaaatagttgatgagtagatcccagtatggtgaacaagagggatagattgccatctcttggagtttggtgtccattgagacaggtggacaatcacataatccaataagaaagtgcagtgcactgacatccggcctggatgggagggatcagaaggcttccctgaggttgtgatggtggcaccgaggttggagggatggtggtggagtgagaggtcagcagagagaattacctgtgtagtgccccaagtgggaaaggtgcagagtgctttgaaggaactagtgtgaacaaggctgaaggaagagaacgcggctgggaggtaggtggagagttttattttacagagcttgggaggtcccatataggttgattattttgccctttatcctaagaccagtgggaagcagttggaggattttatgtcataga

SEQ ID NO: 59559 - DNA, 1602 bp, Homo sapiens
tgttgtctatgttagggcctctcaaagttgtaaaaaagctgtatagatgtgttaccatcaatcgatttcatttgtttttatcctagtgttaaaggtacaagtttttttttttttttctttcctgaggcggactttcactcttgtcgcccaagctggagtgcaatggtgcgttcttggctcactgcatcctccgcctctcgggttcaggtgattctcctgcctcagcctcccgagtagctgggattacaggtgccctccaccacacctggctaattttttttttttttgtatttttagtagagttgggatttcaccatgttggccaggctggtcttgaactcctgaccgcaggtgattcgcccgcctcggcctcccaaagtgctgggattgcaggcgtgagccacggcgtacctggccaaaggtacaagttttaaatatgcttttatcatgcatacagtactcttatagattctgtcagatttagggatattcttttcagattgataaattgcacaaaaatcttggagtatattcttgtaatttcttctacaaaattctcaaaacaacctttttccaatggggagaagacatgaacactgaagtcatgtttttggaaaataccttgttaaaaacagacactgctgtaagggtttccttgcttatgctcttttgtagaactttattgatgtgaagagttctcctttttctgtaaaagcttattttagagtacgaagtaaatgaggcactcagagagttaacctcatcaggtctgagtttagttcagtttaaactttttgctcttatgctggttgatatctttgtaactactctacttctagagttattttgattggaaaatgaattccttttttagaacatggaattgtaaggtagaaaactgctaggttctcaaaagaagggagataaattccaacttgaaagttttttcccctaacgttctaatgctttgtttttcctgtgtgtaaatgccttccttaggaacaaggaaaattattaactcagctgtgtttccttcccttctctttctcactgcccccccgccaccccataccttaataccttttgtcccttcaatgcctttataaactctgtcttctcatagtttttctggtgaagctgtcatggctcctatttcaaccataaaggatttgcagttcagtgatgctactggttttacatcttctttcccatcaaccccattgccctggttaggagacctagaccatggagtacattgcaatattgaaagtatttcatgtttaacacaatttttttttttttttttgagaccgagtctcgttctgttgcccaggctggagcgcactggcacgatcacggctcactgcaacctctgcctccagggtttaagcgattcccctgcctcagcctcctgagtagctgggactacatacaggtgcgtgccaccacgcccggctaatttttgtactttagtacaaattgggtttcactgtgttggccaggctggtcttgaacttctgacctcaagtgacccatctgccttggcctcccagagtgctgggattacaggcgtgagccactgcgcccggccatgtttaacac

SEQ ID NO: 59560 - DNA, 1225 bp, Homo sapiens
aagccggggctgaggaggaccggggccggggcaggggaaaactggggctgaggatggccgaggccggggcaggggaaggccggggccggggcttaggaggacccgttgaggcgaggcgggagtcgacggagctgggtgcccggaagaccgggccggggtcagggtcgggaggccggggttgggcgaaggccggcgaggacgggggtcgggcagggcctgggcggggccggggtcgcgggccgcgagcgcccccaggccgggcgggcgccggcacccgcagtgcggcgccagccttgccactcgctcctcggtcccgccggagcccggataggcggccgtgcgggtgcggggcgggacgggtcatcagggcatcgcattcctttagaaccaggaagttgggatcctgttgctcggtgtgtgtttggaacgctcctgttttcctgttgatagacttgagcagaggtggatctgaaggagttaaaaaaataaagtcagatgtgaagattgcctgtgttggtcttggggctgggatacatgggcggcagagaagccatcggaaagctgctgcacctgcctctcagggtgcgcttgggaacgtgaagagtctttccgtttcagtgccgttgtgcgtcgaaacttcatgcgaatgtaattttgcttttccccttatttttacgtaaaacgttcttaaaacttggctgagatgaaacttgagaaacctagctgtagaaaactacctcctatctggctttcgtttgagattctctaagtggatgcccaataacttgtcttaatagtaaattggaagtttgaagttttggataactgagaaaacaggaaggttttccttgacagggcagtggagtttgtaagtataaacagtatgcgtgaggcctttttctagagatgagagcaactccaaggtgaacattgaaggggacagacaagttattttccctttcgaaagtttttttctcttagtttcagttgtttgaatatttaaatgcacttgaaataggtgctgagttgtagtttgtgaagaccacagtggggaagagtggtgtcctcttttttcttggtggtcaggtggtgtgtgcagtgtgcaatttccatacttccccaacctgcctggcgcccctcattacagtcagggtaatttacagaagttgaaatcgttgtggcttttcagttttttctccttgtatttaatatgctgaaaggcagt

SEQ ID NO: 59561 - DNA, 1188 bp, Homo sapiens
cgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgc

SEQ ID NO: 59562 - DNA, 1532 bp, Homo sapiens
aattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggct

SEQ ID NO: 59563 - DNA, 1159 bp, Homo sapiens
tttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcatgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcag

SEQ ID NO: 59564 - DNA, 1927 bp, Homo sapiens
ctcccttttttgatgtttaaatagtatgtacttttctgtcactggtttattttgtggtattcagtttgggagacctacttttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccg

SEQ ID NO: 59565 - DNA, 1072 bp, Homo sapiens
tatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatccca

SEQ ID NO: 59566 - DNA, 1056 bp, Homo sapiens
ggcaggagaatcgtttgaacctgggaggcggaggttgctgtgagctgagatcatgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattagtttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttca

SEQ ID NO: 59567 - DNA, 1323 bp, Homo sapiens
tggatcacctgaggtcaagagtctgagaccagcctggcaatcatggtgaaaccccatctctgctaaaactacgaaaattagtcgggcgcgcacctataattctacctattcaggaggctgaggcgggagaatcgtttgaacctgggaggtggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgata

SEQ ID NO: 59568 - DNA, 1086 bp, Homo sapiens
cagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccacccacccaccccggacactctggtggagatgctgggccccttcgttatcctgcacccctccatcctgactctgcctcctgcacctcttccctgtcccgacactggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctcc

SEQ ID NO: 59569 - DNA, 1494 bp, Homo sapiens
ccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcg

SEQ ID NO: 59570 - DNA, 1145 bp, Homo sapiens
cgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtac

SEQ ID NO: 59571 - DNA, 1952 bp, Homo sapiens
ccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccattgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcct

SEQ ID NO: 59572 - DNA, 1097 bp, Homo sapiens
aatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggaca

SEQ ID NO: 59573 - DNA, 1032 bp, Homo sapiens
taccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcatgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttagtacacttttaatgtacaatattgtgtttgtacattaatttgactttttatcattctgaattcttggagccaaggtcacaaagggaaatcctgtgaatggcataattttatattctgcataaagtgagtttacacaatgagtgcaacctaatacaacagcaagaaaaaataagaactagtaagcaattgggcaatatgtataatttacatatttatctttaatctgtattatctacactttgatcttttttggttaaagaagtattaataaggaacctacctacaaatgtagtctgtttcacaacataattactgatagcccattataaccaattttaaaatccttaaaataattactgatagcccattataaccaattttaaaatccttaaaataattactgatagcccattataactgattttaaaa

SEQ ID NO: 59574 - DNA, 1019 bp, Homo sapiens
gtgcactggccacgtctcaacagcagtgtgaccttgggcaaggccttcctaagtcccgactccctgtcctctaacatggtgttcatatcagcctcattttcttactgggaaggttacgttatgtaatatatgccagccatttttgcaaagtgctgtatacaggagatcttgagtgagtgtgtttccctcctcctctttttgggtagctatgttaggctgttcactttgggcatttgccctgaactaaaatccctaagtccctttccccaaggtgaaactaagatagagttttcatatttatcctgtcttattcttttcagggaaaagattttacatctgttgaatttcatccttggtttaaagttgttcttttaactactgagatcttttgaaaatcttgatggctatttatctgattaatggtatttcctaattgattgtcatccacagaattgatggtgtatgtattccatgccttcatttcgtcaatgacaaaacattttaagcaggttaatactgatgacagatttctgaggttgcctgtagagaccattctcttcctcgatattgctcagaagttgaatttggtgtctcagcccactaggaattcgtctaacagtgttattacgataaaatgttactacaaacttgattaaacttctggtggaaattccatcacattttatgcaattttcaatttatttctccaatttatttttaatgccacatggacattatattccttaaccattcttttgcatgtgattaacatttgtgaaattaaccacttaagcaagtgtttttgctttgatgaaagaaaaatgtttaaaatcctactggatatgaaactgaaagtaatgttttgtgttttttgtttcaaatgaaagtgtaaattaagaatttgttggcagggcgtggtggctcatgcctgtaatcccagcactttgggaagccgaggtgggcagatcacctgaggtcagcagtccaagaccaccctggccaacatggtgaagtcccgt

SEQ ID NO: 59575 - DNA, 1284 bp, Homo sapiens
ggaggaagctaataaataggtacaaattagtgaaaattatgttctgagctaaagttacattttagttcattatgttcttttcctcagtttcctaagtgtgatcaggaagtgaaggtctgtctctaaggcaaatagggatgttcatggtttttgtattttcttaaagtatctcgtgctgaccttcttaaagtggaaagggtttaattgtttgggaattcatttgtctgtgatggattactatcaagtgatattttgaggtaattttgtatgcatctgtactttggcatatttcaaggatacaaagataaattgaaattttcagtgatcttgctatgatggtgtaagtagttcttgttagctttttatttttccaatttgtttccttgagtttaaagttaatttagcatgacatctatagtaagattaactgcaattaatagagcaaatttagtccttctgccgtttgtcctcacttgatagtctttggtaattctttgttattcaaaagaaaatctgaaattgttggtattttctactgtactttccttcgataacatctagaatgtaagttgctaatttatttgattttttttttggccatgtaatgtctagcttatacttacaagttttgaactttttaataaattaacttgaagctttttcttcataatgaagtgtgaaattatgttcttcctcatttaatttctttttacattatcttggattatgttgttttttctggtgtgtacagttgtatatatacaatgtatggtcttggaattccaaaactttctcattattactgaagtagaggaagaaatgattatataaagttgtcctttaccatgagcagtaaaaaataagatttggacaagggtaaggatatgtatagtaatgctttgctttaaaaaatgtattagagatatttaaagcccagtcattttaggtactagaaattcatctgaatttataagaagcatattactaatgatctttatagcctttgcacactgcccatacccattgtaaaaaataactatgaaaatataagacatctgaagattgaagaaataatttggtaacagaatatattctgattcgtactacagtgtggattcttggtgccaaagctaagcatgaatgcaacaagagaaaggctacagtctagctttattactttccctccttctgacccagagccacgaaaagcaagtaacgtgcctggtgggatagcgggaacacaaaagtgtgttacgtgaacgcagaagaggtttttccccttcc

SEQ ID NO: 59576 - DNA, 1030 bp, Homo sapiens
tttcttatcgtagcagaataatccatggcttttatgaaagttaatctttagtagacattttatgaattaaatgagaaatggataaaggaaaatacattgagcagtactttctagagacagtagtggataagcagttggatttattgtgagatgaagatggcttcacggtcttctcgaagcctttccgtacagcatcagtatgtttgctgctccccccgcagttcctgtagacggagctccttgaggccctgtggttaccattctgttcccttagattgtaggcatctgatatggaggaaaagagaaaagtagcacagagacacagcaagttgccaatgtcagcatttttacttctttctgggtaatttatctaacccgtggtagcttggatttgctataatttcagagtagttttaaaaacgtgccttccttggtcgctttttcgagggtagccttacagtactgaggacttttcctgtgagattgtcagacccccacagatccccatgatagcccagggacattggtgatgatctcgaaggatgtgtgtaggctttcagtagaccagaggtccttatgatttttctgtaaaggagtaagcagtgaatattttcatctttgcgggacattcaggctctgtcgccagtactgagttctgctcttgcagcctaaaagcagcggacagtgcactgatgagtggacatggctgtgtccacttattcacaaaagtgggcggctgtctgggtttcgcctatgggccaaattgtgctgacgcaggaatagaacactgaggttgagatgactggccccttcatgcaggtggagttgtttaagaaggagccccagcaacaggtacttccagtgtgtgggatgcagcgagtcatgcggtttggttggagtttctatgtgagagagaaatgtggtgggagggttagcctgagagtcattttgagcaggcccagaccacatagctgactttcaccttcatacgtggatgaagactaaagcagacaaggagtttacaccttac

SEQ ID NO: 59577 - DNA, 1009 bp, Homo sapiens
tgctgataggtgcctggcccattgaaaggccgcgtgtgtgttgaatggatggagatgagtgtcgctttcccgaacgtctcagagttgattgcagctgtaagttctgatatgatagggtttcttaggttagatagatggagaggaaaatctactatttgtacattttctctgaacttccaggactttctatgctaaaatgaaaggtgaaatagttttataagtaatcattatttcctcaattttggacatgtactctattttcaatagcattatgcagtctcagaaaagagttatttaagtaaaaagtacattcctctcactaagtggtcactaagctggaaaggtctgactgctgctgcttagccatagtggcggtgaagagcgcattttaccatggtctgtgccttgggtaattttccccgatttctctcttcagcttctggagatcagactgctcatatctggagatacgcggtgcagctgccgacaccccagcctgttgctgacactagtgtaagcacctttccttacctgtgaatgtgtaggatgctgatgtctgcgaatctgagaatccatttatgatatctgtcatggacggaatgtttgtgtccccccaagttcagtgttgaaggcctcacccccggtatggttgaatttggagattgggcctctaaggtagtagttaaggttcagtgaggttgcgtgaggtcctcataagaggagacagtggagagctcacctgtgttctcaatctctctgtcactctccgtgtcacgtaagagcagagccagagggcggccgtctttaaggatgagcccgcaccagaacctgaattggcttgatcttggacttccagcctccagcactgtgagaaaataaatgtctgttttttatgcgtcgcccggtctgcggccttttgttgcggcagccagagccaactgagacagatttcagtaccgcgcgcagagcgggggctgctggagaaatgccgacggtgtggacctggctt

SEQ ID NO: 59578 - DNA, 1036 bp, Homo sapiens
tttccatggctcatagatggcgtcttctcctggatccttcatccctctgggagtgtctgtgtcctcatctcttcttacaaggatgtcagtcctattggaataggatccactctcctggtctcattttaccttaattatctctttaaagcccctttctccaaacagccccattctgaggtcctggggtgaggacttcgacacaggaatttgggtccacagttctgcccatagcagccccttccactgttccctccgcagtttgttcacacagcacacaccgggcatcacatcctgccgacagccgtctggtgattttgcatcacacggaataaaacctggtgtcctttccagtctcccgggattacaggagctgttcccgactttgcctcccgtagctgttccgcacatggcgggaatgttgttcctcagcccgggcgagccttacttaacctttcctttcctcacatccgactcacgtgcgacctcatcagagagtccctcctcagtaattctgtgtgaaatagcgcccccatccagctgccccttgtcctgttttattttacttcatagaagttactaccaccttactctgtgtctccatgttgatttgtgttcccgtgctgctctgcatccatgtgatatgtgttcccgtgctgccctgggtccctgtgacgtgctttcccttgctgctgtgcgtccctgtgacgtgcgttcccttgctgctgtgcgtccatgtgacatgtttccgtgctgccgtgcgtccctgtgacgtgtgttcccgtgctgctgtgcgtccctgtgacgtgggaacccttgctgttgtgcgtccctgtgacgtgttctcgtgcggctgtgtgtccatgtgacgtgttgccgtgctgctgtgcgtccctgcgacgtgcgatcccgtgccgctgtgcgtccctgtgacgtgcgttcccgtgccgctgtgcgtccctgtgacgtgcgttcccgtgctgctgtgcgtccctgtgacgtgcattccctagtaatgtatatgtgctcatgacgtgcc

SEQ ID NO: 59579 - DNA, 1023 bp, Homo sapiens
gacacccccaccaggcccggcctccaacacaggggattccagttcagcatgagatttgggctgggacaaatttccaaattatcagttccagtactagtacttgtgtatatatgacatacctctccatactaacgggtgtgtgtgtgtgtggtctctctcttttgctagaacagaagttctctgagggcaggggctttaccaggggtcctcactccagagttcctacctgctagattgagcgtagttttgcatgtgtgcatgtcagaagccgtctgtcctcttctgcattgtgtaagcagcacctgggctgggggtggggactggcactctgtcaccccctgataaatatttgttggatgaatatacagattttcttacagagctggctgtaatgtgtttgttttagccttggcctttgacagggggcttgatgttacaaaggaaaatagactcttatgactatagcaatagaattccaagtatattttaaataggctcttgagaatgaaaatgcctttttgtaatgtgataaattactgactttcatttgtatttggttagttttatattgcatttctactagtaactgatgaaagcttaaatgttgaaaatcattttatttgccattctgttgatgcgtggaaataaatggtagttcggttgacaatgttgtggattccacttttttttctgtacgagatggtcgtagagttgatgggtgttcacgggcagcagttatgggtcagaggaggacatactcatcactgtggccagcaccaggctcctagtggtgaccatcatgatggatatgtcctcaagagattaatgagaaccatctattttgtagctatgtcagaagaaactcaagatttccaggaaatgtctttcttttctggccttccctttggcagcagatatctggggaagatgaagtagagtgctctgacaaggacgagcccgacctcgatggggatgtgtccagcgactgccccaccatccgcgtcccactgacatccctcaaga

SEQ ID NO: 59580 - DNA, 1043 bp, Homo sapiens
tagggtcagaaaatgggttatgcacctgtttggttttctgttcctttgacatggacggctgaaaggacttcagcttctgagggaaaacctgccccactgtgacccacatgctgctgagtgattccattaggtcaggttcacagtctcagagagacggcttcttgggttcttgtgctgttgaaaagcgtctctctcagcgtgctcctcaggtgatgaccttgtgttttgccatcttggttacagggcacgaccaggagttgacgcactgctgcacacaccccacccagcggctcgtggtgacctcctcccgtgacacgactttccgcctctgggatttcagggacccctccatccactcggtgaatgttttccagggacacacggagtgagttgcggtagtttagacatctgtccttagtcatgaaaaagttctgtgggttgacatgaaaacttaattctagccttaattttcagtatttccgactctactatctttcaaaaaaataactacctttcaaattctgctattctttttctaaacatttagctccattttggctatttcaaaggatgtaggagattaagagaaggcaccctccgaagttctctcaagaagtttaatgcagacagaatgggggagtgggtggagagggttagagaagagcagggctgccagagcctgtagctgagcacaggggccggccacgccaccataggagccgcgggagctgttactcctacccacggggtgtctcctggatcttttccatctagtttttgttattacacgtgtctgcgtggtatattctgggagaaggtatacacatagacgcgcaaacacagacatagaccctcaatccagtgtgtccctctctgcttgggtttctctccggcaactcaagtgtaaggtcttttttttctgagacggagtctcgctctgtcgcccaggctggagtgcagtggcgctatctcggctcactgcaagctccgcctcccgggttcacgccattctcctgcctcagcctcccgagtagctgggacta

SEQ ID NO: 59581 - DNA, 1147 bp, Homo sapiens
tcagcctcagccctcagacctccctcagcacaccccaatcccgtagagttttcctcccctccccatctcccttttttgtttttttttttttgttgttgttattttggttgctataaaaaggagctgacaggcgaggtgtcactggccattaagcctcctctgtgggtggcaggtggctctgccttgtgccgggctggcagtgtttgcaatgcggataaactttagcattgaaaaaaacaggagatcatctcaacatggatgcaatatttgaggatgcaaagttttttgttttcttcctttttaattctttgcaaacgattttaactttattcccaaaatgtggtctttggtgctttcttctaaagaaaacaaaacacacatctaaccaaacaaaattttaaaagatcagttgagaaattataatgatcactttgaagtgatgacatgtttgtgtgcttttatttccaaacacctgggggagagatttggtactaaacactgagttctagatcatgtgctcagaaaggtaaacacagttttgcagcttgtgtcatggtgttaacagttttccttatgcttttaaagggaaaagatgtttggaaatcgacatttttaactggatgatgggcagttttaattgcacctgaactttgtgcttggtcacagtcagcatgcaggtgtcagcttgggtgtgggcctctgggtgctgtccggccagctggccgcctgggaggtgcgtgttggaaaggacgcatgtggtctctaaatcagtttgctttccactttcagatctgctttctttttggtgatggcttttgagtccttgtctgtggggaaggtggagagccagccatctaccaggtggtgactttgcagacagcagggccctgtggaagggcctctggggcggaagtgacatggagatgaggacggcctgcaggctgtggggccttggaagcacacctgtgtctcctctcagtgttacatcccctacccatatgcctgaaagcttggtggttgtctttttaattagattacattagagtactttaacaaaatgttgtatgtattcatggggtgtgagtgcagttttgctaccttgatgtactccactcaggtgaggccagggccttcagcatacccctca

SEQ ID NO: 59582 - DNA, 1018 bp, Homo sapiens
cagaagcgatttctccaatgatccctcaagaaccaacactttgtaaaaaaaaagactatttcgtgtgtgtgtgtaagagagggacataccagtgctttaggagtgtgcacgcactgccacgctgtctccctgccctgatggccccgcagcctgggcgttactgtttgtctctgttgagtgttttgtttcagcttctctggaagtcagctgttgctttttgccatttttgtgctggtttctaatgctgtttctcactcaatcccactgatttctcttacttactgctcctgaacattctaaaactgataacgtagaaatgaaaatgaaccctgaataaaagactaagggccattcctatgaagaaaaaacatgagtgcatcggcgttaggaatttcttctgtataccagaaggccgtgctgcaaaacaagtcaagagcatatatttggaaaatacgtctgtacaggctcctgcagatgcagtggttgtgagaaacggtctctgtccttggtagccttgacgttctaggatgataagatcagtacacgagacagagcagagcaagagaacacagagctgagtgctgttactgagtccaggcaccacaggtcagtgtttctgtaatgggtcttctttctttgtgtcatagccaaggtgaagctcttcagctagcagaagagtgttctcactgtgcccccatagctcatggatctcatctttagaatcttatttttggccggatgaggtggtcaggttatactgaactaaatgttctctttgaatagtctgtggaaaggttcttactaattcagttagtcaaatcttagggaggctttagcatagtctgaagtcactttagaagcccttctctgtgggccatggtaaacacagatgttgcagaggcttcttgtagctttgctgtggtgcctgttggcagcacttccaggccttagggtgctgttgtgcgcctaacactgctgaccttataatattataagtggccagtcacttgcccccttc

SEQ ID NO: 59583 - DNA, 1038 bp, Homo sapiens
aacacaacacagctaccccatgtcttcccttgcgctatgaagcgccgcctccgaggggcacccgggggtcctggctggcttattggggtgtcctttggttacttactcagggcactgttttaaagtcaggactgttggcgacgcaggtgttgtacttttgtatcagcgctgtaacagaacagttgacatgccaaagtaataaagtaataaagccacagtgctgcctgtttcacagctgttcattttcaaagatctgttctcggtaccttgactgagaagcctgggttccaaggaaggggctgccgtccacaggactccctctctgtggacacacaggcgtgctcctcagatgtgaacacattaccttgaggaagctgcgttttaaaaataggaaaggaaacgatcgtcagtgtttgatgtcgtgccggaaaagcactcccatcagcgctttgtggcccagtgttttccacatcgtgtcgtcttttccttagtgaaatttcggcagattgttatgcagaagcggttctgtgtctctgtgtgactgggagacagctgttcatcctaatgaggatgccagcttcgcggcgtttccgctgatggagacccgcggagggagcggaatgttccagaccaggcagtggtgtgcggcgaggaggtgctgcactgtcagctggaggagcacgctcggctgccccacacgacaagataaatgagtttgccggagtttggcagcgtcggaaccatttccagtgcacggccgtgcgcgccagcctccccatgggacctgtgggctgagggtgccttggaaactgctgcctctttgccagttcttttttcttttgatgtccgacaatacttgtcaggattgtgatttattaaaaacctaatgtcttttagcatttcattaacatggagttaggcgatcttttgttgagccttttttcctattaatttagcagaatgttcactgaaacttaacttggccaaacctcctgaagactccagttcaaagagaagttgggggcacctctcctctca

SEQ ID NO: 59584 - DNA, 1092 bp, Homo sapiens
tatttttttagatgaagactctggaggagttactgggttgattttgcagtctctctcctctgcccatgctgctctcgtaacccgtgctgctctcgttacccaggctgggcgtttgcttgtgtcctgccccgtgtgatgccgtggtttccagttgggcagtttccccccaggagacagtgtttgttgtcacccctggggaggggtctgctctagtttctaatgtgcctgggcagggcggctgctacatccacaggccaggatgctgcaccacagggaagggccccgaccagacatcaggtcctagcgggggaataagtgtcagcaatccacaccgcagctgtgggcaccacgaccaggcctttgagaatgcagacgtgaaaacggtcgccgccgcatcatcctgactgtgttccggggtctcggtgtcagagcgtgttgccaggtgttgttgacgcaccttgattctcagtagctttgctgtactttgatgttatatttttaaaaaccttgtcttaatgcagtggaacttagacgtaattaggactcagctggtgtccactaaatgaggaggattttcataaatgggctttgtgactgcgtggtgcttctctcatccagggccgcatagagcatgaaatcccatgtcacggtacagcttcagtggctgggacaactggcatttaactggactccagagttccaagcaattttgatggactggacctcgatgagggtagatgtggaaaccaagcttttggtccacattaaattagtgatttgtgacgacaagaggacacttccttcatggataggtggaaattcacatgcttatcatctcgtaggtatctcagctgcttcagtgcggggtgaggcgggttttgagcccctgtacagagtgagtgaccccagtttttgtgccctgggagacagtgtaggggtcaagcctgtgtctctctgagaaggcactgcccctgcgtctcaggatctgcccactctgccctgaagtcagaccatgccttcctgggtgggccactcatgcccagctgcatggcgagcatggggacccaccccagccctgagccaggcaggacg

SEQ ID NO: 59585 - DNA, 1795 bp, Homo sapiens
ggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatat

SEQ ID NO: 59586 - DNA, 1480 bp, Homo sapiens
ccctatatgattctaggtcataaccctacacgaatgggtcatattcctgtatgattctgggtcatatccctacaaaaataggtcttatccctaaaacaatcagtcatattcttatgtaattctgggtaataaccttctaataatggggcgtatccctataacaatgggtaatatcactataataaaggggtatatgcccatataacaatgggccatatccttatgttattctaggccatattcctataacaatggttcgtatctctatacgattctgggtcatatctctaaaacaatcagtcatatctttatgtaattctgggtaacagccttataataatgggtactatcactgtaataaaggttcacatgcctatataattcatggtcatatcccaataacaatgggttgtccctataaaaatgggtgatatccctacataattatggatcatatccccataacaatgggctgtatcactatataattctgggttatatccctataacaatggtttatatccctataagaatgggccacatccctataacaatgttcatacctgtaacaatgggtcatatctctgtaacaatgtatcctatcactgtaacaacatgttgcctccctataaccatgtgtcatatcattataacaatgtgtatacttgtaacaatgggtcatatctccataacaatgtatcctatccctgtaacagcacgttgcatctctataaccatgggtcgtatccctataacagtgtgcatacctgtaacagtgggtcatatctctataacaatgtatcctattcctgtaacaacgtgtggcatccctataaccattggtcatatacttataacaatgtgcatacctgtaacaatgggtcatatctctgtaacaatgtatcctatccctgtaacaacgtgttgcatccctataaccatgggtcatatccttataacgatgtgtcatatccttgtaacaatgtgtcatttccttgtaacaatgtgtcatgtccctataacaatgggtcatatccctatatgatttggggtcttatccttatatcaatgactcatagccctatactattctgagtctatttcctacaacaaagctgcttgccctcctctggcctctcaccccttggaaaacagacatggtgatgatgctcactttaaacagaggacaaaagtcattcattaagagatggcaagggagtatgacagaagaccctgggccagattatatcaggggatcagaggtggtgcctgctctgaatggcccttcttctgggctctgaaggggaaaacaaagtaaatgtatagtgttgaggattgagggattttgtatccatataatatgagtatatatgcatatatattagcctatacataatgcataaatcggtatctgaaagtgtggcattgacattacaaaacttaaaatacatgtcgtgttaagccagaatagacaaaactt

SEQ ID NO: 59587 - DNA, 1047 bp, Homo sapiens
ttgactggaaacatcactggcttcatggcccacgaactgcagcatctttagttctgacagctgtttctgaaacttaactttgcagaggaggaagcttggtgctctcaggtgtgtttgggagcaaaggcactgaaggctcaggtgttcctcatccttaagcagcagcgctgcatggctgtgggtgcggccctcgtgccttttcactcctctcccgatgggcctgagcttgttagccacgacagcaagacagaccctccaggcccagaggtggttccgagacactagtggcttcagctcccccaaatccagcggcagtggagagctaggtggaggctaacagacttatgatacattgtaagcagacttatatgatgatacattgtaagcagacttatatgatacattgtaaatagacatgatacattgtaaacagacctacatgatgatacattgtaaacagacttatatgatgatacattgtataacactgttcttctcaaggggggcctccctttatcttcatgaggtatggttatttgtaatatgctggtttattttaactttactgataataaaattgcatgacttgttttctgttgaagcccattgccttttttttttttttttttttttttttttttttacagtggtagttggtgatgtgatactccatttttcatctccttctcaaatcacacacacacagaatttggctagctgcaaataaacccctattctgtacttcgttttgcagttgaatggagtggcctacaaattcgtaccaagtccaggcagtgatgttttgaacagaaagtagcctgggcatgggggtaccttgcgttacgttggctgtttcttttagtccttaccctaatcccagaggagtgtgtgtacccatttctcatattaggaaatgaggcattgagaggttaggaaacggacccatggtcatgggtagttagtggcagagccagaattaccccgggctcttcagtgactcttgctcctgtttccactgcaggtatgaacgctgccgtccgtgccgtg

SEQ ID NO: 59588 - DNA, 1121 bp, Homo sapiens
cctgacgctgttgtgtgttgagtggaagttagttccctcacagaagtggcggcctgaacactcacagggactctgggtgcagaggaaaggaaggaaatcacttctcttatttcacagataaactgacttaccttagttcactttctccgcgtcaccactcagcatgttcagggccaggaacagagttcggtccccgacccctggcctctagccgggagtagggagtgatttacccccttaggacgtttaccagtgtttggaggcattttttgattgtgccattattgaaaggattgcccctggaatgtactggggagaggccagtgatgctaccgcacatcctacgatggacaggaccacaccccacaaagaatggtccagacccaaatgttggtagaaacaaggccgagggaccctgcactaaaccaagcgcacactgtgtttggtttgaatgttgttagctggggaggggtggggagtgaggccgaggggagtgtgagggcctaatcttggatgcagtccctggcccactttaatctctcttgatgtaagggttgtgtttttgtggcgattgtcgggtgtctgatttttattggtcactgtgtgctgtagtcgcccgtctgtttcctggtgggattcagatgtcctcagacctgtgcctgctgtctgtgtggtatgtaccagaattaaggagttggtatggaacacactgggaggcctaccccagaggccctgggctttctctgatgtttgtttgtttttgagacagagtcttgccctgtgtcgcccaggctggagtgcagtggtgtgatctcagctcactgcaacctccacctcccaggttcaagcgattctcctgcctcagcctcctgagtagctgggattacgtgcctggctaatttttgtatttttggtagagacggggtttcaacatgttggccaggctggtcttgaactgctgacctcaagtgattcacctgccttggcctcccaaagtgctgggattacaggtgtgaggcacctcacctggctcagaggccctgggctttcttgggaggtaaaacccatatgttctctctgtctcagctgggagggctggggctctgaggcccatccatgtg

SEQ ID NO: 59589 - DNA, 1355 bp, Homo sapiens
cagacaattattattcagctgtgctgtttaataatattcaacatacatcccaagtggcgcagggtgccttggcaggcggagcccctgacaaaatgctcccatgtatgtcccgtgctcgacagtgctgtgtgcctgtgagtttgtgctgaagtatgataaacacgttgggtgaaagtgacccctttcaacctctagcgaaacacgaccctttcaacctctcgggaaacgctgggccataggagaatggcttgattcctcattgcactgtgaggctgagtctaggcagacgttcccattactagggactcaaggtgaggactttcccacaattcactgcttttatccagtgctggaactgccctgtcttctgaccagtggatgctgaggaactgacattcactgtcatttttcccgttttatataatttaaggatcacttcccatttagtgaagtttatctcatttttaaaagattctccctttctcccctagggctaccagggcatggtggacggaggctcaaacatcgcagaggccgactgggagagtgtctccagcatcctgcaagtggtaggtactgggctgcgtccacagggttctctgagttagagactcttttatgtctagtaaattcccagaacacttgagctcagatcagttgcgaaatagagattatgtggacagaacagactttgtgagcagctctttacttgtggtttgatttttagaaatgcatgtgttaatctgtgagtcactttgagtacttgttaatagaaataatccaaatcggtgcctccccgctgaagacgctcatggggcccacaccttcgtgctggtccaggctctctctgcattgggcgcctcctgagctccgacacatcagaagagaggtggagggaattttgacaaccacggaagttaggtggagcaacgtttgcaaaacatcaggagagtgtgggctgaattcacacaggggagcgtttccattctgcggtcgtgattgacggaggaagataagatgtgaacggagagttgaagtgcgtatgtgtatcagtgagtctgtgtttctgtgtgtggtgtatgtggtgtgtgaatctcggtgtgtgtgtaactgtgtgagtctggtgtgtgtctgtatgtaggtgtgtgagtctgagtgtgtatgtgtggtgtgcccgtgtgtatgtgttaactgtgtgaatttctggctagcgaatgtgtatctgtgtgtggggtgtgtgtatatgtggtgtccttgtatgtgtaggtgtgtggtgtgtgtgtgtgtgtgtgtgtgtgtgtgaaagagagtgagtgagagaatgggaatggcacccactcctctgcagcccagtt

SEQ ID NO: 59590 - DNA, 1114 bp, Homo sapiens
aaaaaaaatccccctggccccaggttcctgctggttttacttgcaggtgctgtaaggggtgactggagggagaagcctggctgctggtcacaccgcttcccttgtcctggccggcatgctctggtggtcagtgggcttgtctttggttccacgtgcacctggttgagctcgttggccggtgctgaggcggctgctgtgacaccgcaggctggttcctgctccatgtatttaactgctggctgccgtgtgtctggctctgcaccctccctggctcctcctgggtgtcacgcgcctgtctttgtccatggaatgctggtctgggactaaaaacaggaaaatcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctca

SEQ ID NO: 59591 - DNA, 1025 bp, Homo sapiens
tccggttgccttgagttcggagaaaataaagaatcggccagggcagtggctcacacctataatcccagcactttggaaggccaaggcagaaggaccacttgagcccaggaatttaagacccgcctgggcaacatagagtgtgggtctacaaaaaaaattaagaaatcagccaggcatagttctagcttctcaggagactgaggcagaaggatcgcctgagcccaggagttcaaggctgcagtgggctatgatggtgccactgcactccagcctggtcaacagtgagaccctgtctcagaaaaatgataataaagaaatgataccaataacaaagagtttagaatggttgatttctctacccatggccattctgcctcacccctagtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgacgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgat

SEQ ID NO: 59592 - DNA, 1021 bp, Homo sapiens
tagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcacgtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgac

SEQ ID NO: 59593 - DNA, 1070 bp, Homo sapiens
ctgcctggaagcaggggaggctagcgtcatgggcaggcttggtttagaacattgaattattaactttttatccttgatatttaaaacattttcataatgactcagaagttggacggcaggggaaacacgcagctcccgctcctgggagcccattccgcttacgtcacctcttgccgagcccgtagaggttccgggactccccagcagacagagggggtcagctcgagtggccacgcgtgttctttggattagaatgttccggctcttaaacatgagctgctctgagaatgaggactgaccacttggcagccgacccgggcttctgtttgccacagtgggaaaaggcggcgtcttgctattccctgtgccctcccataacccagagcatcagctgagcacattcttacaaagccactgtgtcctcgtggccctgcctgggaacaggctttggcaggctttggcaggcttcgtgccctgggacttgctcaggccagtgcctgcctgtctggagaggactctgataccatgggctgtgcccctgctgtagacggggctgcaggctgccggggctggggatgggctgtggctccagcagccacggggcagaagacgtccccacctggctttgcaagtcggcttctttattgtgctttgttatggtcagttaaggagcaaagcatatctctggatatgaaaacagtgatggacacctgggaaagacatctgccaatatttataagtggtcatccataaagtccaggcaaagattttatttcccgcttaactgtaattaaattataggacaatggaccgagaaggaaccaaggaatttacgtagcccagccccactgtccttacagaggaataagctgagttccagagacagtcagtggcctctccagatcaccgggccggtgtgcccatgggctggggcgaggggaacgccttgattgggctggcttgtgctgttcaaatcacagctgaacaaattaaagctggttcaaggaagatgtttacattttttgtaaaatataagtaatagtttaaatgcaagctactgaaacgttact

SEQ ID NO: 59594 - DNA, 3519 bp, Homo sapiens
ctgcaaatgaacaaagggaaaagcagttccagcttttcaggcattggttcagtagtggaggtggctgtggagttagctgcatttgaagttatttaattaattaatttatttatttagagacggagtctcactgttgcccaggctagagtgcagtggcgtgatcttggctcactgcaagctccgcctcctgggttcacgccattctcctgcctcagccttccgagtagctgggactacaggtgcccaccaccacgcctggctaattttttttttttttttttttttttgtatttttagtagaggtggggtttcaccgtgttagccaggatggtctggatctcctgaccttgtgatccatccacctcggcctcccaaagtgctgggattacaggcatgagccaccacgcccagctgttgttttatttttcagagttcattcatgattcgtgactcctgttttgttgcctcttaacacacacaaagaagtcgtgaagcaatcaagtcagggacttgttgaaagtcaccttgtaaacataatttccaaaagcccaagggagaaaatagtatttgtgtgtatgtgtgtgagtgtgtgcgcaggcttgtgtctctgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtgtacatttgagtgtgaggtagtatgtttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcatgtctgtgtgtgcatgtgtttatatggatgtgtgtgtatgtttgtgagaggtagtatgtgcctgcatgtttgtgtgtgtgtgcaggtatgtttctatgcagatgtgtgcatgttggcatgagtgtgaggtagcgtgtgtctgcatgtttgtgtgtgcaggtatgcttatgtgcatatgtgtgtatgttggagtgtgaggtagtgtgtgtctgcacgttagtgtgtgcctgtgtgcatgtgagaggcagtaggcttaaaaggctcagagcactgaacgacatgcggtacgtgtattttgagcctgtgtctcatgtctctgcttgtctagagacgaccgtggtaggtgtcacttgccctgaccttgaaaccacccttgtgtggctttgtttttaaagctgagggaccactactgtgcacctgctgtttgtcaggcgtcttcctgagggtctgacatgcttgaataaccttagagatagctggaagtaggagtatttttctcatcttacagatgaggaaattgaagttcagagcgagaaagaacttgaccaagatcctgacgttgcccagggctgcctggcgtgcatcagtcccagccccgtgtcccagggcctccatccgggcccctctgctcccccgcccgctgtgacctcgctcccatcccacatcccccagtgagctggtgtgttctgttttgtttttccccaccataatcaaattgagaattccttagaaccatgcctgagagatttcatttcctctggctttgttctcttggagttaaatcttcacagtgttgtgtccacaaacagcaggtgacaccttctctttttcctcagaagcctcctgagctaagcagtcccagggctctgacctcacagccgggccgtgtggggctggctgccaaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcggttcgactccgagggaggtgaggtgctttggagaaagctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctaaagtgcagtggtgccatctcagctccctgcaatctctgcctcccatgttcaagcaattctcatgtctcagcctcccaagtagctgcgactaccagctcgtaccagtgcatgtcaccacatccagctaatttttgtatttttagtacagacggggtttcaacatgttggccaggctggtctcaaattcctgacctcaaatgattcacccgcctcagcctcccaaagtgctgggattacaggcttgagccaccgcacgcatgtcttgcaagagaaagttatgaagtgtagaagcgtgcccttttctcttagtccatttccaccagacacggacagcaccgcgggtcgcggctaagggctctgccatgcacatggaaccctggggcctcctccttctgcccagatagtcgggcagacacattgagtgctggcagataagccaccttttctccacatgagccctgagttgtgtccggtattctcgactccggtccaacgacacccttttcctttaggagctttgcgggcaacctgaacacctacaagcgacttgccatcaagctgccggatgatcagatcccaaaggtaggtggccggcctcccgcgatgccccgacctctcctgcgggcctcccctcatggcctctgcctcagtgaatgaggccacctgttttcaggcctggcacggcatgagccactgccaaagtgtgcagcaaatggagctcacgtgtgcccgtgacccagcactcacctgccttctgttttgcagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccaggtgagtcacccaggatgccgtaggcaggcagacaccctggctgtgagcacagtggacgtggcggcgggggggtgccctccatggccctcataccttttcatgc

SEQ ID NO: 59595 - DNA, 1018 bp, Homo sapiens
atcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcatacgcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaagg

SEQ ID NO: 59596 - DNA, 3332 bp, Homo sapiens
gcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagctacttgttggctactggccacgatccgagatgataggttcccagacccagcggccactggagaattgtagaacagcaggatagcaggtggtaagacgtggcctacgagtggcccagttccagtaaagcaacttaaccgagaagcaaaagcttgactccttaacccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatctcagcactttgggaggccgaggcgggcagatcacctgaggtcaggagttcaagaccagcctgaccaacatggtgaaaccccgtctctactaaaatataaaaattagccgggtgtggtggcaggtgcctgtagtcccagctacccgggaggctgaggcaggagaatcgcttgaacccgggaggcggaggttgcagtgagacgagattgcaccacctcactccagcctgggccacaaagcgagactccgtctcaaaaaacaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccctctcctccccagcttccctctcgccccacaactcccacgcttgtctgacaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgatctcactcccagagagttttaccacctcttcttctgtgtggccaccagggggacgtagtgtggccgagactccaggggtgcccgtgagcacccgaggcgctgaggagggctgggtcgcagtctcctgtgattgtaccagcattaaaaatcgctgtgtgtgtgtgtgtgtgtgtgtgtgtgtgctgagcctaaattttctttgagcctccaatacccattatgatgaacccctgccttgatgctgagggtagaaattgaactgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggacctaccttcgcactgtgaatgtgaagatgagcctctttcacagactggattccgtcattgctttcactgctctttcgcctgctttagctagatttttgggtctgtgaaagttgggtgtgcaatgggagggactgaagcttcttttttccctaattgttacctaattggaactcgcccagagggaacgggtggagaatttgagagcggtcgctgcagttagctgagtttctttttaattccagggtcctctgctataaataactgttttttttttttttttttcagattgtaaatatgtaacaaatgcatagggtcaaatttatgaaaaccaaaatacgtggggcaaaaacacccc

SEQ ID NO: 59597 - DNA, 6751 bp, Homo sapiens
tatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaagctgccgagacccccacctgccctcctgtgtgcctcaggcccctcctggtcccaggtcacccacaccgtctggcttccagcgagcgcttctcggagaaacagccggctccccacagccagtcttggtcagtcctgagctcgggtattccacagtaaagtgagcgacatcacctgtctgaaaagcataaggagactcccacgtggcggtgctgaggggccacatcctgggcaccaggccagccagtgccccgacatgagtgttgctggctgggaagcagctggcatttggattgaagtcctgcaaaaactgccatggccagagcctgccaggcagagcctgcacagagcggcccaagagctgggcacgtgctgggcctgggtggaggtggaggctgtgccatggggtgcgggggaccctgctcacagctcaccttgtggtcacccagcactgaccccgttcacagctcgccttgtggtcacccagcactgacccacccgccccaccctcctatccaccgtgctgtgaactcacctgccacgggtctacacccactgtccgaagccctcggcccacacgggctccaggccttgggatgctttgcgttgcaccagggctgcagagcccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacaccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacgccctcctgggcaggcggtttcaccaacatgtgccttgggaggggtggattctgccagtcgtgggtgtggtgctgacacccacatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgagtccgagcctcagcctcccactcgagctgaggggcgtgtcctggccatctctctcctaggcttctccctgtgttccccagtgctgtggtggtcttgcagaggctggccctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccatgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttctcagcagcaggatcgcctctgcgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggagaagtcttaaagccttacagcgtcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcaggtatgtgacggggctggcctcagggcccgtccccttgggatccactgggtgctgcggagtgaatcatcgtgtctagggtggtttgctttccaaggggcatggagatggagatgctacagaacatgccacgc

SEQ ID NO: 59598 - DNA, 1061 bp, Homo sapiens
aagactgcagtgggtgtctgaacctggggatagtacccgccccctgtatacacgaggttgcttccatctgataaccaaggtggctactgagtgactcgggcaggaggcacagacagcatggagatgcagggcacagggatgattgacgttctgggtgggacagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagcccctgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtataggcacccaccaccacacccagctaatttttgtatttttagtagagatggggtttcaccacgttggccaggctggtctcaaactcctgacctcagatgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattt

SEQ ID NO: 59599 - DNA, 1265 bp, Homo sapiens
gtgttatgagctgagcctgggacacagggtccaggcctcctaacttgcacacactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcggtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttctgtaagttacatattctaagaaatctttaaactgaagtttcaagaaacatgacttttttataatactcttgttaatggctccaacatggctgttccccactcattcctgagtggctctttgtgccagcatctttctcacccccacccccctcagctttcttaatcagtcatagcagatgtgtgcttttattccggcaaaccactatcactgccag

SEQ ID NO: 59600 - DNA, 1067 bp, Homo sapiens
gaaaaatgacagtctataaaaaccagtgatgtgaatagtttcaatgggtttgtctttttgaagaactgactttggctttgattctttctacagcgattttcttttgctaatttagctatggatgctttttgcctctcagtgtgtgtatgtgtgagcataaattagtgtcctgtaatttaagctaatttccctattccactatttagtgaaaaattctctccactgggaggaaaaaacaaaagctgctttccaggaagccctcggggcagtcccacaggagcagagctgcacgaggccaggtgctggccccactgcgcggctgttctcagtctcactgggcttccaggccgggttcagcatggttctgaggaatctcagttctcatctcgccccgtgattctgctcccccacctgcccatgttgacagggtgttattaatcttttttaaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgggaggcagaggttgcagtgagctgagattgcaccactgtactcaagcctggcgacagagcgagactccaccactgggtcttcgggaataattttaaacaatggtttcatttgatcctgaaattggctttatcatctagttgattcagccgac

SEQ ID NO: 59601 - DNA, 1621 bp, Homo sapiens
attcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaacagtcctctgttttagttttttaagtaggagattagtacctcaatctatgggtggctactaaaggttttctcagttttgtgggcaaagattagcaaaatatttttatagggatcactgaactatgcacacgtcatacaaggagaacaaagccaggagttcacacaggccaaggggaaggccacgtttactcaccattccatatctgccatgtgtcagtttccatccacagcagcaggccgggaccctgggcctcgaccccaggctcctgctctcctttgaaagtaaaacatgaatcttagttacttgtcctcttgattgcaatcctagctgcatgttaaaaccaccaaggggtgggtggggcggaggtgggttcaaaaatctgatagccagcttctcctccaggccaagccacagtcctcgctgggacctaggttggaactctccggaagactcctgccagagtagacacggctgctgggatgacagccctgctgccctggtgggcccccctcctgtagggacagcgtttctgcctcttagctctagtctgcaagagagaacagctgcgcctcagaaatgggggcagagagctgggtggagggagaggagaggccaaaaacaaactctgtttgggaaatcagagtccgacagccaagaaagagctagcgcggaggctttcctttctggctctgtaacgatgaagcaagcgcttactcaccccaacccacttgcttctcaggacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataatgactcaagcagaggttaagtcagagttgccctttatttttagattcttaaatattctagaatgaggtaaaacgagcctgccagtacaaagtgaaaattctacatggtgcatctttggcgcttcatgcatgattatttcaatgaacctcttcctggtcactcttaagatagatctgagtttttgactcgccagtcaagggctttggcgacactcaatgacataatattcttggaaaaagcagtagcatttctgacttttcatattcagctcggaggtgtattgtctcgggctcctgtgcagtcgagcgccacggctgctcattggatgatccaggatgggtccttggcaattttcgggttctcgg

SEQ ID NO: 59602 - DNA, 1070 bp, Homo sapiens
tctggatttttctcttttctcttggaaacttgattttcagaaacctgtgcccagcagctctggtggagatgcccacgttccccatggctcccaggtcattaggaagctggtcatggtaagaaccacagcccatccgggttgccagcgggtgggtgcttccctgcatggctgtgtctgccactgatgttcgaatgttcctccgtccgcctgtctgtggggctggcgtgtccctagagttgcgagttcagtgcatcctttgtcactgccaccctgagccttttctctctcagacagtactgagtgaaggccctggtgggggtgtgtcctcctgtgccgaggagggccctggtatggggtgcgtcttccctgtgcccaggaagagggctactgctctgggtggtctcctcccgggcaactcacccttctttgaacgtagctcccgagctgagtcgatgccagtggagcggtctgacagatcctttccgcgactcagcctggtgctgatgctgtttggtttggttccttgtggagtagagtgatttaacacattcctatgatataatatgatatgaaatataaatatgtaactgtgatataaacggcgtagaatgaaatgtttttaattgaacagtatacgttaaggcatcacgtcaagattggaggacttcatgtcagttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccctggcagatgaagactcacttcctgatgcccttcccggtgaattacgtgggtgaatgcatccgaactgtcccctacacggacccagatcatgccaggtaggagggtgtaggtcgggacctctcaggcctgagccttacggaagagctt

SEQ ID NO: 59603 - DNA, 1045 bp, Homo sapiens
ggagaaactggggtctccctggggaagggggcacatgaactctcgagggcgaaggccagagtgcacctgcttatgaccttcgaagtgtagagaggttggcaaagccgcagttattgaattaatggaagcaacttgtaactcaagatgcacgattttaaaaatgattcagtaaagactgacttgtaatcggggcgatgcttctctgctgtgtcaggctgggctgcggccttcttgactaccgggagcaggctcagcagatagaattgaagaccggagggatgagtgcttctccccacgtgctccccgacgactcacacatggacacctacgagcaggtagcctggtaccgtcagacgactgctgcggtgggaagcttttctccagtgtctgtcactgttcgattcggccctaattcctttcttctgtgttttctttggttcagggtgtgcttttctcctctctctgcctggatcgaaacctgccagacatgatgcagctatggagtgaaatatttaacaagtaactttatttgcaagagttgtccattcttggggtgtactagagatctttgtttgaagtactttaaaggagacagttttactcgtgtgtgttgttgttttccaagtctgacttttacttgtagttcatatggacttataaaatttctttggttgttaaagtactctgaaaacttaatcaactttccatgatactgaagggacgtgaggaatgggtctccaggaattttttcttctcctttttccatagcccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgggaagcttggaaggaacctctattactccggtttagccacatattccagagttactaatttctttgggaatacattaatttatgtcccagaaatgctaactttctaac

SEQ ID NO: 59604 - DNA, 1031 bp, Homo sapiens
gcgcttgtcatgtttgtatctcatttattttcatgtgtgtgtgtgtgtgggcgcatgtgagtggaactcgaggctgacatctctctgatctgttaaccctggcagtttttgtccgtgaatctcattaagtgtttgctaagagtgagaataaatcagtcatccttccgcaccttggtccctccgctggtctagggtgctctgctaggtagggacatatgaagctgaatgtccagccctccccttgaggtcaggatgggtgggtgggggacaccaggagccttgtttggggccctggggcagccttctgttgtggggccagagggtggcagggcctgttggggaagatgagcagcgctgaggacgggtgcgatgtgggcccaggggtctcgggggcacctggtcagagttccctctggttgacggggagaggttgggtaactggaactcgcagttatgagaccagaagttcgtggttccatccttccgttcccattccttggagagcacgggttgctttactattgaagacagttccagtttttagtcatgaaaatatgattgggaaatttatataaactctagtataagtcttaaacctccattcttgaaaaaacaataaatagcattgtttttaaatattacaagtggttagaattttactggcagcaataaaaattaaatcccttttgtttttctagctggagatatccctgttcagtactgcgcccagcccaccaatggcatggtgtatttccgggccttctccagcctgaacacactccccgaggagctgaggccctatgtgcccctcttctgcagcgtcctcaccaagtacgagtcgcaacatacccttgtgtgtcttattaatgtctgctttgtgtgcatatctgtattctaatgcatcagtaggaattaccttcagtgaatcacaacttacaatgttagtgtgtaagtatggtgtacaatatattggtttagaattttttatgaaagtaacattttcttactatattacattgaaatagttatga

SEQ ID NO: 59605 - DNA, 1023 bp, Homo sapiens
ctgttttgatatttatcctgccataactcaaaagtttaaattttatttttaaaaaatgatgtaaaaatgacatggatgtacacagaaccagttacttgagaacactgctttaatgagcttttcagtggaggggctggagtttaaggcgcttcgttctgatctttaaatcaagcatattacgagggcatgatgaacgtgcccggattccagtgcatcatttctggttttgtcttctagatataatggctacacgagggaggcctactttagtgtcggcctccaagggattgcggagaaagacattgagaccgtcagaagcctcatagacagaacgattgatgaagtagttgagtgagtgtagcttgtttgtaacaatctgctttcgttcctcattcctgtgtgctttttgggagaagctgagcctgatccattgtttcggccttccttctctgtcatataacatgcttttgttcatatttagttgtttaaatattatctctgctaccttctgttactaaaactcttcaacatcttaggtttttgttttgttttgagacagggtctcgctttgtcacccagcctgctgtgcagtggcgtgatctcagctcactgcattttcctcccctaccaggctcaggtgatccttccacctcagcctcccaagtagctggaactagggtgcacaccaccatgcccagctaatttttgtgtagtagagatgggctttctctgtgttgcccaagctggtcttaaatgcctggcctcaagcagtcctcctgccttggcctcccaaagtgctgggattacaagcatgagccattgtgtctggcccatctttgttcttcattgtattctttaggaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaac

SEQ ID NO: 59606 - DNA, 1077 bp, Homo sapiens
aggaatagcaccatgccctgtgaatgaacgttgaatttataaattaggcacagcgagaggttaacaacaataactaataataaaatagaacaattataacaatatactgtaataagttacatgaattttggtctctcgaagtaccgtgatatttttggaccttggttgagtaagggtgactgaaaccgaaaggcgagaccttgggtaaggggcactcctgtgctgtgtttcagtgaaacagacagcacttgatctcacatcttttaaactaaaacagactaattatattcccttaaaattttaggttcttcacgtacggtaattttccattagaacagcatctgaaacaaattcacgaggaagcactgagcaaattccagaaaattgaaccaagcaccgtggtgccagctcagacaccctgggacaagcctgtgagtgccccaccgtgtttgtgtccttcctggtaaatatgttgacatgaggacttggactgggtattgatgatgggatttcagatgctgtcatgtttggtacagagtatgggagagcttttcaagctgaaagaatggtaatttgtttgaaaggaaagttaacttagtggaaagcctgtttcgctccatttcgtgtatccagataacctagagtagttgacaaccgtcagacactgtgcctactcacaacgtcacgtcattttacagagggaattccagataacatgtggcccggattcatttgctacagatccctctaaacaaacaaccatcagcgttagcttcctcttaccggagtaagtatatgctgtcaaagctcatacaagacaaaaacatgaggaaaatgttcctattagaaggttcggaagtgagttctacaattgaatgttaattaatatacggttaggattcaggggttaagtggattttaggaatagagaacaaaatgtcgaagtttttaataacatccaaaatggtttttgaggaaaatcgtttttgatagccctccggaagaaaagtaatttacttattgtatttcaaagctttattcctacagagaaaagactgcctcagaccagcaggtgct

SEQ ID NO: 59607 - DNA, 2046 bp, Homo sapiens
gctcacccatgatgacacaggagccaggtatttacacctggccagagaagacacgaataatctgttcaggtgtgtggtgcattgtaagaacatggtcttgaatgtttttatttaaatcaggaatgtccattcttttggcttccctgtgccacaatggaagaagaacaactgtcttaggccacgcataaaatacactaacactaaggacagctgatgagctaaaaataataaataaaggacccctcaatgttttaagaaagtgtatgaatttgtgttgggctgcatttcaagccatcctgagcatgcgggctgcaggctgcgggttggacaagcttgatttaaaacatggctatacattacgtggtttaaaatatcatctcactagtatttttattgacagagcatcttgaaaaataaggaaaagtttacactgacttataatctcatcaaaatacaattttacagtctgagtcaatgatttacattatagttggaaaaccctgtgctggaggattgtggtgtcagaatgatgatttctagtagcctgaggtgatgatgcatctgggaactgtgtccgcagcactaagctgaaccttttgcgttctggtcattctccttccctagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacaggtaagaccagcatcctgaacagaaactgcttttgggtttgccaggcacacccactggaattcagttagtttctgagaaggaatgaggggagtgggcaattcatgttctagaaaaatttttacctctctctagttgaaggacattagaaatttaatccttcaggaaagccacatggtagcgagattgtaaaaactagcgttttaagaaaacatatgtgaacttttcccagaaaagttcaaaacaattttctcttggagatatcgctacaatgccagagttactactaatgttgatgtttgacttttagtaagactgacgatagtggatagggtgacgatgaacagtgcattctgtgggggagtgacattgaagagcgggttaaatccatgctgttacagaatgaggtcatctttgtagatgtatgaaagtctctggagaaacttgagagagtttagatattcgctgaagaaagccctggtgcccgtcgagtgcagatcctgagacgggatgggaaagccggcacttggggttatgagctgggacagctgctgaggccagggaccagagcatggggccactgccccatcccaagaatagctacagcttactgtcctaggacaaagggggaatgagtcttgagagtcaataattttagtagaaatctgttatattttacaatttcacttttcatttgtacccagctagtgattatactctgtatccattttccacacaaaatcccaaggactttcagaatctcctctcggtgtatttggatgccacctttttcccatgtttacgcgagctggatttctggtatgtcatgaatgattaactagttgatacagactttagtatttgagtcactatcagcttataatgatttgtcctcaggcaggaaggatggcggctggaacatgagaatccgagcgacccccagacgcccttggtctttaaaggagtcgtctttaatgagatgaagggagcgtttgtaagttttcttccttttttatgttgtgttcagcttacctttcccatgtacaatatcatgatatagacacatctggaagattttatttaatattctcattataggtgatacattcttgaattagctggggtcagtgctgtgagcagaagtcggggtagcagggccaggctgctgttcttcccagcaggtctcagaccatgtctggggacccctggtatgtgatctgcagcaagtctgtgagataaaagctattttcataccactaccaagacagtgtct

SEQ ID NO: 59608 - DNA, 1044 bp, Homo sapiens
cttttccaaagttattccactttgtactccctgtagcagtgtatgagagttcccggtaatattaggctttttaagttttcagcaattcggtaggcatgtaatgggatttaactgtagtgtgaatttcttggtatactgtgaaggcttttgaggattctgtgaaggaaagaagcccttttgtttaagagttgtctcttaaacaaggggaatttaaactgtaattgtattatagttatttgtgaacaagtgtaaagaaaaggtttccaacattgaagctttagttaagataaagatcattaaaatggaaaggaccttaccagaaatcagttttctggaatgtgcaagactttggaagatgcaatatttaatttttctttaataatctttattacatgagagtattttcactatgtggctgaataatgttagccagatacttttcctgcaactcatctaacttagatgacttttaatctagacatgcacaccacagagcgtggcgatggaacagtaaccgggcttgtgagagggctctgcagtataaactaggagacaagatccatggattcaccgtaaaccaggtatgggtcgtcctcggcacctccttataaatccacatacattgcaggtgcggcttctggcctatgtacggagcccttcagggcggagactagcgtttttgtccttgtgtcccaaggccctggcccagctcctgctgtgtggcagctactcggctgaacagagcttgtgagtgaaatgagccccagtcccttcctggaatcccgcaaagcctggttcttgtgagattttagagagtaacacttccagctgggtctctgtaatcagacacactagcgtttctgcagccaaacctgatgtttcactgagcatgagcatgaagactcactgccctgatctgtttagtcaggttttgccatcaaatagcttgctctaaacgtccgcagaacctttcagttttctgagccattcgggtttcagaatgataaagaagcaattgtggacctgtacttacttgggtctgta

SEQ ID NO: 59609 - DNA, 1075 bp, Homo sapiens
actagtgatgtcgagaaactcaccttcagcaagtgtgaaactcgtatgtgctctaagggacctgaggaaatgaacatttcttcaaataaaccataactcaacggatcagaatgatccattagcctgatttttgcctgcttgttgcatatttaggaagcagagctcaacctcagggaaaacaggtcgtgttaggggctgctgtaagaaatcatgtcgaatgtatttccccaggttggtgtttatggtgtagactcccgctccacatgtaatttaaaggttgatgagatttatattgggaatgacaaggcaaggtactggatcatctgaaatcattaaagggatgttggtgtgggctcactgacttctgtttatggagacaaggaataaggaaacaagctcatattttatataaagaatttcacaagccaatgggaacaattcagtaatgcttctttagccaaggcgctatgacttgaatacccggctctattaagcttataagaaatcaaagttcaggagagaagttagagctttgctgcaccacacaactctggaagctcctggaatattttcttagaagaaggagaaggaagaggaggaagaggcaaagcaaaactaaagtacagtcggtagcctttgcagtgcaggagcccacagttgtgatgtgcagatctggcttctccaggggcggggctcaggcacttatgaatgaattggcttagaagcctctactgtgaggttctgggtctgtttatcaaacccatgccggaaacgtcggagttgttaatagctttggagtgagacataccagggttcaaaccttaattacatcagctgctagctgggtaaccttggcaagttacctaaactaagctgggtaaccttggcaagttgtctaaatgaagctgacctctgtcaacctaaataacaaagaaggaaactatctaaaggacaatggtgtttattcgggcgtaggcattaagatgggcatgtgtgtgccatggtaaactaattgcttatccagagaagtaaaaagagataattttttttaagaaaatgaggattgcagaattgt

SEQ ID NO: 59610 - DNA, 1069 bp, Homo sapiens
tgttgaatgagtcaccatcgccacacagctgcttgttccagagcagctatggtggggacattgtctaggatcccaggaaaagtgaaaacattgaccggaatgtttccagcacaatgaatgtgataacagagaatgaataagtggaacagctccaacacagccaagaagatgttgctttatgagagctgactttccccagagcagtgcgctcccatcacaaggaggattaattcatacatttcaaggcctaaatgacagacgataaatgtgtgtaattatgtaagtgagcccactgtgttagtatgcaaaggtgcccacttttcctgcatcagatattgaccctcttccatgtcaaaattcagagagtgacagctgccaatctcaccccagcatcctcacctgctaaccaggtatctgtactcactcagcgtgcctgcttggcgaatctcagctgagtcagttacaacaggtcccctttcagacaggtgatgattagaaggtttgtgactcaaagagcatgacgtgttccctttcctctgcagcaggaagatactccctgatatcgtagcagtgactcagcctgccaagacaatccatttcattcttgtaccattcttgcataaatcacagtgcagaaagcttggcaagataatttttaaattttaaactcgaccaggagaactgttgagaaataagacttcatattgaagtacgtttcctctcctcggaagctttcaagaggcgatgctgggtgaagggttactccaaggtaaataaatggtactgtacttggtagtaaacaggagctgagtgctgattcagccagtcacaggccgttccttcctgaagaactcaaaagctgttagcatgtaaagtgggctcttccacaaggtgacagatcaatcaaactctgtcatctcccaaacctctttgaggcagggttccatcaacagataccatctttgttcactttacagtttggggggtgaggagaagggcagaaaaagaactctcattggaaatattatttaatgttttaaattaactcaaaagatcttatgttaatata

SEQ ID NO: 59611 - DNA, 1679 bp, Homo sapiens
tatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggac

SEQ ID NO: 59612 - DNA, 1592 bp, Homo sapiens
ggggccttgggaatgtgatgaccagggttgagtaggtgtgcagggcacattcgaaggaaggcatgcagtttcctatgtgtgaacatttcttttcaagcctgggactttttagaaagtttctggtgtgctcattgtccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaacttcttctgtgcttctgatttgcccttgcaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagc

SEQ ID NO: 59613 - DNA, 1107 bp, Homo sapiens
gtgggactcccagcagggccgtggagtaatttccccttgcacccttcacaatagcagatggccatgctggaattatttctgcactcctgttgttgaagttccttgtttttctctgaccactgtagaagtaattaaagttctgtgtcatgcaagggcctgcacttgggaacggcattctgtgaaaacataggcggtctgggctacacaggaaatgggtggtttttctgcagctccattcgatgcccctgaatacagacagctgctgtctcctctcccccgagtgtggccctgtgttgtcagccgtgtccccaagggggtccctcagaacacgctgtgtgccgtgcagtctttctgtcctgtgtgggtatctgtggagtgtgaagggtggatggctggggctttccttaaaacacatggttcttgacaatgtcagataatctggttgaacctgttggggaggagtatgtgtatggggccggttctcttcctctggtttcatgagaaacatcaacactggtaactacaacaaaaaaaccggcttagtgatcatcactcattgtggcccttggcccaacattgggaaagccaggagaggtttcaccctccgacttttcctctgaattcttaccattctagaaacagatttcctctaacttccgtaaggacacggatgcttaattacaaaaggttttgcccctgtagtgaccgggcagcaatgttatctgtccttcattcttgcatgtttttggaaattgcttttgcttttacttttggtcgtcatggcaatcacgtgccttctctggttcattttgcacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattgg

SEQ ID NO: 59614 - DNA, 1918 bp, Homo sapiens
aaaaatagcctgcgaggccactttccaatcagaacgagcagagttcgaattgagccaatggtgcgggccgtgatggagagtctcggtcacgccaggcggggccgctgtgtgtcgccgcctgcgattggccggagctgacatcatcggcgcgcagcccccgggccgggagccacgggattgggccgcgcacggggcgggcgcggggcgagtcacgtggggggagggggagtggggggagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacaggtaaacgcagccggccgcggttccctgcgggcgccggggcgcgggccgggtcggctgtttggggttcagacccggtgctctctgcggtccgctgggcctgggccccgcgctgtcaccgggggagcgggcgcagcgcccccgccgatcgatcctccaggctgcgatcagcgtccgcccagggaagccccaactcccggcacagcccggccgagcccctggcacgagttcggagcctgtccccgctccagacgccacagctggagcttgtcatggggaccaacttgctctgcctgccaaggtgttttttttttgtttgtttgttttttgttgtttttttttaacggattttgtttttgttttgtttcttggtgcttgtacttaacagttttttaaaaaaatcacattttgcccccagaacgtagaccagctctcttttatttttgtcttttttaaactgtagaccatttccaatgtgttttctgctctttggaatgcctaacatttcccctagatctgccttatttgtcttccctgcttctcttgttgaccaagaaaaataaaaataaaactgtgtacaccccagtgacttgtcagtcttgtgacaatgagcccgtccaaactgcttcaagtcttagtttggaaagaaggacctcggtttccgacattgtcgtagaactggaatttgggggcattggaaatttaagaaacttaccaggtccccgtgcttataggtagcatcgcccgaggggagagagactgacactcctcccattgtctctccagcgatcgcaggagggtttactgttgtctccctgccctgctgtgctgtttgtttttcgtcacaaagtgaattgccagatcaaatagaggctgtgggtttccaagcctcgaaagctttaaggaagatgaaatgcagggtgttgcaaccttcacacgcctgcttaattgttcacagtcctctcctgccttttccccctccccctcctgtttttttcctcctcaaagaagctgctccctaggacgtgattgaaattgatctaagtagtttccttcgggcgtttgggatttgggcaaacggccagacctggctcttggtcgcctttggaggcttttaaactctccgagagcttcgttcaggtcccgggtgctcatcagcgtaatggagattttaaattggccggattattaaagtttaacaagatctccataaatgtgcttttcttttttctttgttaaatcaataaaatacatcgctgctgcctctcttcagaacgctgtagtgtgcattgtaactcagacgcctggtttcggggg

SEQ ID NO: 59615 - DNA, 1065 bp, Homo sapiens
cagtgattggtggcacaggaattcaagcccgagtctgcatgcctgtccacatagaggcaggcgtcagggccgcaggtgctgccgtatggacatatgttaacttacgctaacttgcctttaggactcatctttgctgttatttgcttacgacagagctgcttctataattatgacaggattccctgccttaggaaaggtgagtctgagagaggagagaatctggagttatgctggctcaatgaacactcttcatctgattcttgaattccttgctcttcattcctgaccaggcttatcttctgttgggaaattccagcaacagggaccttgtttcagagctaccggactgtaacatctggtagcgatccctgaaagagtaatcgggagaagcactggttggagggttgaggagggggaactcaacaccccacctccaacccccaaaagaaacctctgtgtgtgtgttcctgtatgtacgcgtgcgtgtgttcctgtatgtacgcgcacgtgcgttcctgtatgtacgcgcgcgtgtgttcctgtatgtacgcgtgtgtgttcctgtatgtacgcgcgtgtgtgttcctgtatgtacatgtgtgtgtctgtggtctccgagcgtgtctgtgtgcttctgtgtctccatgtgtatatttaggtgtgtgtgaccctgtgtatgtctgcacttgcacctgtgcccgtgttcgcgtatgcttctgggggtgtgtatgtgctcgtgtgcatgtgtgtattcatgtctgtgtgtacagtacatgtgtgtctgtgtgtgctgggtgtgtatgtgtgtatatgtactgctgtgtgtctctgtgtgtatgttcatgtatatatgtgtgcatgtgtctgtgtgtatggctgtgcatgagcttatgtgtgcgtgtctttgtgagtgtgtaagtgtatagacgtgtgtccatgtgtatgtataagggtgtgtatatgtgtatctgtgtgactatgcatctgcgtgtgcacatatgtgtctgtgtgtctgtgtgtgcatgtgtctgtatacatgtgcatggccatatgtgtatctgtgta

SEQ ID NO: 59616 - DNA, 1048 bp, Homo sapiens
atttctgggcctgctggttttgagatcccttgcagcttcatgcttctacaatgttgccttggcagcttggaaaagaagcagaatggagaagagagccaaggccaggtgggggtgaggacggaatagagacactggaatgaacttccctgacccagggcatgctttcagctggaactttaggagagatgtctccactgcatggctctgtgggcagcacctcccactgcctgcctctggcccggtgaggtggcttcttgttgtgcacgtttcttcctctgtcattgcattattttgttcaggaccctacatccccctccttcttatactagactgtgagcttcctgaggcagagaatggattcatctgcattgtccctgaactggtcacacagcacaggatcaatagtgtttccgtgggctcagttgacctgtttgttctttgtattttctttttcttttgtcttctcatggttcttcttgctgacgggtgaggaaattgatggctcatggatgcagtgacctgaaggcttgcgatttctgccctgatatctttctactccataaacctgcttctcccaggcaggtgtggcccagagaggtcatatgatttagaattacagttttactagaggagtctgtgaagatcactgcttgaccctcgtttctttttagtcttcttttaatggtctttgtgtctgttctatctgtgtgttttatgtgaatccactgcaaatctttattggaagcatctgtggtacaaattaataagaagaaaatattggagtccacatagtataaatatgactggttaaatcttttcaaatatttaggtgtattttttttcctaaaccaatgctctacctaaactaatgttccacacaaaattttcttttgcaactttagaagcacttttcatgagcattatagcacaagctagcacaatctaaaaagaaaggaaatattagaattgattctttagcaattttgcacagatgtgttttgcaatgagcagtggcctgtactttatcatgcatctttaaaggaagtgg

SEQ ID NO: 59617 - DNA, 1063 bp, Homo sapiens
cctacatgtctagattgttcttagtgttggtgagacatctatgaacaaaacaaattcaaacaaaaatctctatcttcatgaggcttagatcttggtgacacagaaagacagtgagcaaatatgtaaaatctatgagatgtcagatagtgatagatgctgtagaggaaaataaaggccgggggagatgagagctatggtgtgttaacaatctttatctgagtgctcagggaaggccctgcagagcaggtggtattggaacattcagatgatgtaggtgtccccaaggccgtggactcagagaccatgacacctgctggcctcttggagattgctctgtccagactcctcacaacagaaacacttaggcctggagctgggccccatggctactcggtgacagccaagactttgacgcaggtcttctcttgtagagcttttcttgaacactagtggtctgaattttatgtaagctatgattctgttatagattgagtgccacccatatcttactcagaagaatctgatcagtttttgccaatccagagatgtgtccgtgactgcttaccgtcctcttggtggctcgtggtaaggatacctcagtggtgtgttagtcagagtccgactgggaagtagatgccaccttctcatttccttgggatgactgagggagggcttaatggaggttttgacagggtgtggagggatggtactatagggggctgtccacacctctcaagcctgggattgaaggcatggtttattattggaagccagggagtggctgtgagtgggctgccctgggagggtcaggacctcttcagggacgtaaatcagcctggagtgacccctttgctgagttccccaccagggtgtcagcccccttctgacctcctgacaaggatgctccccaggcctctccatggttggatgaggcaaagcctgctgtcatctttacccaggccctcctgcagctgtactgtgctcccaagatcagctaagagacctccagccattcagccacctaagccagaagcttggaaatcatcccttcccacatcccgag

SEQ ID NO: 59618 - DNA, 1046 bp, Homo sapiens
gagaaggaccctgttatattatacacttatatataatatatacacaattacatactatgtatacaatatagagaacagaaatcacctttgttataaaatatctagtacacagataatcaagtttttaaaaagatccagaaaaaatatctacctctaagaaatactgaattttgaaatctgaagtagcccagtttacccgtaacctcatgggagattttcttctggaagagaggtaacagaagtgcacctgctgtatttaccctgctagtcttaagaaaaagtgggaactatttaaagacttagataatctattttataattgtgaatatgcttgcacttctgtaaaataaaagcaggtttcctggaaaattaggcttttcttcattatatatgttgattcagccctatcgaataagaatttctatttccttatttgagttgtcaagttgtccatactgaacttattcccatgcaatagggttttatgggaaaagtctgcctgtctgtgactaagcaccagagtagataacgtaacaatttgttttacttcgggaatgcattttaaatcaggaagagaagtttctgtcctacttgaacccagcttcactctcctcctgggcgaaagctgagaggcctaggtgtgcccagctctcagttaactgaagtcacgtggtggtggaccccgcccccagggcccggttggctgtggccccgcccccgagccctggggtcggtgcttgctgcctgcggctctcagaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggtaagactttaagagaaacgttaggcaaaaggaatgttttc

SEQ ID NO: 59619 - DNA, 1025 bp, Homo sapiens
tagtctgacctggtgtgcatttttcttccatctgatgagttcattgtatgccacttttttcttcagaaggaaagaggcatgttagaatatttaaaccagtgactcattatttttaccctccttgctttgtctgagtctttttttagtctttatgaacatttatcaatataaatcaaattactttatgccattttatgtaatcttgatttaacattgtgtgatattctgtttatactatatactttaatatatactacattgtcacttatatgctaggaatagtgttcctgcattcagttaactgtgtatctcttgattgtggtagtggtttccgtctctatacacacgtcaaaacttatctaattgtgcattttaaatatgtaaagcttactgaataccccagcaaagttgcttgtcatgtgtacacatacacacaccttttggtagttaaaatagctgccgtcttcaggaagtacacttttatttggtgtggtttggctttggtttttgttcttggttttggtctttgcctatgtgtcggttttctcaaaatgtgtaagtatttcctttgagtagagcagtcatccacagtcactagtgtgaatcctgcagcttatcatctgttgggcccatagaagctggcctttgtttagtatcagcatgggctgtgtttctgccttacctttatttctaagttacaagcactaggaatgttgtcacggttttagatctagtgacacagctctaaataatttgagtatttctagaaaaggaattcatcccatgtgatcataactcgtttttatctttttaaaaataacttttattttcttttgattttaaagttttgctaaagattttaagagaagattatttaactattataacccaaaggaatagacccaggtgcatactattttttttattcagtgtcttgatatgattggttatagaagagaccctcctaaaatatgttctctaactggcatcattagaagaaaaagcctttctacagaatgctgact

SEQ ID NO: 59620 - DNA, 1021 bp, Homo sapiens
gtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccctgaaggtttcttgcctggtggctatgttgggggcatttggcaaaatatgctggtgtggcaaaggaggtagtggtaagcctcataaaagttagtaaaaattgtagttcaacctttgaaatcattgatgaatcagcgaaaggtaggtaagtcttgtgttaggaaatcttttaagaacatggtgtaatcagacacagcaattgtattgaaaataactgaacacctgttactttctggataggatagtaagggtagtagtggcaaaggatcctgattaatttcagattttaatgtaagtacctcaggttcttgtctttggaaattcacattcataagtgtatattacaccaatgattgtgatctgcaacaccagaaagcaagatttctaatcatttccagaggtgttgtatagaatag

SEQ ID NO: 59621 - DNA, 1032 bp, Homo sapiens
aagtctggggggtttcctgggaggctgggctcagtgctgacagccgcaggtagacacagggcaggggggcagcgggggagttttccctgacccattctaggtggtgccccatgtcttctgttctcacagcaagaagccggccaggcccgtttctcccactgccttgagccctccgtcctcagcggggcgcagagccgtgtcctggcttcctgagggccatgcgggtcatgaactcctccctaggttgggacgcaggcctgcctggcttccctgccctgcaccaaggatggaggctgctgcccctgccgcgtctgtgtgcttgttgtctccagtgtccgtattcaaggacattcccccccttttccatttatcttaagggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggtgagtgggtgtttgcccgagcgggtgtttacctgagtgggtgtttgcccgagcgggtgtttacctgcgtgggtgtttgcccaagtgggtgtttgcccgagtgggtgtttacccgagtgggtgtttaccggagtggatgtttgcccgcgtgggtgtttaccggagtgggtgtttgcccgcgtgggtgtttaccccagtgggtgtttgcctgagtgggtgtttgcccgtgtgggtgtttacctgcgtgggtgtttacccccgggggtgtttgcccgcgtgggtgtttacccgagggggtgtttgcccgagtgggtgtttgcccgcgtgggtgtttacctgcgtggttgtttacccccgtgggtgtttacccgagggggtgtttgcctgcgtgggtgtttgcctgcgtgggtgtttacctgagtgggtgtttacctgagtaggtgtttgcccgcgtgggtgtttacccgagtgggtgtttgcccgagtgggtgtttacctgagtgggtgtttgcctgcgtgg

SEQ ID NO: 59622 - DNA, 1046 bp, Homo sapiens
ccctaacggtgcaagaatacccttctgtcgaaaaactgccttataggaatgggtgactgtatgcggtatgtcctgtactgtacatcaataaataactaagccaggccagaaaaagggtgacaaaaggtccacaattatgttaaggaagaccaagacggtatatttgaagttttgtgtatacagaacatttgcccaaatgtaactaatttttttaaagggagattataagcatctcctgtggtccaaacatagttgttaaaatgggttaaaatcggtgaagtgcctaagaacttgactgagacatggtgtttgttaaatacagtatactatctattcagtaaaaatagatcaatatggcatgtatttatcaagtgaatttcatttttctgttggtagacattcaagttattttcaagatatccctataactgacaatactgcagtgattatctcttgctgttataaacagtgcttcaggtggtcatgatagtatttctgtagaattgactccttatgagagtgctggataaccatgttgctaaattgccctgaaatgattgtacctttttatgttcactcgctcaaaagatgtgtttttatctccatgctagccagcactggatgataatggtatttttaaaatatcttagccacctagtaattgaaagtaacattctgttttaatttttatcttccttggtgaatacaaaagttaaatctttttaggcaggtcatatcatttgctgatgtttttattgagtctgagctctcttttctttcgcccatgtaactattactgtagcattttaattatcatagttttataatatattttggtactttcttttgaaaaagagctttgggtttttcttttgcattttttcttccagaagaaattaaaactatctttttaagtcctatagaaaatcttgggatattgtttgtgatggtgttgaatatataatctgagaagagacatttatttgagtttttccttctaagagaatatgtacatctcccttttctttaaaaattttttattgtga

SEQ ID NO: 59623 - DNA, 1056 bp, Homo sapiens
atggtttaatgccaaagcacaaactcataaacccagttgatgaggagccagaacaatggtcattactgtatagagatgttttaaaaagtcaccatataagctttgaaataattctaatgaaaattatatgaccttgaggctgggcgcggtggctcatgcctgtaatcccagcactttgggaggccgaggtgggtggatcacaaggtcaggagatcgagaccatcctggccaacatggtgaaaccctgtcactactaaaatacaaaaaattagccgggcatgatggtgcatgcctgtagtcccagcttcttgggaggctgaggtgggggaatcgcttgaacctgggaggcagagattgcagcgagccgagatcacgccactgcactccagcctgacgacagagtgagactccgtctcaaaaaaaaaaaaaaagaaagttatatgatcttgaatataaaaagtatggtctctaaagaatttgttgttgtttttacataatgtaggaggaaaaaaattgtggtgtttataagcatcagcctgattaccaaaaatactttttgtggtagactggattttgagaatgttaaaacaatcttcaaaaattgaatattaaatccaaaaataagcaagccacagctaaatgaaaaagtcatagtacataggtgtaatacactttactcaaggggtgtaattccaaaaaaaaagtttttaaaaaaggtaatttgtctcctactggatatactaaataccttagtgaattttttattttgaatagctctttgttaatctacataattgtttatgaatttaacttgctttataagttcaaattatcctatatgctatacaacacactaatggtaatgatgaataagatctactaattaggctttcttctgggcaatgcatgtgggtatcttagattgcttagttaaaacataatgagtaaagatgtccttagatcaggccaaacacttcatcttccccctgcacctccgtttgattaaatttttcgtaaattttgttagggctgcatggcttattgggaagggacctc

SEQ ID NO: 59624 - DNA, 1103 bp, Homo sapiens
aatcgtctgaattcaaataacacgctctgggttcttactaaaaatgacatttggcaacaagacattttgaaatttcatgcttctaaagctgtagttggaaaataaatcttctagtggacttacctgtgaccctgcttagtttggttttcctgacatttttgttgattgaaatggtaaaattctatgaaaagtttgggccattaatcaaaatacagattgctttgcataagttttctttgtgccccgaatacctacagtgagcagactatttattttaaagcttatggattaggccagatgcagttgtgcctcatgcctgtaatctcagcattttgggaggctgaggtgggaggattgcttgagcccaggaatttgagatcagcctgggcaatatagtgagaccttgtctctattgtataataaaaaataaaattaaaaaaaaaaaccttacagattatagcattttttcattgcttcaaagactgaagcaaagtaatcttttgtttaaaggcaaaattggtatgtcagtgtggactccgtgttggcagcagtgctgttaccactctgggtgatccagccaaaggtaagtccgtaaagcaaaaagaatcttaaaaaaaaatcttcttttacaagatgaagtgaggtttcattagttttataagatatgtatattaaaagccagtttcattaaatgtcaaacagttcataatgtttagatttctaactttaaacatatgaatgagatttgagtctaaaacttaacagtatttttcagtgtcaagagattggtattgtcttgagaatctcttctaaattgtcacaatggcaataagaatagaaaatagagctgaccgaacttggcaactatggaatgtgaggggtaagagaggaaataatcaaatataagcttttaaacttacactacagtgataattattaatagaaaagaggtacataagaagagaagcagattggtagagaagctgatgagttaaaaataaaaatattatctaattgtcaagaacaatgaattagcactaacttttttgaagattcagtttcttcatgtgtaaaacagattaaactactttatagagttgttg

SEQ ID NO: 59625 - DNA, 1031 bp, Homo sapiens
tgaatgagtaacacccaagatatatttctgactctaatgtgttaaatttcagggctcggtggggttgagaaaaacttggtacatatgcagttccatagtgctaccctgataatacttatttttcctctttcagtattacttttacgaactttcaggcaacaccgttattgaacgacccagacagatctgtccttatgtaattgtagcttttcgatacagggaatctaaaactatggcaccaccagctcataaaagcatgtaagtaattatgtgcatgctttgttttactgaatttgttccttttactcttgtaaacatgttctttttctttctttttctgctagacttgaacgcagtgaaaatggtaagaaatagttcattgattcttttaggttttttttttcttgagtaaatgtttcatcataaataatcagtttcttttttaccttcatttcttcagttctcatgtctccatggaaagggaaattaattgttcaagaccgtatgctatgtgatatagctctttggtccacttacggtgcaatgattccaacacagctgtaagtattaaatgttatgtcctttactaatgcttatattacaagttttggggttttttttcctcacctcatttcaagggtggcattggtgtaaaatacagcaactgttcttgattttagatgagggtatatttgggtaaatgtatagcacacagggtatgacatagtaaacctaaattctaatttattaatgggaaaatgacctcttgggataaattaaactattagatactagaaatttgaccttccccaagaaataaatcagatttgcctgatagcaaatatagcagattatagccacttaatcgtattatttttattaacatttgcagtatctgattttcaaattttaacatgattttcttagaaaaatgttagaatagctgttacatgtatttacattaaaagcaattatcatgattaatattttctcctggggaactgtgaagaacatcttaggaaatctttttg

SEQ ID NO: 59626 - DNA, 1049 bp, Homo sapiens
cccaaagttttgtttgtttgtttgtttttctttttttttcagttgttacaaagttattactctgatctttttcttcttcatctgatagggatataggcagacacttagcaagttcatattatatttatgtgagaatgtttaacttttgatttgttaaaatcttttaattaaatacctgaaacttcatagtttattccccattactaaagttactgtccccaaaataaaaacaaaacaaaacaaaaaatggaaaagctatgctaagtatctgggcccctaccccttacaaaaatgatgtcttttctacataaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctggtaagaaatactcttcctataaatttaaacaccccaatacagatctaacagagagtgcaagataatttattgaaatagtgtaagagcagttgcaatgtcccaataattttttctgtgtttttcagttcagacattaaaaaaactaagtaaactggtttcctaatgtaaataaattaggaaggtacaaaagctcaaaccttcaaaaacatagagcctactttttactttgcaaaaagcctgaacatgaattgtctacaagcattaaagtataaatggccttatttatgactaaatgcagaagcaagtagtatctggcattatttttctagaccattatcaattataaaaatagaagattataagtttatctaaagggaattataaacagactgtccaaaactgtcagtaatccagaatcctgtatttagttttatttatttagagacagggtctcactttacaatcactgcaaccttgacctcctgggctcaagg

SEQ ID NO: 59627 - DNA, 1048 bp, Homo sapiens
tgtataacataagttttatctgagggttggaagagaccttaatctaatagaaaattttaatatgcaatatatgttacataagtttttctcagacatgttgaattaaccatcatagtaatatggcagagagttaattctatgacaagcaaacatctctcttttttttttcttttatactgaagtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagta

SEQ ID NO: 59628 - DNA, 1051 bp, Homo sapiens
ctcctgtgatcctgggcaagtttcttgcttctggacagtgcttcttaattgtgtgtgctgctcatctagagatttcactgaactgcagattttgatgcattctccttgggagaggcctgacattctgcatttctaacaaattttcaggtgatatcaatggtggatgacagtctgtggccaacatttaattatgtagctgtgtcctgaggttacatatattgagatgcacagtgactggccagtagtagtaataaatggtaaccatcactgttagcaagcattcattagctatatgaattgacattcagctccctattaatgaactgtttcacatctgactatatggactctacagctgtcaggctttcttctatacacctgttcatatatactcataagggtcatttccttagaacttcctgtttagctattgcccaactctgcagcccccctgacttatggtactccagcgatctgccatccttttgcctgccaggtggccagaaatgttttctatttccccttactgtttcaggatattttgcagaactgtagtctgaaaatagtatagttctgttgaattgcccagagagatattttatcttcagactttctcaattattagaagagagacacaaaaatggaaaataaatgaatcagccagacttagcaaaagcatggtgatgaggatttgggtattggcgaaaccatttctataataagtattctgtgtccagagtgaatttgtatggtgtaaaagacacgtgctacccatgttcagatcatggttctgccatacaggttttgtgatttgaaagaaggcaattacatgttctgattctcagttcccgtctctgtaaaatgagtgggttagatggataattatttgttaagtcaactacatatttactcattcatgtttcatatctgtaaattttaaaaataaaaacaaaaactaaggaatattggaggcacttgcttatgataaggtaatcaactaaaataaccattttcaatgattttcatgtgttctttctgtaaactcttaggc

SEQ ID NO: 59629 - DNA, 1101 bp, Homo sapiens
taactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtatgtaaagctgaataccgttaaatgttggcattatttttgaagaaaaaaatgtttatatgtaaaatcacattcaaaacaaggcatttttaaattttaggacagtgaattctcaaggtatgtaaagaactattacaccaaaaacctagttttcatgaagtgtccttgaattgtctgcaggtagagcttacctgccatcccgattgaaaaaaaccagagtagaaaaatgtcacagggtccacatgatctgggagcccagcataatttggggcaaattgcttctttgcctaatttttaaaagaggtgacttaatacctatcaagtcttatgtagaatattgtttaaggatcaaatatagcaataataaatcttagatatactttgataaaccttaaagtaaactaaaattaattgtattaaaattatttttgaagacagatgctggaatagtaaaatgccagacctgtgaaagaagacccattgcaaataactatttgtaaatatggaaaatatactttgttttgttccttgttctcaactgacattcaaccaggccagataatccaaattttacctggagcaaatctaaaagttgttaacaaaattctaagcaaatgaattgacaaaattacctaccttttaaagttttccgcccaaatttattctagaataatattgcttgggtttgggcagcatctctgattcctgtcttaagaaagagtagacagtgttcctatacccggggtcaccggggacttggaggtccttgggtgagcctcatagaacccgtgaatatcttcaagtgattgtcatcatcatgagaattaaagatttctgggtcactgtgtgccagaaagtaagagttctaagcccttcactcatattaactcagttcattctcaaataagttaaagactattaatctccccattacatagatgacgagactaaagcat

SEQ ID NO: 59630 - DNA, 1782 bp, Homo sapiens
gtgagccaagatcactccactgcactgcagcctgttcgataaagcaagacgctgtcttgaaaaaaaaaaaattaatctcatttattaaaaacaaaattgaatgctttttctctagtgctacacttctggattaagcggtgctaagtagcaaacaggctgcatttaaagtcttttaaattgtcagtggtctagttatttttcttccaaaaagcttggagctctcttctgtgtgtggttttaaagaaaacaaatcccactggggggtattttaagtctgcctttaaaagagggacttgcttgatttgtaccctgtgatattcttttagctagaaaattcagaagaacattcacaaactaaaattaatttttatcttttctgttcttcacatgtacatataatcgtataaaaaacattttatatgactgatttttttttttttttactttggccgtttcaggtaactggggaagaagctaaacaagaatcattggagacttctaatcttgtgctttcgggtattggaagtacacaaactaatggaccttctgttcctagtgaagaagaaattgttcagccactggatagcacaagagtggcttcttacagtggcactgttactcaagccacattcaccaggacttacgatgggcctggcagtcagccagtgatatgtcagagctctgtgtacggcacccttgaaaacaaagtggatattcttgatgcagcagtgcaaacaaaaacaggtactttacaggaccttatccaacatggcagccccataaacaatgaatgtcacccttccttggaaagaaaggatgataatatggggtgtgcagtgattaacccggaaccaattactctcacctttgaaaaaaatgcacatgtaccaatacagacagaaggtgtaaatactgctgatgaacgtacaacctttaagaaggagttgattaagcaagtatcacctgctgcaagccttagacatcctgtatccacctcggaaaatgcacgaacacaaggcctgagggacattccctctctagtagttgcaggacagaagggcactaagtacctttgtgcctcgtcagtaggtggagagacacttgataaagcagtgtgttcattacagaaggagacgccccttccagtctctctaccatctgataaaacaatggtcatggaggcactatcattagctaaaagttctagtcatctatcacccagtgaagaagtgagatgcactcaggatttcctttcacagactcagagtctcctcggcctatcttcagaagggcttctagaactgacacaggttgaagtggactcatcatcagcctctaccaccttgggaaggcagtgttcacttaactgcatttcgtcaggatgccacacatcaggtgactctttagaactaaggaagaatcacaagaatggtccaaacactgaaaatatgaatttggaagcgtttgattcagtatttatcaaacaaacaagcctgtctgtgagtagagaggtcagcctagagttatcagaggaagattctgacattgacttagctctaacaatatcaccacctacaagtcccagagaagaaatgccagctggtgaaatagagcaatttgaggaggccccattctcaaatttagaacttcaggatgtagctgaggaaataggtgaaccggaagaggtggctctcacagaaagcagagaagtgagttctgctgacaatgtgtcagtatatccctcagtgtcagaagaaccagtagaaaataaggagagaaagg

SEQ ID NO: 59631 - DNA, 1051 bp, Homo sapiens
gccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaaggtaaagtgccagccacgtcttacgtattattttaattgctgattttagttttagaaataataaatttagcatattagccatcaaaaagaaatcatggtatgacatagtatttaaatttcacagcttagtctttatctgcatactaaatgttttcctgcaggatctgccatt

SEQ ID NO: 59632 - DNA, 1391 bp, Homo sapiens
ccatttaagattatagtttttacaagggtggtaaaacctttaaaacagagcataatgtgcatcgtatgcctttctgacattagcatgcaaaaacaaagctatttgttaaaatagacttatttttgctccaactaagtaaacatgtaaaattatttttaataagctcaatagcttagaaggcatcttgtttaaaatgaaaataatttaaaacaatatctagcactgcaacccaaagctaacagacaactgcaatgccactgtgacatatttcagcaaaatataaaaaatgaaaactttccaagttgtagaacattggtttttcaaatgtaagactgttcacatgtgtattcacatgttcacaagttttccaaagggaaaatactaattttttattggcatcatccatatccaggcaggctgtagttgagtcacctgaagaaacacaaaattgataaagaacttcttaaaataatacgaacaagaaatattttataagcgggatgctctaatggggaaaacgcctatgcattctaaggttacattatgttctgtactgacgatccaagttaacagcaagtgaaaatgcacattagataaaataggtaattttagtagatggttacttcatttagtgataatttaggaattcctatttatgccaaatagcaattccacccctaaacaaacactttaaatttatagcatgaagtatgtaaacaacagtttcccaactgtttcccttagacacaaatgtcaatatttgccatcaacaactccaactcacatgggaaagttacataaaaagtgttcttaccaatagctactcctaaatggagctgctattttttctatgttttctataaagttatttacatctgtaacaaggattccactattttcaaagacttctctggggatagtaggcttgtctgttaaaaaaaaaaaaaaacaacttttggttaatataattaatgtacttttatataacaggacctggttttttattttaaaaaatctgtggaacttcctcgtgtgaggggtagggggagaaaaggtgttgggttccaaattaagaaaagatttgaagctttggaaatagatgcctccatcgggggtggtggttaaagtactgaaaaaaaatccctgaaaaatgataactatggttctttacgtaaatttttcttaacacttttttttttttttttttaaagatagatagggtcttgttctgccacccaggttacagtgcagtggtgtgatgacggctcactgcagcctcgagcaatccttctgccttaacccaagtagctaggactataggcacacatcaccacacctgccaacttctgtagagatgaggtctcgctaagttgcccaggctggcctcaaat

SEQ ID NO: 59633 - DNA, 1090 bp, Homo sapiens
ggaattcctaaattatcactaaatgaagtaaccatctactaaaattacctattttatctaatgtgcattttcacttgctgttaacttggatcgtcagtacagaacataatgtaaccttagaatgcataggcgttttccccattagagcatcccgcttataaaatatttcttgttcgtattattttaagaagttctttatcaattttgtgtttcttcaggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataatctctttctgcaatgatttttatagcagaaattgacttatctggagtgttctagcaatttttaggtcatttagcagaacagtaagcttccagaggaaacctacacttctatcctttgggcctggcctgttctgtttctgggttctttccgcagtcaagta

SEQ ID NO: 59634 - DNA, 2104 bp, Homo sapiens
tagttaggtatgacagagctgttaagagatctcattccaaacttcagcagttcgctaccacttcaattcttaatctctagtaggttaaaagaaattcctattgttaaatatctgtgtactttacatccaactctgtcaccatttagaacttaagtgtagaagatcttgcctattgagagtaattttaactcacacctcatgacatatgggtgatacctgagtatgttgggtcccagatggagacacttgaggcagtgagctggtatcatttgtttctagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaagtgagttgtgttcttttatatctgccgagatgcaaactgaggcctttgattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggctttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactactgcccggtgttggtttgtgtgtcctgattgcaagggtcacagctgccgtgcttcctttggtagcactggagtcaatgccagtcagaatgctcagcagcggaaagcgtgggtgtcttctgatctggaaggatcacagcaggtcctgtcgtctggcttccctgtgagtagacctcgagttttattcttgacacagtaccattactagacctatcatctttgtgcagaaaaaatagtgtttaatgattttgcttgtagcagcagttataagggagtaagtgaactgtcaggtagagtaggtgctttagtaaataatttttgtgtagttgaaatgataaagtgtttacatataaggccctttcccctgacagtgatgagcctcacggcagatgctgttgtttaccacagata

SEQ ID NO: 59635 - DNA, 1116 bp, Homo sapiens
accaaaatatgttaccgtgctgagatgaatccgtacgggtctgcagcaacctcagttcttttctcctcagaagaaagaatgaccaaggggcataaggtagaaggagagactgaggcaagttttagagcaggagtggacgtttattgaaaagctttagggcaggaatgaaaggaaggaaagaaagtacacttggaggagggccgagtgggcagctcgaaagacaagtgcctggttagtgattttttttgacttcgtatttataactgattatgtttgtgtttttgactctgttttcttgctttaatcacttctaagctgacatctttctagaaggaaattgaacaaatgtatattgtctgtaactcattaagatctaagaaaggggactttaggagttgaaacaactatatattattaattgggattttaaaaattttccaggctaagtgctatttatggaggtacctatatgctgaataaacccattgaagaaatcattgtacagaatggaaaagtaattggtgtaaaatctgaaggagaagtaagtagcttttaaaatgaaaaaaattactatgttcttgtgaagaaagttgtgtattctaaatattgattttggtgtggacactgatgcatatgatttctgtatgggaagttagtatttattgtgactaaggactaattacagttgctgtgctttgttttaaaagcatcttttttgttgtcagttgttgattattttaatattgaaatatgcattatgggtgagctctaaatagtaagtattctgtatttatagagtttgggttgtgcctgtctcccaaattttcattgaaattgaactgtacttgcaggccacctacacgggtggggttttgagcagcatttctcaaatgtgaattatatataaagcatcattaatctggttctagtgcatgttctaatcagtaggtctgagaaggctctgcattttcttgaaacctcttaggtgatgtggatgctactgaaaaaaaaaatcacaaggaaaaaaagatcgtttccctttatcaccatatgaattaattcttctgccatttgacactgttactatctgcaacagttcttgcagtagaggatgca

SEQ ID NO: 59636 - DNA, 1505 bp, Homo sapiens
aagattggattgtctttctgtttttgacttgtaggagatcttggtgtatgatggtggcaagtcttttgtcatatatgtattaagaatattttctcccagtttatggctggtcttttgataagcataagtgttaactttttttttgagatagagtcttgctctgttgcccaggctagactgcactggcatgatcttggctcactacaacctctgcctcccaggttcaagcaattctcatgcctcagcctcccgagtagctgggactacaggcatgtgccaccacgcctggctaatttttgtattttgggtagacggggttttgccgttattgaacaggctggtctctaactcctgacctcaagtgatccacctgccttggcttcccaaagtgctgggattacaggcaggagccacagtgcctggcctagaagtgttacattttgatgaagtccagtatatcaaagaaaaaatttttttaatgtttatagctttttgggtcctattttagaagtcttttttttttttttttttggagacagagtctgggtgttttgcccaggccggattgcagtggcactgtctcggctcactgcaagctctgcctcctgggttcacgccattctcctgcctcagcctcctgagtagctgggactacaggcgcctgccaccgcgcccggctaattttttgtatttttagtagagacggggtttcactgttagccgggatggtgtcgatctgctgacttcatgatccgcctgccttggcctcccaaagtgctgggattacaagcgtgagccactgcgcctggccctattttagaagtcttttacttgcccccaagggcacagaaatactctcctattgtctttttttttttttttttagaagttttataattttatctgtgcatttaaatctgattcatcttgagacagtgttggtgtgtgggatgaggtaagacttgaggttcttttttttttttacatacgaatatttagttgttttagctgcatttgttggaaagacttccttttctaggtagtcgtggtgcctttgtgggagatcagttggctacatatgagtttgttttgggactcagttttgtttcagtgatttgtatttcctatgccagtactacactgtctggataattatagttttatattaagtcttgaagtaggtgataacactttcgccaactttttcttcagaatttgttttgggtgttcgcatttccatatacgtttttaaaatcaggttgtcaatttctagaaaacatgcttgttgggattttgatattgagttaaatttgtagatgagtttggagaaaatgatcatcttaattatgctgagtctgccagtccataaatatgattgttctccatgtggttttcttctcagcagtgttttacagctttcactgtagagatctatcacatttttgttcaatctctttgtactgatgccgctgttaatgtattttgtattgatgctgctgttaatg

SEQ ID NO: 59637 - DNA, 1718 bp, Homo sapiens
gaattgaagactttataagtaacctgttataatcgtgtcagtttaaggtgttgtgaaactggaagccatgctgtccaaactcccatatcttaaattgcatcctgcattttaggcgcggtggctcatgcctgtaatctcagcactttgggaggccgtggtgggcggatcacctgaggtcaggagtttgagaccagcctaacatggtgaaaccttgtttctaccaaaagtacaaaaattagctgggcgtaatggcggttgcctataatcccagctactcgggaggctgagacaggagaatcgcttgaacacgggaggcagaggttgcagtgagctgagattgcgtcattgcactccagtctaggcgacagagcaagactctgtctcaaaaaaaaaaaaaaaaaaaaaaattgcatcctgcattccgcagttgataacaaggcatgtttaaactttgctctcatacttcgttctcctcaatgtctgattgtgagtgtgctttttgaaaaattcttttttatttaggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgatccaaaacctcatcttcaacataatgtgtatatgagatatagtttaaataatgagatgagatcagtctatgagtaataagatgctttttatttttattgaaataaaattaacatataatgatatgcatggatcttcagttaaaaaaaatccagttttatacaactgtagctgatgtgctcttgtaagtgccaactcctggctggaggccagccaatacaaaaccagcgcacttaacaaaaatacaaccaaggaccttc

SEQ ID NO: 59638 - DNA, 1035 bp, Homo sapiens
aggatcacctgaggtcaggagttcaagaccagcctggccaacatggtgaaaccctgtctctgctaaaaatacaaaaaattagccgggtgtggtggcgggcacctgtaatcccacttactcaagaggctgaggcaggagaactgcttgaatccttggaggtagaggttgcaatgagctgagattgcgccattgcactcctgcctgggcaagaagagtgaaactctatctcaaaaaataaataaaaaaaaaaaattaaaaggtgactaatgtcttagtgttattatgaaacagttttaatcttgggatgcataggagcccacagaccacacctggacccctggtttcttaagggctttcttcataaattatgtcatgttgcatgaatataagtgtaattactaagagaatgtgtaatggcaggcttgaaaaaaatgatctgttttaaatatgctgtagaactttcttttcaaggtactatgctttttctataggaatgtatcctgtcaggtataatgtcagtgaatggcaagaaagttcttcatatggatcgaaacccttactacggaggagagagtgcatctataacaccattggaagatgtaagtgttagtcaaatttcatacgcctctcacactttgtgagtatttcacttgtgaatctctaccttattccttagagatggtcttaattttgttttgttaaatggaatatctggagcactgtttttcaggagcttctggtttgaagctcatagaaatttacattttgacttttgttgctatgtggagcagttatctcttagcattaacagagaatagtctaggaagggagggtagaggatcgtctgatgtgccagcgcaagtccagtgctttcctcatggctttatttattttctcagtccctcaaagattttttttttaatctccatttaacatagtctctgtggggttaaaatctgagatgggttgtaaacccaagttacatgactacaaagcttagttccttttgctatactgccttgtttcctacttttt

SEQ ID NO: 59639 - DNA, 2107 bp, Homo sapiens
gccctacccactgcaggttttgtgcttttttttttttttttttaagtgcctaattgggattccaagctgagcttagtagtttgtggtggattttgcctgttggaatgggtagtgttgctgccagcgtgttttaagagccggttagttccaccgtttttctatggttgttgctggtctttcagatttgctcacaattgaggtcagttaagcatgcacgagtgagtgcaaatccaccatcatgcaggcttccacaagcctcgttcacatcactttgtatcaaagatggtgaaagtgtttttatataacaagttaagataatgagctttgtttaaattttcattcggattgtgaactctttgatgaatggtagatgcatacttaactagaaatcagacctgtttctgctgtcattttgtagctgtgataactttaatctctgtgagccttcctaagttttctgagatgttctttgataattatatcaattcaggacaatcacattattaccatcattgataggagtagtgatgacaggatgattttgataatgagaaatcatatatccttatttttagtgttaccaggaattagatgattaaaaattagaagaagagaaaaccaaagttagcactcagaattaacttttgaatgtctggagttaattaattttcttaaaatttactttagtgcctgagacttaagaacctaaaaaaaggcaagtactttcagtgttaggaacttgttacttttaaagaagtgtaaggaagtgctggagttgctgtgttgcttagtgctgccattgtttgtatgagttgttaagtctaagctcataatcacaaatattgatagttatcttaatcaagaagatacaaaacgatttggtataaaggagtaaaatcttcattctgtgtgtaaaagaaatggaatattccacacaattgaattttctgaggaactaaaggttatctctaaagagcacagcttttggataatgcctttctaaatgctgtcacaacttctttaacaaactaagaaacataatttacttgataaccaagttttcacatagtgaagattaactattgtgttatgctgtaacatggtgaagccatgaagaccccgccagctttgtaggaacttttgccccctttactctcaggctgctatgctttttgagctcttcagtttactcttcatattttttccctctatcttactttactgttaggctggcaacatttacttttctctgctttcagcatgtgtaggcagcctctcaccacataatttgcacatagttcactatggacttggaaataaattcacgagtcttgttagacatagtagattaaaacaataagagtaactagttccacagctgtttgtgcttcccagaggtttttttcttcccattttttgttctacacagtaagaatttatgaatagaaatatatactttagtgatgtataccagatgattctcagcatcatatgtttaaaaacttgctttacatcccagatacttttcctcatttctctttatcagaattttgtgatttcagattcagagaaggttttatacttgattttaaaattctgaactaaaattcagattgcctcttggatttgcttaatctttgatttgctctttgagagttcttgcttatagctgtgttagagttctgtagacaaaggactttctattcactacagtagtgagcataggatcaatatttgcaaatgctgttacacttgggagctgtgttgtaggcagtttaaaccagcgttaagcatcctggccaaaagaaaatataagtgaaattagacatattttagcatgtagagatgacaatagtgtgacattggtttttaaagaccactggtagatgttcacatgcgtgatacactgcaattacctctgtcttccctcccatggtacctgattggagactcttactggagtaatagtttcagtttcagttatttaaacccagtgactattgtgatcagttatgggcagtaaaaaggtaaacacagaacctgtctataagtagcttgttctcgtgttggagagtaactaataagaattagtatgagaaagcattaa

SEQ ID NO: 59640 - DNA, 1010 bp, Homo sapiens
cagaacggtggtggccagcagtccccgcccgcggctccgtgcacctccaccccggcccgcgcgccgcctcccgaaccaccgtggcagaggccgcaaggggaaccggaagccaaaatggcgacgccccgcccttttcctctcgcgagaggcggggaaggaaaaaaagttgtgcgagcgacggggacgtaaccaattagagtgccgggagcgcctgattggcggccctcccggcgcctgcaggccccgccccggctgcggaggctcagtcacagccctcccctcctcgctccctcccctcctctccccgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggtgggcgccagggctgaggggccggggctgagcagccggggcgggcgcacccccggctcctgcacggcccgcgggtcgcagctcctcgggggtctcgttctgccgtcagccgtagttttcgggacgggagtcgtggctaggggcgcgggcgggttcaggggcgccccgcgtcccggggcgagcgggcggctcccagtgtgaggggcaggcggggaaatggagatgcgggccgtgaggctcggggcggggtgacggccgagcccggcctctgcgcttgcccccagcggaagcggaggggaggggagaaggccgcccgggccaagggtcccgctccccggtttgggccggtgacctcgcccggttggaaaccagcacccgaggcggaggggacggtgcaggcctcgcggttgcatttcctattccgcctcggccgctgccccgggtcagtctggctgccaaagccgagtacggggtttcct

SEQ ID NO: 59641 - DNA, 1040 bp, Homo sapiens
tgggattgcaggtgcatgccaccatacctggctaattttttatatttttggtagagacggggtttcaccacattggccaggctggtcttgaactcctgacctcaggtgatccacccacctcggcctcccaaagtgctgggattacagtcgtgagccactgtgcccagctcagacacagatgtcttaaatattttggctgtggaattgaaggatgggggtaatcaattgattatgaaggatgcaggaaaggcagtggcaaggggtggcttccaggtctctggtgcaggaagctgaagagaccaagtgctgtcaaatgggatggagaaggttagaggagcagcaggtctgctagggaagaccatcacgctcctgaaggcttagtgctcagttcggacactgagatgggggagaatagagagagctccatgctcacaggtcatttgcacacacgcagttcacctgcaggtgatcaggtgtcaactgtcccctgggtttgaggtattgaattttctcagctcttacttggggttttggctctaggtgccaatatgaaccagactacagagacaactgtggcgtcaccgccttgatggacgcaatccagtgtgggcacatcgacgtcgctaggctgctcctcgatgaacatggggtataaaaatggttgtgtttttattcttttggttcttcctataaattttaggtcacaggttaagcagagcacattgttactcagatcccaggttccattccccagcccctccaaactctctctctggaacttggtgacctctttaagcaccagtgttcccatctgtaaaatggagagaaatgtagtttcttcagaaagttttacaaggattaaataatataatgtacataaagcagttagcaaaatattcagtaaatggtagctgttttatagcaataataacaacaaactgtctctgctgatagtgcttttggcaccatagcctggaacattgaatcataaccatctttttgattagagagcccttttttgagagcagggcgtgatggct

SEQ ID NO: 59642 - DNA, 1025 bp, Homo sapiens
tttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagc

SEQ ID NO: 59643 - DNA, 1081 bp, Homo sapiens
tggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccg

SEQ ID NO: 59644 - DNA, 2447 bp, Homo sapiens
taagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaa

SEQ ID NO: 59645 - DNA, 1044 bp, Homo sapiens
gaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagtta

SEQ ID NO: 59646 - DNA, 1476 bp, Homo sapiens
tcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgctta

SEQ ID NO: 59647 - DNA, 1048 bp, Homo sapiens
tataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgc
